United States Patent 8,344,211 (PLANT NUCLEOTIDE SEQUENCES AND CORRESPONDING POLYPEPTIDES) - sequence listing, part 13

SEQ ID NO: 48932 - DNA, 774 bp, Zea mays
  misc_feature: Ceres CLONE 1458816-F
  misc_feature: Encodes the peptide sequence at SEQ ID NO. 48933
  misc_feature (427)..(427): n is a, c, t, g, unknown, or other
aagctggagctccccgcggtggcggccgctctattctagtggatcccccgggctgcaggaattcgcacgagaccattacctagaacatcctaatcgaaaaaagactccgcaacctccctctagcccgagcgaacaacaaaggagggtgctctgccggtggcggagcggagatgtccgagaggaggcgcggcgccggcgccggcaccggcccccgcaaggatgaggtggtgacccgtgagtacaccatcaacctccacaagcgcctccacggatgcaccttccagaataaggcaccgaatgccctcaaggagatcaggaagttcgcccagaagaccatgggtaccaccgatgtccggatcgatgtgaagctcatgaagaacgtctggaccagcggtatccggagtgtgatgaggcgcaccacgcccangattgcccgcaagaggaacaaccagcaacacaccaaggaggggcagcactctctggtcacattaactgagatccctccggagggtctcagaggtttgggaactaaggttgttgaggatgaggattaactccaagggttcaatcctctagcacttagatgcataccatgagaccaagtttgataatgctgcttcagcttgttatctatgcccgaatgacttgctgatagaagtttcgagaccttgctcctttcaaatttttgaattttgcctacaaaaaaaaaaaaaaaagcttatcgataccggcctacctcgaggggggggcccggttacccaattgcccctagag

SEQ ID NO: 48933 - protein, 127 aa, Zea mays
  misc_feature: Ceres CLONE 1458816-F
  misc_feature (15)..(109): Pfam Name: Ribosomal_L31e Pfam Description: Ribosomal protein L31e
  misc_feature (86)..(86): Xaa is any aa, unknown, or other
MSERRRGAGAGTGPRKDEVVTREYTINLHKRLHGCTFQNKAPNALKEIRKFAQKTMGTTDVRIDVKLMKNVWTSGIRSVMRRTTPXIARKRNNQQHTKEGQHSLVTLTEIPPEGLRGLGTKVVEDED

SEQ ID NO: 48934 - DNA, 710 bp, Zea mays
  misc_feature: Ceres CLONE 1458822-F
  misc_feature: Encodes the peptide sequence at SEQ ID NO. 48935
  misc_feature (657)..(657): n is a, c, t, g, unknown, or other
ctggagctccccgcggtggcggccgctctagaactagtggatcccccgggctgcaggaattcgcacgagaccattacctagaacatcctaatcgaaaaagtttgcatcctgagctctctcctggaccagccgagatttctcgctctgcgcatctctgattcatcttcgtcgagaggagctgttcctcttctttgccgcctcgaatctgggactggtcggttttctggatccctgctgcctgtcgggttctcgagaggtgtaaaatccaatggagggtgtgtcatcgttgaaccagccgttgatcaacgacgaccggcagcccgtgcccagcagtatcgccaagggtgatcaaatccaaggcctgttgtcgggtgaatggacaaatgagcggcacagctcgtacataagctccatggaggcatctttcgtggagcaactccgtagtggttccaaggccatccaggagggcttgtgccagagcatgaggattccgagggatgatgctcgcagccatgacgtccctgagagtccgtgggtggtggtgaggcgtttcaggccacgcggtgtccaccatggcgatggaatggaagtggaacctttggtcgatggttatggatcaggtactgacacggcccgagagaaggtccggacccacgncagagtagcgaaggcttctgctattatttgagtcacggaccagaagcttatcg

SEQ ID NO: 48935 - protein, 139 aa, Zea mays
  misc_feature: Ceres CLONE 1458822-F
  misc_feature (130)..(130): Xaa is any aa, unknown, or other
MEGVSSLNQPLINDDRQPVPSSIAKGDQIQGLLSGEWTNERHSSYISSMEASFVEQLRSGSKAIQEGLCQSMRIPRDDARSHDVPESPWVVVRRFRPRGVHHGDGMEVEPLVDGYGSGTDTAREKVRTHXRVAKASAII

SEQ ID NO: 48936 - DNA, 762 bp, Zea mays
  misc_feature: Ceres CLONE 1458828-F
  misc_feature: Encodes the peptide sequence at SEQ ID NO. 48937
tggagctccccgcggtggcggccgctctagaactagtggatcccccgggctgcaggaattcgcacgagaccattacctagaacatcctaatcaaaaaacgctacagagcgcagagctgcacgctccaccggcgaactcacctcggccgccctcctctgccagatagcctccctctactattcaagcccaaaccctaaatcctcggttcccaaatggcgacgccgccgactgcgctgctgttgctcctcgcggcggcagcggcattccacggcgcgacggcgaagacgacgatcgagccgtgctctggcgcggacgcgtgcccggctcttctgggctacaagctctacgcgaacatgaaggtgtccgaagtgggcgcgctcttcggcgccgacccggcagcggtactggctgccaacgcgctgggacttcgcctctccaggcgccgccaaacgcatcctccccgggggaacacccttcgcgtgccaaccgctggcgctgggcccaaggggtccgaaagtcgttcccatccgtaagccgccggggcttccaaaccgtttggtccatttccgaggtggttttcccggccccccctggggaaaaaatcccaccccccaagggttccccccaaaaaaccccaacgccctttaaccggggaagggggggtatccccccccccggggggggtaaaaccccacaaaaaaaccccccgggggggcccctcttatttcggggggggggaaccctaaaactcctccccccccc

SEQ ID NO: 48937 - protein, 106 aa, Zea mays
  misc_feature: Ceres CLONE 1458828-F
MATPPTALLLLLAAAAAFHGATAKTTIEPCSGADACPALLGYKLYANMKVSEVGALFGADPAAVLAANALGLRLSRRRQTHPPRGNTLRVPTAGAGPKGSESRSHP

SEQ ID NO: 48938 - DNA, 794 bp, Zea mays
  misc_feature: Ceres CLONE 1458829-F
  misc_feature: Encodes the peptide sequence at SEQ ID NO. 48939
  misc_feature (410)..(410): n is a, c, t, g, unknown, or other
ggagctccccgcggtggcggccgctctagaactagtggatcccccgggctgcaggaattcgcacgagaccattacctagaacatcctaatcgaaaaacttggccgtcctcccgagctgcggcggccgcatcgattgctagggtgaaaatccgttctccggcgattttgggctctcgggaacagacaggaggatccgcgggaaggattcggctgcgtcctagtgtagtgtcgacatggctgggcgcaaggagaccgcactcgacctggcgaagttcgtcgacaagggcgtccaggtgaagctcaccggcggcccgcaagtgacaggaactttaaagggatatgaccagctactcaacctagtgctagatgaagcagttgaattatgaaggaagccagatgaccccttgaanctttcagggaaaaccagacggctgggcctctttgggggcaaaggcccgcattcatgctggtccccccgactgatggaactgatgaaatccccacccctttttttggcgaaaggagaaaaaccttggggttgggcaaataattaaaaaccgggtcctttgttccccccaaaaaaggtgggcccccgggggaaaaaaaacctttttccccccccgggggggagaaaacctttaaatttcccccgggggggggggcttttaaaaaaaaaaaaaaaaaaaattttttttctccccccccccccggggggggccccgcccccccccccccaagagggggatatccccccccccgccgggcgttttttacacgcgggggggggaaaaccc

SEQ ID NO: 48939 - protein, 50 aa, Zea mays
  misc_feature: Ceres CLONE 1458829-F
  misc_feature (9)..(50): Pfam Name: LSM Pfam Description: LSM domain
MAGRKETALDLAKFVDKGVQVKLTGGPQVTGTLKGYDQLLNLVLDEAVEL

SEQ ID NO: 48940 - DNA, 890 bp, Zea mays
  misc_feature: Ceres CLONE 1458831-F
  misc_feature (15)..(15): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (39)..(39): n is a, c, t, g, unknown, or other
  misc_feature (40)..(40): n is a, c, t, g, unknown, or other
  misc_feature (890)..(890): n is a, c, t, g, unknown, or other
atttttttcccaaancaccacccattnnnnnnnaaaaannaaaaaaaactgggactccccgcggtggcggccgctctataactaatggatcccccgggctgcaggaattcccacgaaaccattacctaaaacatcctaatcgaaaaagtctggaacatgttattgtcgagtcggcaagaaaggaatagataccagaccaattcgtggtgtgaaccacgggtgtggttcacatttggtaccacagccaatactggatcctccacacgggtactggacgagatcgcaatcaaagttgggcggtctggtgccacgaaaagaagaacaatgcgttgtccccgcttctggcgaatatgcaggaaggaaaacagggaaactcacccgacccatggaggcgattcaggcggcggtcgggaaatatgtagggagtccaacaacgtggggattaccgacaaggtaaaatcttgtgtccccccaccccgacgcgcaacgaaaagttgacggacatcttccaacaaccaaaaggccaccccggattcctaatggcaaagaaggctagaaaaatcccttccgctttgtgggtccatccagcggacagaaaagtgagaataactttattttttgaaactcgcccctagtaaggttttcttctcaaattaggagagtaccgctccttgaaagaagtgcagagaccaagttcttcctgggtgcgggattttggggggtggacctcgctactctggagaataatccccttaatacatgtggtgtgtgggtctaaaactagaggagtcctcacttttccctcatttgggggagctctccgtgcttaattttgctggggcggcgtggtatgaaaagttgactatggtgcctctactcctcaaccacan

SEQ ID NO: 48941 - DNA, 656 bp, Zea mays
  misc_feature: Ceres CLONE 1458837-F
  misc_feature: Translation starting site: 213
ctggagctccccgcggtggcggccgctctagaactagtggatcccccgggctgcaggaattcgcacgagaccattacctagaacatcctaatcgaaaaaaacccttcgaaaacccttctcccgtcctgctcactcccgtctccgagcgccgccgccgccagcgccgatacgcgataaacaagaggaagaagaggccaaccgatccagcagcgatggcgggcgggggcatgctggggggcgctttctgggcgacgcgggcgctggaggtggtcaagcggaacgattccccgggcctattgtggaagcgcatcaagctcaccaccacccgcaagaacaacgccaagaagcgccctcagcggctcttgggaaaatggaggggggttataaaaactggggttgatcagcgtctgacccgggttcccaagggtgaaaaaaaaaggtagcttgggaccccaaaatgggggaaagggccccggggaccccaccccttgggtttgaaaaaagaaaaaacccttgtttttttttggcccccccccccccccaaaagtttttttttattttttcccggccccccccaagaaagaaaaatatttttccccccccccaaagagaaaaaaaatttttttgtggtgtggaccacaccccccccccccccc

SEQ ID NO: 48942 - DNA, 813 bp, Zea mays
  misc_feature: Ceres CLONE 1458840-F
  misc_feature: Encodes the peptide sequence at SEQ ID NO. 48943
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttttcctttctccccttctcctatcaccccccnnnnnnnnnnnnnnnnaaaaaatggagctccccgcggtggcggccgctctagaactagtggatcccccgggctgcaggaattcgcacgagaccattacctagaacatcctaatcgaaaactttcggaggaggcggaccaggtaagcagcagcaggaaccctagcaccgctgcatccgaagccatgggtatcgacctcggtgccggtgggaggaacaagaagaccaagtgcacagcgccgaagtccgacgaggtttatctcacgctccttgtcaagctctaccgtttcttggtcaggacgaccaagagaaacttcactgatgacattctcaagaggctcttcaagagcaaaaccaatcgcccaccaatctccatgcgccgccttgacaagcccccccaaggaaaggagaaaaacattgctgtgattgccgccacccccacagatgacaagaggatcccagacggtccagcaatgaaggctactgccctgatagtcaccgagacgccaagggccccgatttgccaatgctgggtggcgagtgcccccacattttggaacaggttgccctccgggctctactttgggtaaaaacacagtccctcttgaaggggcacccaaaaaatgccccgtgaaggcgttgaagggtacattccggaaaggccttcttgaaagtggcccccacaaccccctatcaaagcccttaatggcgcccctcctccaggcaaaagtgaagatcccgtagaagggctccgctggacaagcgatgaaaaccacgcccgggg

SEQ ID NO: 48943 - protein, 134 aa, Zea mays
  misc_feature: Ceres CLONE 1458840-F
  misc_feature (12)..(132): Pfam Name: Ribosomal_L18e Pfam Description: Eukaryotic ribosomal protein L18
MGIDLGAGGRNKKTKCTAPKSDEVYLTLLVKLYRFLVRTTKRNFTDDILKRLFKSKTNRPPISMRRLDKPPQGKEKNIAVIAATPTDDKRIPDGPAMKATALIVTETPRAPICQCWVASAPTFWNRLPSGLYFG

SEQ ID NO: 48944 - DNA, 648 bp, Zea mays
  misc_feature: Ceres CLONE 1458843-F
  misc_feature (350)..(350): n is a, c, t, g, unknown, or other
tggagctccccgcggtggcggccgctctagaactagtggatcccccgggctgcaggaattcgcacgagaccattacctagaacatcctaatcgaaaaacaatgagttgccactagatatacgcgaagcctctcccacctcatctgcctcgcgtgcggcggcggcgactccacctggcttgcgtcctcccgttttccagccagcaagccagactcctcccctctccgaagactccgatcgtccggattcatccagatccgggcgttctagtcctgccgaggctctagatcgcgtcgcgcacgatgccacgcgacctgtcgcggtcgcggtctccgccgcgccgacttggcngtcgccgtctcccgcgcggtacgcgggcggagggggcgcaggaacgaaacccccagtcccatcgtagcaggtccccctatcgctcctcgaaaagaggaggaaaccttttgcctccccaagaaagaaacaaaaccccttctccgtcccctaagaagggcaaaaaatcccttccccttccaaaaaggtttacaaaaaaaaaaaaacccaaaggtgcttatttctcccggggggggatttaaaaaccccccctttggggtgggaaaaaaaaaaattttttttttatcccccagggctaaaa

SEQ ID NO: 48945 - DNA, 800 bp, Zea mays
  misc_feature: Ceres CLONE 1458845-F
  misc_feature: Encodes the peptide sequence at SEQ ID NO. 48946
  misc_feature (395)..(395): n is a, c, t, g, unknown, or other
gctctagaactagtggatcccccgggctgcaggagttcgcacgagaccattacctacaacatcctaatcgaaaaagcgatgctgcagatccgcctgagcaagattggctcgtcggactccggcggtgccgccgctagcacggaagctggcgccggcgcccccgccacggttggggcggctgcggcgctcggtggaagcatcctggaatcggtcaccgtgtcatgccccgaccacctcgtgatcgcggacctccccgtcacgaagagcctcggcgccgacacgacctccgctgccgccgccacgcccgccatcggccgtcgttcccgtctcccgctcggggattttttacacatcagactccagcagaaaaattcccatttaactccccccgctcnccccaccccttgggaacatgcctcccgggttaaccttggggaagaacgggtttgtagcttggtactttttgtgagcacccccctttaaaagaaataaacgcggtgaaaaattaatgcacggaaattttctctgtgtgggtgggacaaacgggacccccaaacgttccctaagaaagcgctaatttgggagccccagtttgccgtgagtgttagggccaccgccctctcaagccaattctctagtacgggaagaaaggaaggcatcgtgccaacaaaggccctaaaccttccctgggtgctgtttgggtgggaccaacctctcaatgacatctctaattatctttaatatctctcgcgtcgctggggtcatctcctcctctcgcgacggtgaggtactatcaattg

SEQ ID NO: 48946 - protein, 134 aa, Zea mays
  misc_feature: Ceres CLONE 1458845-F
  misc_feature (106)..(106): Xaa is any aa, unknown, or other
MLQIRLSKIGSSDSGGAAASTEAGAGAPATVGAAAALGGSILESVTVSCPDHLVIADLPVTKSLGADTTSAAAATPAIGRRSRLPLGDFLHIRLQQKNSHLTPPAXPTPWEHASRVNLGEERVCSLVLFVSTPL

SEQ ID NO: 48947 - DNA, 784 bp, Zea mays
  misc_feature: Ceres CLONE 1458848-F
  misc_feature: Encodes the peptide sequence at SEQ ID NO. 48948
  misc_feature (640)..(640): n is a, c, t, g, unknown, or other
  misc_feature (648)..(648): n is a, c, t, g, unknown, or other
  misc_feature (661)..(661): n is a, c, t, g, unknown, or other
  misc_feature (662)..(662): n is a, c, t, g, unknown, or other
  misc_feature (682)..(682): n is a, c, t, g, unknown, or other
  misc_feature (722)..(722): n is a, c, t, g, unknown, or other
tggagctccccgcggtggcggccgctctagaactagtggatcccccgggctgcaggaattcgcacgagaccattacctagaacatcctaatcgaaaatccttcgtggcttcgtgcgttcgttcaatttgctggtggaacgtggaagaagagcgagaacgccaagcgagaaaagaaacccaagccttcgccatcgaaaaaaaaaaagaaaagaagaaaaaagagcagaaaaagtagagtagactacgacggcgtccggcgaggaggcggaggctaagatgaggaagaagctcggcacccgatgccccgcggctcgaatcaaaaagataatgcaagcagatgaggatgttggaaagattgcactaggagttccagttttaatttcaaggtctcttgaattgtttttacaagacttaattgaccgcacttatgaaattactcttcaaagtggaccaaagacactgaattcccttccccctgaaccaatgtgtgaagaggtacaagttcttttgaattccttaaactgaatttgtcagccaggggtaccaaatctgtggtgggccttgattccttggggataggaaacaaggattccctaatacaagggccattaagaaatggcaaacctccctcctcccaagnacctgggnagggggtccaagnnaaaaggacaatggcccgccnccaaccaaaaagaaaggggggtgggtattgcacaaatttnaaaataaaaacctcgctggtttgctcgaacaagggggaccccctttcccaagagtggaaaaa

SEQ ID NO: 48948 - protein, 82 aa, Zea mays
  misc_feature: Ceres CLONE 1458848-F
  misc_feature (7)..(78): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
MRKKLGTRCPAARIKKIMQADEDVGKIALGVPVLISRSLELFLQDLIDRTYEITLQSGPKTLNSLPPEPMCEEVQVLLNSLN

SEQ ID NO: 48949 - DNA, 727 bp, Zea mays
  misc_feature: Ceres CLONE 1458854-F
  misc_feature: Encodes the peptide sequence at SEQ ID NO. 48950
  misc_feature (700)..(700): n is a, c, t, g, unknown, or other
tggagctccccgcggtggcggccgctctagaactagtggatcccccgggctgcaggaattcgcacgagaccattacctagaacatcctaatcgaaaagaaaccagctggattttcttcccacttcggtgtgctggtcgacgtggtcgtcctgtcccttctctcctctcgtctccacagtccacacacaccgtgtgcggcggtagctgctgctgcccgtgcctaccgaagaagacaagtccaacactgttgttctgttccgtgattgcggaatttgcttcaccacaccttcatcagagagccgagacgacacgctcgggacccagcaaggcaagaagaacacgagagagatagcaggcaccaggtagggatcaatcatccgtccatggagaacctaaaggagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacaacctcctcgcccacgcccaggcccaggccctgaagccgcaggccagtaacgcccccgcccagctcggccgcccccgtcccggccccgccgacgaccactccccaaggggagggaaagagttcctganttacttccggtgtttgatcaaggcctg

SEQ ID NO: 48950 - protein, 114 aa, Zea mays
  misc_feature: Ceres CLONE 1458854-F
  misc_feature (106)..(106): Xaa is any aa, unknown, or other
MENLKERGHDAAGANAWMTVPAFGDWDTKNGALPDYSMDFSKIREMRKQNKKELSRASLGGDDNLLAHAQAQALKPQASNAPAQLGRPRPGPADDHSPRGGKEFLXYFRCLIKA

SEQ ID NO: 48951 - DNA, 743 bp, Zea mays
  misc_feature: Ceres CLONE 1458855-F
  misc_feature: Encodes the peptide sequence at SEQ ID NO. 48952
  misc_feature (729)..(729): n is a, c, t, g, unknown, or other
  misc_feature (743)..(743): n is a, c, t, g, unknown, or other
ccccgcggtggcggccgctctataactagtggatcccccgggctgcaggaattcgcacgagaccattacctagaacatcctaatcgaaaaaaacaaaagcctcgagccagtgtggtgtggggtcgcgtgctctcttctatcctgctctgctagtgccaggattccgccctatccatcccatcaacctcaactaaggtccccagcggcggcgaggagatggcggcgcctgtgacggcgtacggaccgatgctctcaccagctgtggaccgcgtggcggactgcctcctggagaaggacgtgccgttccagatcgagccggtggacatgtccaagggcgagcacaagtcgccgtccttcctcaagctccagcccttcggacaggtccctgccttcaaggaccacctcacaaccgtctttgagtcaagggctatttgccgttacatatgcgaccagtatgcggactctggtaatcaggccctcttcagcaagaaagaagacagcgcggttggccgcgctgccatttgacagtggatagagtctgaagggcacgagctttacccaccggagctggctattatcttccagctcgcatttgcacagatgatgggcccggacactgacttggctgtggtggagcaaaatgaatctaaccttgcggaggtgcttgaagtgtatgaccaacggctggggggagagcccggattttgttggggaagatttccccctggnccaactttgtgccn

SEQ ID NO: 48952 - protein, 102 aa, Zea mays
  misc_feature: Ceres CLONE 1458855-F
  misc_feature (3)..(78): Pfam Name: GST_N Pfam Description: Glutathione S-transferase, N-terminal domain
  misc_feature: SWISSPROT Homolog: EC 2.5.1.18 Glutathione transferase
MAAPVTAYGPMLSPAVDRVADCLLEKDVPFQIEPVDMSKGEHKSPSFLKLQPFGQVPAFKDHLTTVFESRAICRYICDQYADSGNQALFSKKEDSAVGRAAI

SEQ ID NO: 48953 - DNA, 752 bp, Zea mays
  misc_feature: Ceres CLONE 1458857-F
  misc_feature: Encodes the peptide sequence at SEQ ID NO. 48954
  misc_feature (644)..(644): n is a, c, t, g, unknown, or other
  misc_feature (704)..(704): n is a, c, t, g, unknown, or other
aaagctggagctccccgcggtggcggccgctctagaactagtggatcccccgggctgcaggaattcgcacgagaccattacctagaacatcctaatcgaaaattcacccacctccgccagccactccaaacacttgcgccgccgctgcctcacaggtaaggccgccatggtctccggttcgggcgtgtgcgcgaagcgcatcgtggtcgacgcgcgccaccacatgctgggccgtctctcctcgatcatagccaaggagctgctcaatgggcagaaggtggtcgtcgtccgctgcgaggagatctgcatgtcgggcggcctcgtccgtcagaagatgaagtacctccgcttcctccgcaagcggatgaacaccaagccgtcccacgggcccatccacttccgcgcccccgccaagatcctgtggcgcaccatccgcgggatgattccgcacaagaccaagaggggggaggcggctctggcgaggctcaagacgtacgagggcgtcccgccgccgtacgacaagaccaagcgtatggtcatccctgacgctcttaaggttctgaggctacagcctggacacaagtactgcctcctcggcgagctctctaagggagtcgggtggaactaccatgacaccatcaggnaactttgagagaagaagaagggagaagccaaggttgcctacgagaggaagaaagcattgncaagctgcgtgtcaaggccgaaaagcagccaagagaagttggggtctc

SEQ ID NO: 48954 - protein, 161 aa, Zea mays
  misc_feature: Ceres CLONE 1458857-F
  misc_feature (11)..(127): Pfam Name: Ribosomal_L13 Pfam Description: Ribosomal protein L13
  misc_feature (160)..(160): Xaa is any aa, unknown, or other
MVSGSGVCAKRIVVDARHHMLGRLSSIIAKELLNGQKVVVVRCEEICMSGGLVRQKMKYLRFLRKRMNTKPSHGPIHFRAPAKILWRTIRGMIPHKTKRGEAALARLKTYEGVPPPYDKTKRMVIPDALKVLRLQPGHKYCLLGELSKGVGWNYHDTIRXL

SEQ ID NO: 48955 - DNA, 769 bp, Zea mays
  misc_feature: Ceres CLONE 1458859-F
  misc_feature: Encodes the peptide sequence at SEQ ID NO. 48956
  misc_feature (372)..(372): n is a, c, t, g, unknown, or other
  misc_feature (473)..(473): n is a, c, t, g, unknown, or other
  misc_feature (584)..(584): n is a, c, t, g, unknown, or other
ggagctccccgcggtggcggccgctctataactagtggatcccccgggctgcaggaattcgcacaagaccgttacctagaacatcctaatccgaaaacagcgcataagaacacagcacccgcctgcctcgccgccgcaatggccgccgccgcctccgctgcgagatccttcctccggtccagcggctcatcgtctctccgcagcgcggtggccagagccgcctcgcgtgcgggaccgggaccggctccgctgccgaggcggatgcccacctctgccccccgtgtactcctaaggtcgccggtggaaatgagcagcgtgtgtctggagtccttgatgcccatgcacagagccacggattcagtgataaaaacnccgcttctcgccgccccggcttgcaagggattccgctggctatcacaaggtcaagctgaaactagatgaacttcatgggacccaaaaggcctgtgattacngcgatggaggtcaacttggatgaagactagactggctatttattttgccatctctgttgccttggggttgcccattatgaatgcaacatacaccaatgggaacttccgccnctgcgactttatatgatggtcattccacaacttgagccccagattattggtgtccctattcgcaaatggatgattttgtccttactggaaatctgcctggggagggtttcttgtcctgaattataggattccctggtgaatttaaaggcactctgcgtgggctcccccacaaaaaaacaaccaaa

SEQ ID NO: 48956 - protein, 100 aa, Zea mays
  misc_feature: Ceres CLONE 1458859-F
MAAAASAARSFLRSSGSSSLRSAVARAASRAGPGPAPLPRRMPTSAPRVLLRSPVEMSSVCLESLMPMHRATDSVIKTPLLAAPACKGFRWLSQGQAETR

SEQ ID NO: 48957 - DNA, 778 bp, Zea mays
  misc_feature: Ceres CLONE 1458866-F
  misc_feature: Encodes the peptide sequence at SEQ ID NO. 48958
  misc_feature (470)..(470): n is a, c, t, g, unknown, or other
  misc_feature (689)..(689): n is a, c, t, g, unknown, or other
ggagctccccgcggtggcggccgctctagaactagtggatcccccgggctgcaggaattcgcacgagaccattacctagaacatcctaatcgaaaaactgttccactccagtcggtcgaggagtagggttctagcgcctatctggtttctccctgcgccgccgccgccgccgtggacaaccggagcgtagtgggaggggatgatggagggaggtagccgcgcggatgggcggaatccgaaccagctccggccgttcacctgcaccgggaacccgctccaccgcgcccacggttccgcgcggtgggcgcagggcgacaccgtcgtgctggccgctgtgtacgggcccaagtcgggaacccggaagggcgagaaccccgagaaaggcctcatcgaggtcgtgtggagcccaagaccggccgatcggaaggcaagaaagggattattgaaatgaccctccagaaggacttgcnaaagcttctgcttgtccaaggttatcccaaaccccccacctttggtggggtttcggttgggggggaaaaaggttcctttttggcgggggaaaaaaaaggcttttggggcggccctttggtttgggggaaacccctaaaaaactccctttccccaattatttgggggaggaagaaaagggggtgtttttttttccccccccaaaaaaaaaaaaaccctcngggggggtgtttccccccggggttttcaccaccccccgggttgtttttaagaaggaagacccccccgttggttggggggcctggggggg

SEQ ID NO: 48958 - protein, 82 aa, Zea mays
  misc_feature: Ceres CLONE 1458866-F
  misc_feature: SWISSPROT Homolog: EC 2.7.7.56 tRNA nucleotidyltransferase
MEGGSRADGRNPNQLRPFTCTGNPLHRAHGSARWAQGDTVVLAAVYGPKSGTRKGENPEKGLIEVVWSPRPADRKARKGLLK

SEQ ID NO: 48959 - DNA, 741 bp, Zea mays
  misc_feature: Ceres CLONE 1458868-F
  misc_feature: Encodes the peptide sequence at SEQ ID NO. 48960
  misc_feature (384)..(384): n is a, c, t, g, unknown, or other
  misc_feature (471)..(471): n is a, c, t, g, unknown, or other
  misc_feature (474)..(474): n is a, c, t, g, unknown, or other
  misc_feature (484)..(484): n is a, c, t, g, unknown, or other
  misc_feature (496)..(496): n is a, c, t, g, unknown, or other
  misc_feature (499)..(499): n is a, c, t, g, unknown, or other
aagctggagctccccgcggtggcggccgctctagaactagtggatcccccgggctgcaggaattcgcacgagaccattacctagaacatcctaatcgaaaacttctagaaccttctccacgatggcgttcctccgagccctccggcgagccctcccgccgctctactcgccggcggcgcctctttcccggcgcgcaccaggtcctcctccgctcccttcccgccctctccggctcctggatccgatcgggttccggccgttctccgccgcggccgccaccgccaccgccgtcgcgcgggtgccggaaatgggggccagcctcttcagagggctcacggagaccaggttccccaagcggcgcccggggttcgtgtcccggcgcangagggccagcctgcgacccaaaggtccgcactactgggtgaagtgcacgccgggggagcctatcccttcgagcccagcgaataaggncancgtgcagggnaagaaggaaaanaancggatcaagcagcggcaaggacttcatcatggcttgaaagagaaccgcaaagccccgtattctgttgctgtgaaaaagaaggaggccaaccggaccaaaagaaaatgggttgcagtggcaaaaacccggccttggtgggaaaggttggcaaacttaacccaaatgggggcaaaaaaaacctcctagggttttggagaccctctggaaaacgggagggggtaaaaccgttttggtttccccgt

SEQ ID NO: 48960 - protein, 187 aa, Zea mays
  misc_feature: Ceres CLONE 1458868-F
  misc_feature (88)..(88): Xaa is any aa, unknown, or other
  misc_feature (117)..(117): Xaa is any aa, unknown, or other
  misc_feature (118)..(118): Xaa is any aa, unknown, or other
  misc_feature (125)..(125): Xaa is any aa, unknown, or other
  misc_feature (126)..(126): Xaa is any aa, unknown, or other
MAFLRALRRALPPLYSPAAPLSRRAPGPPPLPSRPLRLLDPIGFRPFSAAAATATAVARVPEMGASLFRGLTETRFPKRRPGFVSRRXRASLRPKGPHYWVKCTPGEPIPSSPANKXXVQGKKEXXRIKQRQGLHHGLKENRKAPYSVAVKKKEANRTKRKWVAVAKTRPWWERLANLTQMGAKKTS

SEQ ID NO: 48961 - DNA, 758 bp, Zea mays
  misc_feature: Ceres CLONE 1458875-F
  misc_feature: Encodes the peptide sequence at SEQ ID NO. 48962
  misc_feature (706)..(706): n is a, c, t, g, unknown, or other
ctggagctccaccgcggtggcggccgctctagaactagtggatcccccgggctgcaggaattcgcacgagaccattacctagaacatcctaatccaaaagaaccttgaagcgccccgtagtgcagtgcagcagtgtgctacctcctcagtcctctcactccatcgcaaacgctagtcttcctctaaagctcggagcgagtctcagaagcgatggcggcgtccaagaggctgctgctggcggcgctgtgcgtggtggccgcggcgctgctcgccgtgcggtcggagtcccacggcctggaggaattcgcaagcagcgacgcgacgcccgagatgcagaccttcttcaagcccgaggccgcggcgctcccggaggccctggacgcgtcctccatgcccgccgccaccatggccgcgaagccggaggccacgtcgatcccgaccaccaccggcaccacgacgacggcggcggccacctccgccgcggcaggcactactgctgcgtcgccgccgcgcaggtccgtgtccgtggccgccggcgtggcctgcggcgtggctgccgtggccgtggtccgcatcgcggccgccgtggcgtacgtggtgcgcggcaggcgcagcagggaggtgcagctcggctcctccccgtgagcacgcgcccagcgccccggcccgctttacagacaggccgtcatcggcatttagatctggntaagcgcgtcgtctagctctgcgatttgtgtggcttttggggtagtgttgaa

SEQ ID NO: 48962 - protein, 144 aa, Zea mays
  misc_feature: Ceres CLONE 1458875-F
MAASKRLLLAALCVVAAALLAVRSESHGLEEFASSDATPEMQTFFKPEAAALPEALDASSMPAATMAAKPEATSIPTTTGTTTTAAATSAAAGTTAASPPRRSVSVAAGVACGVAAVAVVRIAAAVAYVVRGRRSREVQLGSSP

SEQ ID NO: 48963 - DNA, 842 bp, Zea mays
  misc_feature: Ceres CLONE 1458876-F
  misc_feature: Translation starting site: 235
ttgtgatgtggttggttattcttttttcgcgttatgttataggatgagaaagatggactccccgcggtggcggccgctctagaactagaggatcccccgggctgcgggaattcgcacgagaccattacctagaacatcctagtccaaaaatcgcgtctaaacccttgtctccttcttatccccacctccctcgcggatcactcgccgccgccgccggccgcagcaatcgccgtgatgctgtcccagtcgagggctatcgggaggctgctcttctcgtccgccgaggccgcgtcaacggctgcggtgaggacggcgcaaaacccgctcgaggagttctttctaggtcgagcggagcaccgaggagggaaagcctcctccccacttactgtcgcagctggaaggcttctgagctgcgactaaattcttggggatgacctacagaaagtggggaatgtatcttcaaaagcaaaaataacttgcttatgacgccgcgtcaaatgctgtcattagaaaagggtagaggttcctcaaatcaagagagtgattttccaaggggaaagaaaattcaatgtggcgggaaaaaactatgtcttggaactaaataagtcttatagacgaaactccagattccaaggaaaatctttcccaaaactgaagccggaagaataaagggccccgtggattttcctcaaaaaggcatatcccccctttgggaattttttggtaatgtcgctttgtagagaagacctgcatagccttctggagtgaacacttagccccctaaaaaacctgggtaaaccgaaagttcttttaggagctccaatgggaaatgaaacaataaa

SEQ ID NO: 48964 - DNA, 775 bp, Zea mays
  misc_feature: Ceres CLONE 1458878-F
  misc_feature: Encodes the peptide sequence at SEQ ID NO. 48965
  misc_feature (380)..(380): n is a, c, t, g, unknown, or other
  misc_feature (613)..(613): n is a, c, t, g, unknown, or other
  misc_feature (614)..(614): n is a, c, t, g, unknown, or other
  misc_feature (731)..(731): n is a, c, t, g, unknown, or other
ggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccgggatccaagtcggcaacgcgtgctgggaactttactgcctcgagcacggatcccagcctgatggccaagtgcctgggaaaaaaatttccnaacctcccgaagaggccttgagaaacttttttcagccacaccggggccgggaaaagaggttcccccgcaaaccttctttaattaaaaacccctgtgaacaaagagggggggaatggggcgccgtacccgccggcctctccccccgggacccgcctccccgggggaagggaggagcgcctataaattttccccgggggcccccaaccatggggaagaaaaaattttatattttnnccttacccctccccccaaattgttaaaaacaaccccgcgccccacgggggtccccggttctaaacaccgttggggggggcacagggcccccgccctatgtttcctccctgggagaanctttgttgtgtggaatggtcgaaaccaccctgggtgtttttctt

SEQ ID NO: 48965 - protein, 128 aa, Zea mays
  misc_feature: Ceres CLONE 1458878-F
  misc_feature (43)..(43): Xaa is any aa, unknown, or other
  misc_feature (120)..(120): Xaa is any aa, unknown, or other
  misc_feature (121)..(121): Xaa is any aa, unknown, or other
MRECISVHIGQAGIQVGNACWELYCLEHGSQPDGQVPGKKISXPPEEALRNFFQPHRGREKRFPRKPSLIKNPCEQRGGEWGAVPAGLSPRDPPPRGKGGAPINFPRGPPTMGKKKFYIXXLPLPPNC

SEQ ID NO: 48966 - DNA, 607 bp, Zea mays
  misc_feature: Ceres CLONE 1458970-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (161)..(161): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (192)..(192): n is a, c, t, g, unknown, or other
  misc_feature (199)..(199): n is a, c, t, g, unknown, or other
  misc_feature (309)..(309): n is a, c, t, g, unknown, or other
  misc_feature (359)..(359): n is a, c, t, g, unknown, or other
  misc_feature (492)..(492): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttnnnnnnnncccaaagctggggactccaccncgggggnnncggccgctctagaactagtggnatccccncgggctgcaggaattcgcacgagaccattacctagaacatcctaatcgaaaaacatgcgcactgacgttcttgagagtccaggcagagtcgtagtttcttcggaacgcangggaaaaaaaagaagatgaggtttgcggtggcgaacaggcgtacattgcngtgacgctgggcgccgccatcgagctcaagggagcaggtgggccaagcctttgctccttccggcgccaaaaccgggcccccgttttccggtttggtccggccggcccgggaaaaaaatcggcgggggggcggnccggggccccaaaaaaattcccctttagggggtgggaacccaggggtttccccccaaattttgggggggggggaacccccaaccttaaacccttttgaaaaaaccccccggggac

SEQ ID NO: 48967 - DNA, 623 bp, Zea mays
  misc_feature: Ceres CLONE 1458974-F
  misc_feature: Encodes the peptide sequence at SEQ ID NO. 48968
  misc_feature (236)..(236): n is a, c, t, g, unknown, or other
  misc_feature (266)..(266): n is a, c, t, g, unknown, or other
  misc_feature (295)..(295): n is a, c, t, g, unknown, or other
  misc_feature (307)..(307): n is a, c, t, g, unknown, or other
  misc_feature (318)..(318): n is a, c, t, g, unknown, or other
ggagctccccgcggtggcggccgctctagaactagtggatcccccgggctgcaggaattcgcacgagaccattacctagaacatcctaatcgaaaaatcgccccgcgaaccctagctcccgcaactgccgccgccactcccacgctcgcagccatgccgcccaagctcgacccgtcgcaggtggtggaggtgttcgtccgtgtgaccggcggcgaagtcggcgcagcgtcttcgcntgcccccaagatcggcccgctcggtctttncccccagaaagatcgagaggacatcgccnaggagacggccnaggactggaangggcctccgcggtcacggtcagctcaccgtcagaacccggcaggccaaaggtcttcgtcggtcccctcggccgcggggctcgttattcaagggctccagggaaccagagaggggaccccaagaaaggtcaagaacatttagggcaggggggaaaatcagcctccaacaaaatcattttagatccgcccggaccatgaggggccaggtcccctgtgccaagaaattgggccggaccacccaaagggatcccccggaacctgggtgcaacggctggggggaacccctcacaggccaagaaccccccg

SEQ ID NO: 48968 - protein, 101 aa, Zea mays
  misc_feature: Ceres CLONE 1458974-F
  misc_feature (28)..(28): Xaa is any aa, unknown, or other
  misc_feature (38)..(38): Xaa is any aa, unknown, or other
  misc_feature (48)..(48): Xaa is any aa, unknown, or other
  misc_feature (52)..(52): Xaa is any aa, unknown, or other
  misc_feature (55)..(55): Xaa is any aa, unknown, or other
MPPKLDPSQVVEVFVRVTGGEVGAASSXAPKIGPLGLXPQKDREDIAXETAXDWXGPPRSRSAHRQNPAGQRSSSVPSAAGLVIQGLQGTREGTPRKVKNI

SEQ ID NO: 48969 - DNA, 625 bp, Zea mays
  misc_feature: Ceres CLONE 1458975-F
  misc_feature: Encodes the peptide sequence at SEQ ID NO. 48970
tggagctccccgcggtggcggccgctctagaactagtggatcccccgggctgcaggaattcgcacgagaccattacctagaacatcctaatcgaaaagaccccgactcggcggctgcaccgcaatccgaccgaccgccgtccgtccctctccacgccgtctgccgccgcatcaatccagcaggcagcgacctaggggctgtccgtgtccggttgggaggcgccgggcgcactggggtgggcggctgcccgcctggccggccagccgtaagcgccgagcggcgtgccggcatctccgttgcggtgtgggcaaggcaccagcggccaggtccgcaggagctcgggatcgggcttgtgctgaacattgtgggcgcaactggtagagatccgactttattcctggaggcatttgtctgaactttttccgaaatgaatgccggtggtgcttttggtggaaataaggggctgaagcctgtaccccctgaaaaaagtgtattcccattggaccacttacatgaatgccacttggagaagaaagactatcttggctgcctgaaatctacagggtttcaatctgaaaaatgtcgaccgttctcaaagaagtatctgggatggtcaaatggaaaa

SEQ ID NO: 48970 - protein, 66 aa, Zea mays
  misc_feature: Ceres CLONE 1458975-F
MNAGGAFGGNKGLKPVPPEKSVFPLDHLHECHLEKKDYLGCLKSTGFQSEKCRPFSKKYLGWSNGK

SEQ ID NO: 48971 - DNA, 654 bp, Zea mays
  misc_feature: Ceres CLONE 1458980-F
  misc_feature: Encodes the peptide sequence at SEQ ID NO. 48972
ggagctccccgcggtggcggccgctctagaactagtggatcccccgggctgcaggaattcgcacgagaccattacctagaacatcctaatcgaaaaagagagcgttctggcagccgttgcggagcttgaacctctgcaaccaccaatagctaaactaaaagcatcggcggacggcgcgcgatactggacgaccggccgacgatggctaccccggcgcagcagcagggtgaccagcaccacccgaggctgcaaaaggtgatggtggctgtagaccagagcgagtgcagccggcacgcgctggagtgggcgctgcagaaccaggcgcccacgctggccccaccgctactggtgctcaccgtgcagccgtatttcccacacaaatacttctccgccgcgtccttcggcgcacccctggacaccgaccttccggtggctccggagctcatccggtcgatgcttgaccatccgacggagatcagggaggagttcttcgactaggtcagggctatctgagccaaccacggggtagctgataaggcatttgtcgaggtcgcatacctaccggaggtgatatgtcaagcgcttaaaaaaaaaaatgtaaatctgcttggctctggaaacccctcgtcgggtcccacataccaagggtgttcc

SEQ ID NO: 48972 - protein, 98 aa, Zea mays
  misc_feature: Ceres CLONE 1458980-F
MATPAQQQGDQHHPRLQKVMVAVDQSECSRHALEWALQNQAPTLAPPLLVLTVQPYFPHKYFSAASFGAPLDTDLPVAPELIRSMLDHPTEIREEFFD

SEQ ID NO: 48973 - DNA, 705 bp, Zea mays
  misc_feature: Ceres CLONE 1459009-F
  misc_feature (45)..(45): n is a, c, t, g, unknown, or other
  misc_feature (49)..(49): n is a, c, t, g, unknown, or other
  misc_feature (385)..(385): n is a, c, t, g, unknown, or other
  misc_feature (428)..(428): n is a, c, t, g, unknown, or other
  misc_feature (440)..(440): n is a, c, t, g, unknown, or other
  misc_feature (464)..(464): n is a, c, t, g, unknown, or other
  misc_feature (472)..(472): n is a, c, t, g, unknown, or other
  misc_feature (492)..(492): n is a, c, t, g, unknown, or other
  misc_feature (500)..(500): n is a, c, t, g, unknown, or other
  misc_feature (506)..(506): n is a, c, t, g, unknown, or other
  misc_feature (513)..(513): n is a, c, t, g, unknown, or other
  misc_feature (529)..(529): n is a, c, t, g, unknown, or other
  misc_feature (535)..(535): n is a, c, t, g, unknown, or other
  misc_feature (562)..(562): n is a, c, t, g, unknown, or other
  misc_feature (682)..(682): n is a, c, t, g, unknown, or other
aaagctggagctcaccgcggtggcgccgctctagactagtggatnccgngggctgcaggaattcgcacgagaccattacctgaacatcctaatcgaaaatcacaacaccgagtccaaactaacccccggctgctccatctcccattcctagcgagcgagctaactagactcggacctaaccaaaaatgacgagtatgcaggatcctcgcgggcagccacagtgaggtgtaccaggtgagcgccctcagggcggcgctcaccgagttcatctccacgctcatcttcaacttcaccggccagggcttcggcttggccttcggcaagctgagccccgacggcgcggcaaccccggccggtttgatttcgggggcgattgcgtggggcnccccgctgttggtggcggtgtttttggttccaccccccccggngggagttggaanggggcggtaacttggggggcttantggcctgnagattacctttttccggggnctgctttnaggggncaccccnctcccgggctaccccncctgcnggttccttcctccgtcttcttcacccncgcgggttacggggttggaacctttcgggactctacccgaattcttgattcctggaaaatcgccgcctgtggcctggctggaatccataaaataaacaagtacgggaacttagatgttanctatgtgaatataacaaaaacaa

SEQ ID NO: 48974 - DNA, 632 bp, Zea mays
  misc_feature: Ceres CLONE 1459010-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (316)..(316): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaactgggactccccgcggtggcggccgctctagaactagtggatcccccgggctgcaggaattcgcacgagaccattacctagaacatcctaatcgaaaaaccagacgccagtccaccaccgcttcccgtgcagcgccctccctctacgttcccccatttcctgtgttggcggcgatgggcgcgcacttcgtgctcaacacggncgccaagatcccctcccgtggggctcggcacctggcagtctgaccccggcgtcgttgggcacgctgtctacgcccgcgtcaaggcggtttacgacatttccgatgggcccaaatttaccgccacaaaaaggaaattggttttggccctaaaaaaccttttttaaaaggggtgttatgaaaccaaaaaaaatttttttaccccccctaagccttgggaagggtcccccgggcccccaaaaaatggccccgaagaccaaaaataaaaacccccaaaaaatttttccccttgggaaccccggggtttttttttccttac

SEQ ID NO: 48975 - DNA, 679 bp, Zea mays
  misc_feature: Ceres CLONE 1459015-F
  misc_feature: Translation starting site: 371
  misc_feature: SWISSPROT Homolog: EC 1.11.1.11 L-ascorbate peroxidase
  misc_feature (418)..(418): n is a, c, t, g, unknown, or other
  misc_feature (420)..(420): n is a, c, t, g, unknown, or other
  misc_feature (421)..(421): n is a, c, t, g, unknown, or other
  misc_feature (423)..(423): n is a, c, t, g, unknown, or other
  misc_feature (429)..(429): n is a, c, t, g, unknown, or other
  misc_feature (522)..(522): n is a, c, t, g, unknown, or other
  misc_feature (523)..(523): n is a, c, t, g, unknown, or other
  misc_feature (528)..(528): n is a, c, t, g, unknown, or other
  misc_feature (536)..(536): n is a, c, t, g, unknown, or other
  misc_feature (538)..(538): n is a, c, t, g, unknown, or other
  misc_feature (591)..(591): n is a, c, t, g, unknown, or other
ggagctccccgcggtggcggccgctctagaactagtggatcccccgggctgcaggaattctcacgacaccattacctacatcatcctaatcaaaaaagaccatacagagagctgcttgcttctccatgccttgtgcttccacaaagcaaccccttctcctaagcaatgtccgcacccctggtggactctaagaacatggcccatatccatagggcgcggcgggacctcccctctctcgtcgccagaaaaaactgacccacgatcatgctccccctcgtgtggaacgccgccggcactatcgacgccaagagcaccgcaggaggccccaacgggaccacaaggtacccttcggagtaatgacactcttctaatgattgggttcaagatcgccattgaccttttagagcctgttgaagananncnccccgngatcagatacgcagaactgtatctgctcgccggagttgccccccgcgaagtcactggtggaccgaccgtggaattcgtccctggggggaaggnntcttngatttggncncagtaaggacgcttgccggacgccacaaaaggggcttcacatctccaacaagntttctccccccatgtttttttcaaacagggaaaattagtggtggttctccttccgtccccttgtcgaggagaaacccacaatcaagaa

SEQ ID NO: 48976 - DNA, 770 bp, Zea mays
  misc_feature: Ceres CLONE 1459019-F
  misc_feature: Encodes the peptide sequence at SEQ ID NO. 48977
  misc_feature (38)..(38): n is a, c, t, g, unknown, or other
  misc_feature (363)..(363): n is a, c, t, g, unknown, or other
  misc_feature (365)..(365): n is a, c, t, g, unknown, or other
  misc_feature (380)..(380): n is a, c, t, g, unknown, or other
  misc_feature (448)..(448): n is a, c, t, g, unknown, or other
  misc_feature (449)..(449): n is a, c, t, g, unknown, or other
  misc_feature (561)..(561): n is a, c, t, g, unknown, or other
  misc_feature (569)..(569): n is a, c, t, g, unknown, or other
  misc_feature (574)..(574): n is a, c, t, g, unknown, or other
  misc_feature (576)..(576): n is a, c, t, g, unknown, or other
  misc_feature (582)..(582): n is a, c, t, g, unknown, or other
  misc_feature (584)..(584): n is a, c, t, g, unknown, or other
  misc_feature (590)..(590): n is a, c, t, g, unknown, or other
  misc_feature (597)..(597): n is a, c, t, g, unknown, or other
  misc_feature (599)..(599): n is a, c, t, g, unknown, or other
  misc_feature (613)..(613): n is a, c, t, g, unknown, or other
  misc_feature (627)..(627): n is a, c, t, g, unknown, or other
  misc_feature (628)..(628): n is a, c, t, g, unknown, or other
  misc_feature (633)..(633): n is a, c, t, g, unknown, or other
  misc_feature (634)..(634): n is a, c, t, g, unknown, or other
tgatgtggtacatacctctcctctcttctctcgcgccngccggaaaaaacataataatggagcaccccgcggtggcggccgctctataactagtggatcccccgggctgcaggaattcgcacgagaccattacctagaacatcctaatcgaaaagcgtttcctgcactttccagtcggcgcgggagcaaaccgatagaggcgtatccattatggtggcaacctactgcgcctaccccgccgccggggccgccgccgccgctaaccctaccagacgcggcctggaaaccctaaccgcggcgggagccctacttgctggtcggaaacccagagggcggcgccgctccttcctctctttccggcgncnctatgggggcgctgnggcggctccgagtcgctggcgcggaacccggaagttggggtggggtggggtttcccccgtggaaaggnnctgtgttgcgtttgggtgtgggccccccccgcgaccgaaacccaagaaggttgtgggttgaagtcgagaaaggggactccccagccccccccacgggggggggagggaaggnggggggcnccccncnggcaangnttccgngggtgangntggcttcctgggcncagaagaaggttgnnttggnntttgaggggcggagccccgcggaaagtccctgacgcgcccatcgacagaaggacaacctggccgacggtatttactttgatataaggccccagggggaagcacccgggacacaagaggcgccagtcggcccccccc

SEQ ID NO: 48977 - protein, 99 aa, Zea mays
  misc_feature: Ceres CLONE 1459019-F
  misc_feature (52)..(52): Xaa is any aa, unknown, or other
  misc_feature (57)..(57): Xaa is any aa, unknown, or other
  misc_feature (80)..(80): Xaa is any aa, unknown, or other
MVATYCAYPAAGAAAAANPTRRGLETLTAAGALLAGRKPRGRRRSFLSFRRXYGGAXAAPSRWRGTRKLGWGGVSPVERXCVAFGCGPPPRPKPKKVVG

SEQ ID NO: 48978 - DNA, 807 bp, Zea mays
  misc_feature: Ceres CLONE 1459039-F
  misc_feature (1)..(1): n is a, c, t, g, unknown, or other
  misc_feature (21)..(21): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (51)..(51): n is a, c, t, g, unknown, or other
  misc_feature (52)..(52): n is a, c, t, g, unknown, or other
ncccgttcttttccttccttntttttattaccggaacccaannnntncttnncccaaaaccggactccccgcggtggcggccgctctagaatagtggatcccccgggctgcaggaattcgcacgagaccattacctagaacatcctaatcgaaaagttgggaggggggaaagttcattaaacggctggaaaaagtgatctgaatccggcatggaatgaagtgcttaagatatctgttcctggaaattatggacctatcaatcttgacgtgtttgaccttgatatgttgatcagttgatgatatcctgggagacgtacagatggatctcacgcctatgatcgcagacgcccatggtcctgtggagatacttcaggtctatggtgacatgctaattggccaggaggcttcatgaagctagtacgatggccctcgatgaaacaatagcacgggggaaatgttggtggcatggtaaaggtgaaatattggaacccccacccctcacgggtatttgataggtaaaaaatcaaagtggagtttcggagtatgggaggctaagacagggggtctccgagtccctcctagaactagaaggattaacctgcgcctcggattttttggctctaaaggaacgcttatccctcccatgatggcatcgaattgttttcccaagccggttccccctttgattggttcttcccaccactcctctgcttggcagcgccttggacaccccttgaacccacccgccccctgttgaaaaaattgcgcggggcatccgttgggcccgctgaaacccccccccccttc

SEQ ID NO: 48979 - DNA, 831 bp, Zea mays
  misc_feature: Ceres CLONE 1459073-F
  misc_feature (15)..(15): n is a, c, t, g, unknown, or other
  misc_feature (45)..(45): n is a, c, t, g, unknown, or other
tcctccgggcgtgtntccccctccccttgttcgtcgcggagccgnaattaccatctctacattggagctccccgcggtggcggccgctctagaactagtggatcccccgggctgcaggaattcgcacgagaccattacctagaacatcctaatcgaaaaatcgagcatcgcacagataggcgtcttcgtactcgcctacctccgcggctcagacctttccctcttctcccaattccctccgtcggccgccgctctatcccgtacgacgaccccatgagggagtgcatttccatccacatcggccaggccggtatccaggtccggaaacgcgcgctgggagcctgtaccgcccttgagcatggccttcaaggctgaccggtcgaatgccgcggtgataagaccctgcgcggggcggagagtgatgctttcaacatcctactttcaattgaagagtggtcgtcggtaaagctacgtgcgaatgaggttgattgttaaccgacccttcgaactagaccgggtgcccctattgacgttcccgcccatctggcaacccaaccggcaatgctcttttctagcccggggaaggggggacttgacccaggtggggtaaagggagcgatagccccccccacgaattctctggtcggggtgggtctccggaagcgcccagtggccctagggaagagggttgaggccccgagcggattcccggtagtcccataccgcccccccccccccgcggcccggtggtcattgggttcccccccccgggggtggcccccgccctcccctatttcttccccggctttgaagccgactcgggcctccttg

SEQ ID NO: 48980 - DNA, 678 bp, Zea mays
  misc_feature: Ceres CLONE 1459074-F
  misc_feature: Encodes the peptide sequence at SEQ ID NO. 48981
  misc_feature (147)..(147): n is a, c, t, g, unknown, or other
  misc_feature (153)..(153): n is a, c, t, g, unknown, or other
  misc_feature (353)..(353): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (670)..(670): n is a, c, t, g, unknown, or other
  misc_feature (671)..(671): n is a, c, t, g, unknown, or other
  misc_feature (673)..(673): n is a, c, t, g, unknown, or other
  misc_feature (674)..(674): n is a, c, t, g, unknown, or other
tggagctcaccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcnaggtcnagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcccaccatccaagggcacgccgagggcgggttccaggcggccgcccgagctgaanaacggccggtgcaagtgcggcggcaactgccagtgcgacccctggcactgcggcaagtgagctaggtgctccaccctgcagggcggccgggaggccccccccccannnnnaaaacaaagcttacctccggccagaagccccccggtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnntnntnntttg

SEQ ID NO: 48981 - protein, 82 aa, Zea mays
  misc_feature: Ceres CLONE 1459074-F
  misc_feature (1)..(80): Pfam Name: Metallothio_2 Pfam Description: Metallothionein
  misc_feature (63)..(63): Xaa is any aa, unknown, or other
MSCCGGNCGCGSGCKCGNGCGGCSKMYPDMAEQVTTTTQALIMGVPPSKGTPRAGSRRPPELXNGRCKCGGNCQCDPWHCGK

SEQ ID NO: 48982 - DNA, 661 bp, Zea mays
  misc_feature: Ceres CLONE 1459078-F
  misc_feature: Encodes the peptide sequence at SEQ ID NO. 48983
aaagctggagctccccgcggtggcggccgctctagaactagtggatcccccgggctgcaggaattcgcacgagaccattacctagaacatcctaatcgaaaaactctaaagtctgatctcgtcccgccggaatctcctccccaccccatgcgttcagatctggttcgtttcgatttgactcggttttcccttcctgtgcggggtgacatacggtttaagaccggcggcgatggcggcgaatctggcgcagctgcgcacacaggtaacgcgtgcggcggagttcgcctcgaagcacggctgctcctactacaaggaggtaatggagaagaacaagcagtacgtcgttcagccccccaccgtcgagaagtgccaggagctctccaagcagctcttttacacccgcctcgcaagcctaccacgtcgctatggagtcattctggaaggagcttgattgtgtcaagctggtatggaagaacatgaaggacctcacggtcgaggacctttgcattgcgagtttatttggagttgatctctatgcatggttctgcgtatgcaagattgtcggcagatgtatcgccttgaccggctatcacgtctatatgatttccactggtcaagacctgctttactattgatactcttagctgatgcttgtcaaacc

SEQ ID NO: 48983 - protein, 73 aa, Zea mays
  misc_feature: Ceres CLONE 1459078-F
MAANLAQLRTQVTRAAEFASKHGCSYYKEVMEKNKQYVVQPPTVEKCQELSKQLFYTRLASLPRRYGVILEGA

SEQ ID NO: 48984 - DNA, 629 bp, Zea mays
  misc_feature: Ceres CLONE 1459126-F
  misc_feature: Encodes the peptide sequence at SEQ ID NO. 48985
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (590)..(590): n is a, c, t, g, unknown, or other
gcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgagggcgccgccggagctgagaaacggcggggtgcagtgcggcgggcaactgccagtgcgaccccctgcaactgcggcaaagtaagctagggtggctccaccctgccaagcccggccgggaggaaagcttagctaatttattttaacccaaataaaatataccgggcttccctgtggggtgttttccagagccacaccaannncaattttttttttttgggcccccccgcgtgggggggggggatttttttttttgtttgttgttttgnataaaaaaataaaaaaaacaccctcccccgcccgcgccc

SEQ ID NO: 48985 - protein, 85 aa, Zea mays
  misc_feature: Ceres CLONE 1459126-F
  misc_feature (1)..(81): Pfam Name: Metallothio_2 Pfam Description: Metallothionein
MSCCGGNCGCGSGCKCGNGCGGCSKMYPDMAEQVTTTTQALIMGVAPSKGHAEGGFEGAAGAEKRRGAVRRATASATPCNCGKVS

SEQ ID NO: 48986 - DNA, 579 bp, Zea mays
  misc_feature: Ceres CLONE 1459131-F
  misc_feature (217)..(217): n is a, c, t, g, unknown, or other
  misc_feature (218)..(218): n is a, c, t, g, unknown, or other
cacccgcggtggcggccgctctagaactagtggatcccccgggctgcaggaattcgcacgagaccattacctagaacatcctaatcgaaaatcgtctcgtccaccagctgagctgcgcccgttttagcgagcgagacaggtccgcgcgcgtgcgccggcgaggattggattggaaccgtcgcccgtcggtcgtcgatggggatccacctggtggcgnnttcgtggcggcgaaggggcttccctgcagggtgttccagggtgttcgggccccccttccttgtggcccccttcaacccttttggggttggccgtttcggggggggccccacttttctccaaaagggttttggggccccctttttttaaaaaccccccttttttttttaaaaaacccccccaacattttgtgggcccccccctcgtggggggggggccccaaaaaaaaaaaaaacgggggggggagccctttttttttgccacaaaaaatttcttcttccgccggcggggcggggttttcttttgtttatccaatatcatttttctttctttctttgccggagagaggaacatttttttttt

SEQ ID NO: 48987 - DNA, 682 bp, Zea mays
  misc_feature: Ceres CLONE 1459149-F
  misc_feature: Encodes the peptide sequence at SEQ ID NO. 48988
aaagctggagctccccgcggtggcggccgctctagaactagtggatcccccgggctgcaggaattcgcacgagaccattacctagaacatcctaatcgaaaaaccacaacagacactacagctcaaagcaactgcacacacaggttcctctcccccgttgcgcaacacgctttcccccacttcacccgcctcggcgccatggctaagatcgagctggagctcctcctcctgctggccgtggaggctctcgcgtcggccagcaccgcgagccacctggatctcgatctgcgcatcctctcctctggcgaacgccggacggagtgccgcggcccggtggacgattcgccctccgaagaatcggcagaggaggcccttgaccggataggatccatcgacgggcgctttaaggcggcgcgaaatcaccttcgggcccctgcggcggaaaaactggccttctccccccgaggcccccggtactaaaaagggcggcccgggcggctagggaaacccctaccacgcgggtttctcccccgttcacccccttggcccaagattaaaggttcccccccatcccccccgattggccaagaaaaagggtctggggccaaggtctccgggccccttccgcccacaaaaaaaatatcatattaggccccggtttaacctcggggcgctctaaaaa

SEQ ID NO: 48988 - protein, 93 aa, Zea mays
  misc_feature: Ceres CLONE 1459149-F
MAKIELELLLLLAVEALASASTASHLDLDLRILSSGERRTECRGPVDDSPSEESAEEALDRIGSIDGRFKAARNHLRAPAAEKLAFSPRGPRY

SEQ ID NO: 48989 - DNA, 654 bp, Zea mays
  misc_feature: Ceres CLONE 1459168-F
  misc_feature: Encodes the peptide sequence at SEQ ID NO. 48990
gcggtggcggccgctctagaactagtggatcccccgggctgcaggaattcgcacgagaccattacctagaacatcctaatcgaaaaacagctgcgctgctcaccaggaagggcatctcatccatccttcattgtattgccccggcatcaccaggaacagcccagccgcaagaagacagacgacagcagcgagtggggatcggaagaaagaggaagcggagacgaaggtgagagagagaggcaaaagggcagccatgacgatgaagcagtcgaggttcaagaggatctgcgtcttctgtggcagcagccaggggaagaaggcgagctaccatgacgccgccgttgagctcggcaaccagctggttgcccggagcatcgacctggtgtacggcggcggcagcattcgcctcatgggcctcgtctccccaggccgtctacggcggcggacggcacgtcatcggggtcattcccaagacgctcatgacaccagagataagcggcgagacagtccgggaggtgcgggcggtggcccacatgcaccagaggaaggcggagatggcgcggcagtccgacgcattcctcccccttgccgggaggtatggcacgctggaggaactgctggagggcatcccgtgggcgcagctgggcatccccc

SEQ ID NO: 48990 - protein, 108 aa, Zea mays
  misc_feature: Ceres CLONE 1459168-F
  misc_feature (33)..(108): Pfam Name: Lysine_decarbox Pfam Description: Possible lysine decarboxylase
MTPPLSSATSWLPGASTWCTAAAAFASWASSPQAVYGGGRHVIGVIPKTLMTPEISGETVREVRAVAHMHQRKAEMARQSDAFLPLAGRYGTLEELLEGIPWAQLGIP

SEQ ID NO: 48991 - DNA, 644 bp, Zea mays
  misc_feature: Ceres CLONE 1459171-F
  misc_feature: Encodes the peptide sequence at SEQ ID NO. 48992
ggcggccgctctagaactagtggatcccccgggctgcaggaattcgcacgagaccattacctagaacatcctaatcgaaaaaaagcaaggcaagtctagtcttgcttcgccgaattccaaaccctagcctcgcctgttgcggccgcggcggagatggcgaagtctctgcgatccaagcgcgagaagcggctgcggacattgcgccgggagatagcggagcccttctacgacaagaaggaggccgccaagctcaccgcgcaggccgccgcgcttgctgctcccccgctccaggtccgcgggcccccgccgtcccaggatgccggcagctcccgcggcgctagctcagcctcggctatggatgtggagatgtccgatgaaggaaacaacaggtctaaaaccttcttgaagccacttggcatcattagcaagaagaaggtacagcttcatttgaagatcaagaaagacaagagaaaagcttggaagaaggggaagttttcttttaaaaaagtagacgccgtaaagctttgaagtcttaataaacctggtagttctggtttcccgtttgaacaaccaaattctaaaggcaggtcatggcgcaccctaagcccctttcatgggctagccttactatggtcgaaaatggg

SEQ ID NO: 48992 - protein, 124 aa, Zea mays
  misc_feature: Ceres CLONE 1459171-F
MAKSLRSKREKRLRTLRREIAEPFYDKKEAAKLTAQAAALAAPPLQVRGPPPSQDAGSSRGASSASAMDVEMSDEGNNRSKTFLKPLGIISKKKVQLHLKIKKDKRKAWKKGKFSFKKVDAVKL

SEQ ID NO: 48993 - DNA, 651 bp, Zea mays
  misc_feature: Ceres CLONE 1459177-F
  misc_feature: Translation starting site: 147
  misc_feature (602)..(602): n is a, c, t, g, unknown, or other
ctggagctccccgcggtggcggccgctctagaactagtggatcccccgggctgcaggaattcgcacgagaccattacctagaacatcctaatcgaaaaaggacgtttccacctccatcaccgctggtcggctatgtgcatcgcggcatgggcgtggcactgccacccgacgcaccgcctgcttctgctgttcaatcgcgacgagtatcactccagggcagcctttgtccattggagtatgccacagaaattgcaaaggaagcagatcagtacaacggctttaaccttatattggctgatgtgaactcaggaaccatggtttacatctctaatagacccggaggcgatcctgtgattcaaacagttgctcctgggcttcatgtgctttcgaatgctgcaattaattccccttggccaaaggcaatgcgcttaggacagagtttcaaaaggtatttgacaatacacgatgatgcagaagcctctttaaacaaatggtagaagagttgatgatggatactgccagacctgatagatctatggtgcctgacaccggcgacgacccggagtgggagtacaagctaggctcaatattcattgacactngcaaggaacaggcacgatatggaacacgaagcatggtggcactagcagc

SEQ ID NO: 48994 - DNA, 612 bp, Zea mays
  misc_feature: Ceres CLONE 1459182-F
  misc_feature: Encodes the peptide sequence at SEQ ID NO. 48995
gcggtggcggccgctctagaactagtggatcccccgggctgcaggaattcgcacgagaccattacctagaacatcctaatcgaaaaaaaaaacagaagcagttctccaggcaatagactagctagatgcgcatcaccaaagagtagctttcgtctagaacgaagaaacaccccccactacatggccgcgctcagttcttgtgttgcttctggaggcctggcacttcaggccacccttgtggtttctcctcctcgccgccgcgggactccagtcgtcatctccgtatcatctcatggtcgccgcccaagtcttatcggctccaccatgaatccttcaggcatggctccgatcaaaagaactacacgaattcgtgcggttcatccatgccctgcaaattcgttaggaggaagcctcaccatcatcccaatacctgacctgctttcatcatggctctggatgttcggagcggccatagctgcagcagtgcctctttacagaaggttcagagcattagaagataacgtagagaagacggcggaggcggcgatcgaggtgatcgactcggtggcggaggcgaccgagaaggtcgccgacgaggttgcgcaagcgttc

SEQ ID NO: 48995 - protein, 144 aa, Zea mays
  misc_feature: Ceres CLONE 1459182-F
MAALSSCVASGGLALQATLVVSPPRRRGTPVVISVSSHGRRPSLIGSTMNPSGMAPIKRTTRIRAVHPCPANSLGGSLTIIPIPDLLSSWLWMFGAAIAAAVPLYRRFRALEDNVEKTAEAAIEVIDSVAEATEKVADEVAQAF

SEQ ID NO: 48996 - DNA, 831 bp, Zea mays
  misc_feature: Ceres CLONE 1459187-F
  misc_feature: Encodes the peptide sequence at SEQ ID NO. 48997
  misc_feature (21)..(21): n is a, c, t, g, unknown, or other
  misc_feature (22)..(22): n is a, c, t, g, unknown, or other
  misc_feature (45)..(45): n is a, c, t, g, unknown, or other
cgggccgcctgtttgctggtnnaaacgccacctcgctattccccnttgttcccataaacaaactggagctccccgcggtggcggccgctctagaactagtggatcccccgggctgcaggaattcgcacgagaccattacctagaacatcctaatcgaaaagtccactgcgactgtgagcttcgttcgttcagttcatccgtgttcttgtttgcgaggtccagagagagaggaatgtcgtgctgcggaggcaactgtgggtgcggctccggctgcaagtgccggcaacggctgcggagggtgcaccaagatgtaccccggacatggctgagcaggtgaccaccaccactcaggctctcatcatgggtgtcgcaccatccaaggggcacgccgagggcgggttcaaggcggccgccggagctaagaacggcgggtgcacagtgcggcggcaacttgcccgtgccgacccctggaaattgggggaaagtggaccctaggtggtcccacccctgccagggccccccccggaaggaagccctccctaaatttataacaggtttaataaaaagccctaggcccgccgccgggcttcttgtaggggtccgtgaggtcccaggccatagtcaattggcgcgctggcattcgccccttggctttctgagtcgcgccgcaataatgatttccgcccgcccggctgaattggccgcgccccccccgcgccacgtaaaccccggggggctttccccgcggggtgtccctatccccgtgtttgagcaagcgtttgtcccgctgagatcgcgcgccggagccgggctcacaagccccgccgcgaa

SEQ ID NO: 48997 - protein, 57 aa, Zea mays
  misc_feature: Ceres CLONE 1459187-F
MAEQVTTTTQALIMGVAPSKGHAEGGFKAAAGAKNGGCTVRRQLARADPWKLGESGP

SEQ ID NO: 48998 - DNA, 628 bp, Zea mays
  misc_feature: Ceres CLONE 1459192-F
  misc_feature: Encodes the peptide sequence at SEQ ID NO. 48999
  misc_feature (577)..(577): n is a, c, t, g, unknown, or other
gtggatcccccgggctgcaggaattcgcacgagaccattacctagaacatcctaatcgaaaaccatcgtgcgccttcgcttcagccgtgagcccgcaaccgacccgccgcaaaagaccaaaaccctagccgtcacagcgccgcccccgaaccataaacctccacctcgccggcggccatggcgttctccggcaggatccaggagctcgtgaggaagtatggcaaggtggccatttgcgtccacctatccgtctcctgcgcctccatcgccggcctttacgtcgccatcaacaacaacgtcgacgtcgaaagccgttttccggaggttcggtatctccccccggcgttaccgtaggcggcaagggctcacccgcccctgttttcccgcgatgaacacctgcgcgacgtccccctgccgcccatggccaacgaggtactgcaaaaaaagacggagcgagagcggcacccccgcaacaggacgatggagctcgtggcgtcaaagtggcggggcggtcccgcttcgctgtcttctgccaacaaggccttattccccgggagggttcccccatcccatatgngtttaagcccgccccgttgccaaggggcctaaaccccctggaaggcctttc

SEQ ID NO: 48999 - protein, 58 aa, Zea mays
  misc_feature: Ceres CLONE 1459192-F
MAFSGRIQELVRKYGKVAICVHLSVSCASIAGLYVAINNNVDVESRFPEVRYLPPALP

SEQ ID NO: 49000 - DNA, 658 bp, Zea mays
  misc_feature: Ceres CLONE 1459200-F
  misc_feature: Translation starting site: 184
  misc_feature: SWISSPROT Homolog: EC 1.14.11.2 Procollagen-proline dioxygenase
  misc_feature (531)..(531): n is a, c, t, g, unknown, or other
  misc_feature (551)..(551): n is a, c, t, g, unknown, or other
aaagctggagctccccgcggtggcggccgctctagaactagtggatcccccgggctgcaggaattcgcacgagaccattacctagaacatcctaatcgaaaaacaatctttttttaccaataaataggtagagaatataagaaaccgtcacgaccgcctccgccgtgctcttccatccgttccatggcgccgccgctcgccctgctccttctcgccgccatcgtgctctcgcgggccgtctcccacgcccacggcggcggcggcggcttctacgacccggcgagcgtcactcagctctcctcgcgccccagggcgttcctgtacagcggcttcctctcggacaccgagtgcgaccacctcgtcagcctgacgaaaggcagcatggagaagtcgatggtggcggataacgactccgggaagagtgtggcgagccaggcgcgcaccagctccggcaccttcttggccaagcgcgaggatgagatcgtgtctgcgattgagaaacgcgtagctgcttggacatttctcccgaangaaaacgcgaatcactccangtcctgcgctacgaaaccggccagaagtatgacgcccacttcgactattttcacgacagaaacaacctgaagctcggcggccagcgagttgcgaccgtccttatgta

SEQ ID NO: 49001 - DNA, 571 bp, Zea mays
  misc_feature: Ceres CLONE 1459204-F
  misc_feature: Encodes the peptide sequence at SEQ ID NO. 49002
  misc_feature (408)..(408): n is a, c, t, g, unknown, or other
  misc_feature (456)..(456): n is a, c, t, g, unknown, or other
  misc_feature (457)..(457): n is a, c, t, g, unknown, or other
caaagctggagctccccgcggtggcggccgctctagaactagtggatcccccgggctgcaggaattcgcacgagaccattacctagaacatcctaatcgaaaactctccttccccttcttcccccgcccgcgcctccggccgccgcgtgccgccgccgtgctggacgaccgacgagaccctcgcgctcgcgcgggcctacaccgcgcgccgcctcgccgtcggccgggagcacctgacctccaccgactgggccgccgtagccgcggccgccccgtccaagaccgccaggcagtgccgccacaagatcgagaagctccgccgacgcctccggtccaaccgccgacgcccatgcccgctcctcgacgccatggatctcctcgacggcccttccccgcccttcttttccnagtcccagtcccgatccacgtccctgtcctcgtcgccgcccgccgcgnngcgcggttctacgccgtctcccctttcccctccgcatctccgcccaggaagaggcgcaggacgatgcctgggacgaggacggtgtgagcgacctggtgggtgctctgacggcat

SEQ ID NO: 49002 - protein, 67 aa, Zea mays
  misc_feature: Ceres CLONE 1459204-F
  misc_feature (14)..(14): Xaa is any aa, unknown, or other
  misc_feature (30)..(30): Xaa is any aa, unknown, or other
MDLLDGPSPPFFSXSQSRSTSLSSSPPAAXRGSTPSPLSPPHLRPGRGAGRCLGRGRCERPGGCSDG

SEQ ID NO: 49003 - DNA, 663 bp, Zea mays
  misc_feature: Ceres CLONE 1459206-F
  misc_feature: Encodes the peptide sequence at SEQ ID NO. 49004
aagctggagctccccgcggtggcggccgctctagaactagtggatcccccgggctgcaggaattcgcacgagaccattacctagaacatcctaatcgaaaaaatccgccgcggctcgtctccgtctcccggctcctcggcgtctagctcgtcaacgcgcgcgtccgccgtcggctcctccgaccggcgtcccaccacaggggaatacagatcgacgatccgctgggcttgcaaacatgtatatccgagtgaagcgcaacaagagtacctacttcattcaatgtgaaccaacagagacagctttgagcatcaaacagaagttgcactcgctgatagatcaacctcctagtagtcagcagttggtcttgtggcctaccagtgatgtgcttgaggactcaaagactttggcagatcaaaaggtggataacgattccattgttgcattggcactaagaaaagatgacggtgagtttgaggaagttttcatcgctaggccggaggatttcatgtcatcatcatgataaagattagtccatcatttctacaaagggaccactgcggcgtcttggaggtggaccgtcgctctatggctgttcttccaaaatctggggatgtggcttggctgtccctttggggagaaaaaaaaaaactttttaggtggaat

SEQ ID NO: 49004 - protein, 94 aa, Zea mays
  misc_feature: Ceres CLONE 1459206-F
  misc_feature (4)..(75): Pfam Name: ubiquitin Pfam Description: Ubiquitin family
MYIRVKRNKSTYFIQCEPTETALSIKQKLHSLIDQPPSSQQLVLWPTSDVLEDSKTLADQKVDNDSIVALALRKDDGEFEEVFIARPEDFMSSS

SEQ ID NO: 49005 - DNA, 466 bp, Zea mays
  misc_feature: Ceres CLONE 1459207-F
  misc_feature (191)..(191): n is a, c, t, g, unknown, or other
  misc_feature (210)..(210): n is a, c, t, g, unknown, or other
  misc_feature (229)..(229): n is a, c, t, g, unknown, or other
  misc_feature (241)..(241): n is a, c, t, g, unknown, or other
  misc_feature (271)..(271): n is a, c, t, g, unknown, or other
aagctggagctccccgcggtggcggccgctctagaactagtggtcccccgggctgcaggattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtngggtgcggctcccggctgncaagtgcggcaacggctgncggagggtgcancaaagatgtaccccggacattggcttgaancaggtgaaccaccccccaccccagggctcctcatcatggggtggtccccacccattcccaaggggggcaccccccaaagggccggggttttccaagggccgggcccccccccgggaacctttaaaaaaaacgggcgcgggggtggccaaaccctcccccccccgggggaaaaaaagtttgggggttatatttccc

SEQ ID NO: 49006 - DNA, 661 bp, Zea mays
  misc_feature: Ceres CLONE 1459208-F
  misc_feature: Encodes the peptide sequence at SEQ ID NO. 49007
ctggagctccccgcggtggcggccgctctagaactagtggatcccccgggctgcaggaattcgcacgagaccattacctagaacatcctaatcgaaaaaaccctaagtctcggaccccaaccctcgaggaaggcgaccggagatggcggcgtcgtcggcggtggagaagctcaaggtcctctgggactcgcaggtcaacgacgaggagcagtgggcgctcaattataagctgctgaaggctgctggtctgtttgcgggatccatcttcctgatgcggaacttcggtgatctgatggccatttagtaggcttatcagcgttgtttacttggatcctatgagtgttgttttgatgttcccataattcctgctatgaatatgaaagttattttgctctgaagaggactagatctgtgccgatagtgcttgatcttagactttgtagccatagagattagaccctttaatattcggcgtgtaccgtggatattttggaacgatggtatcagtctgcacccatataatttttgatttgatggggtataaatattttaagagaagatagttgccccgcagggcaaggtctaagatgcacaaaagtgtgctattaaaaaaaaaaaaaaaaaacttatcgataccgtcgacctcgagggggggcccgtc

SEQ ID NO: 49007 - protein, 53 aa, Zea mays
  misc_feature: Ceres CLONE 1459208-F
MAASSAVEKLKVLWDSQVNDEEQWALNYKLLKAAGLFAGSIFLMRNFGDLMAI

SEQ ID NO: 49008 - DNA, 630 bp, Zea mays
  misc_feature: Ceres CLONE 1459220-F
  misc_feature: Encodes the peptide sequence at SEQ ID NO. 49009
  misc_feature (282)..(282): n is a, c, t, g, unknown, or other
aagctggagctccccgcggtggcggccgctctagaactagtggatcccccgggctgcaggaattcgcacgagaccattacctagaacatcctaatcgaaaaactagcactaacgtcgcgcgcgttttctgacgacccgtcctcgtgctcatgcaggcactgctcccgctgttcctgaggccggtggtccggttcgcggcgcgcgtggcggccggcgggccggcggccgcggcggcgactatcctgcaccgcgccggcgcgctgccgaggaaccggggcctgnagcgcctcgtccgggacgacgacgtcgacgacgacgacgagctccacgggccgcggcacgacgactgcatcgctagcttcgtcgtccgcgtcatgcgctgcctctgctagctagtagtctagtctagtcctagtctaaatggcgcatgcaacaatgctgggcatggacgacatgacatgcgtgcccccacttaccaatggccccccacccttggggtaaatccccctagctgaactgctctgggtagcttggaaacctaaaggaagggggaaacgggttcctttgtctcccccctttccggaagggaaccccccttggggaaatttcgggatttttaccccgggaaag

SEQ ID NO: 49009 - protein, 80 aa, Zea mays
  misc_feature: Ceres CLONE 1459220-F
  misc_feature (45)..(45): Xaa is any aa, unknown, or other
MQALLPLFLRPVVRFAARVAAGGPAAAAATILHRAGALPRNRGLXRLVRDDDVDDDDELHGPRHDDCIASFVVRVMRCLC

SEQ ID NO: 49010 - DNA, 649 bp, Zea mays
  misc_feature: Ceres CLONE 1459221-F
  misc_feature (578)..(578): n is a, c, t, g, unknown, or other
tccccgcggtggcggccgctctagaactagtggatcccccgggctgcaggaattcgcacgagaccattacctagaacatcctaatcgaaaacatgaacagcaaagcaagggccgaatagtataggcctgttccctcactccccagattccccttttcatagctctatatacctctccttctcgtcgtctctctatcccgcatctgctgttctttatttctatacatacatatatactatcaccggttatttgcttctctattctgtccgagtactttacggtgttccgcacatagatctcgtggccggcggttttgcgctttcgcttgcgtttcttggccctgctggtgtttgaccggaccgaacgggggcagatcgatgctttgggtttgaagcggagctcctatcattccaatgaagggtcgtaccgaagggccggttccgctgctcgttcatggttcccactatcctatctcatcatgtgtatatatgtatgtattccatgggggagggtttctctcgtctttgaaatagcttgtggtttgcatgaccgaagagctgcaccccccccttgctggnccgctcttggatgaagggagctctgcatcctgatccacccctcatttttttttcgcagtggcgccgtcctg

SEQ ID NO: 49011 - DNA, 701 bp, Zea mays
  misc_feature: Ceres CLONE 1459222-F
  misc_feature: Encodes the peptide sequence at SEQ ID NO. 49012
  misc_feature (246)..(246): n is a, c, t, g, unknown, or other
ggagctccccgcggtggcggccgctctagaatagtggatcccccgggctgcaggaattcgcacgagaccattacctagaacatcctaatcgaaaaaaacaaaaggcgcaagcaccgcacggagagcaagcaagaaagcaaccaccgcactgccactacctaacaatggcccgcgcctacgtgtttctcgtcgtgctcctcctggccgctgtcatcgtggcaccgttcgcgggagcgacgcgtgtcnacgtcgttgagggcaggtccatggcgtccgccgacgcgccggaagccgcccgcacatcacccgggcctgactccgcctcgtcacgggactcctcgtcggaatgcgcctccagcagcacctcctcggactagatagctagcggctcgacccacgatcttcgttctccatctaaaggggaatcaagttctagctttgtcgggatggaatggaaaattcccaattcttcggaataatccagccccaaagggaatgggcttggcaacccccaaaaaaaagaccccggtttttaaaaaaaggttccccccccccggaacccctcccaaatttttaacccttccgggggcccaaatttgggggaaaaaagggaaaaaaacctttttttttttttttaaaacaccccacccctgttaaaacacaccccccgcgcggttttttaaaaaacaaaaaatataaat

SEQ ID NO: 49012 - protein, 70 aa, Zea mays
  misc_feature: Ceres CLONE 1459222-F
  misc_feature (28)..(28): Xaa is any aa, unknown, or other
MARAYVFLVVLLLAAVIVAPFAGATRVXVVEGRSMASADAPEAARTSPGPDSASSRDSSSECASSSTSSD

SEQ ID NO: 49013 - DNA, 657 bp, Zea mays
  misc_feature: Ceres CLONE 1459223-F
  misc_feature: Pfam Name: DUF862 Pfam Description: PPPDE putative peptidase domain
ccgcggtggcggccgctctagaactagtggatcccccgggctgcaggaattcgcacgagaccattacctagaacatcctaatctaaaagattatgactccttacttcaccatgtcgaaactaacaggtagagagggagggatctccgtctccacgccgcgtcctcacgcaggaatccgcgctccggatgacgggccaagccctagccattcccgcccattcatggtgcgccggccgggagatctctacggaggcttgtcggcattcgtccggcgcgacggagacgagatgggagcccggaacgacactgcgccactgcccgtgctgctcaacgtgcacgaccttacggccgcgtaacgattacgtctactgtctcggcttctgcgacttccactccgggactcgaatctcatggcactgaatatgggtttggaccccactacaacacatccagaggtctgttacatgagaaatcgacgagatgccctggctttctctacataagatcagtgccgataggcacacttgacatgtctcatggagactaccgctcgtatatcgaaaatctcgcggtgattatcagcggctcgcatatctcttaggttacaggacctgcactcacttcgcagatgatgactgctcgaccttaactgtgaaa

SEQ ID NO: 49014 - DNA, 680 bp, Zea mays
  misc_feature: Ceres CLONE 1459228-F
  misc_feature: Translation starting site: 288
  misc_feature (495)..(495): n is a, c, t, g, unknown, or other
  misc_feature (581)..(581): n is a, c, t, g, unknown, or other
ggagctccccgcggtggcggccgctctagaatagtggatcccccgggctgcaggaattcgcacgagaccattacctagaacatcctaatcgaaaagaccacggactaccgtctcctctcctttcctctcctgcaactgcaagcgaccacccctccacccccatccacccacccgcccgccgacgcttggatcccctcccttgtttgccgtgtccccgcccaaaccccgtagccgccgccacagcaatcgctgccgccgccgctggaggccgggccgtgggggctgaaatgaaggaggtggtgctccacgtgtatgacgtgaccaacagtgactccgagaagacgaacaacaccatcctccagatcaaccgcatcttcaaaggaccgcatcggcctcggtggtatcttccacacccccgtccaggtctatggcgaggacaagtggtcgttcgggttctgcgagtccggcagcggcgtgtttagttgccccttaggnaaaaccccatgtaccccttaccgggaacgaatcttcctcggggaaaccaagggggggatcccccgcctgtaaaccgtatccctgcngggagcccaacccgcgaaggggcccgggcccacttctaacaaacccccctcctccagggaattggtgaaccatttttctggcaacggtgctcctggcaa

SEQ ID NO: 49015 - DNA, 661 bp, Zea mays
  misc_feature: Ceres CLONE 1459230-F
  misc_feature: Encodes the peptide sequence at SEQ ID NO. 49016
  misc_feature (492)..(492): n is a, c, t, g, unknown, or other
  misc_feature (613)..(613): n is a, c, t, g, unknown, or other
tggagctccccgcggtggcggccgctctagaactagtggatcccccgggctgcaggaattcgcacgagaccattacctagaacatcctaatcgaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtttctaggactgattgcatgctcagtaccactgctacattccccaaaatcagctgctcctggcctctaaggtttaagcgcaatgatgttgttgtaagagcaatatcggaagagtgtggcccgcaggggcttcccattgatctcagaagtaaaagggcattcattgctggagttactgatgataatggctatggatgggcaattgcgaaggcacttgctgcngctggtgctgaaattcttgtgggtacatgggtgcccgcacttaacatatttgagaacagtctgaagcgtgaaaagtttgatgaatcacggaagctgccagatggatctcttatggatattngtaaagtctatccacttgatgctgtctacgattcccctgatgatgtcc

SEQ ID NO: 49016 - protein, 158 aa, Zea mays
  misc_feature: Ceres CLONE 1459230-F
  misc_feature: SWISSPROT Homolog: EC 1.3.1.9 Enoyl-[acyl-carrier-protein] reductase (NADH)
  misc_feature (143)..(143): Xaa is any aa, unknown, or other
MTASAAAGVQMVAARPCISASPGILTARVSRTDCMLSTTATFPKISCSWPLRFKRNDVVVRAISEECGPQGLPIDLRSKRAFIAGVTDDNGYGWAIAKALAAAGAEILVGTWVPALNIFENSLKREKFDESRKLPDGSLMDIXKVYPLDAVYDSPDDV

SEQ ID NO: 49017 - DNA, 659 bp, Zea mays
  misc_feature: Ceres CLONE 1459231-F
  misc_feature: Encodes the peptide sequence at SEQ ID NO. 49018
  misc_feature (659)..(659): n is a, c, t, g, unknown, or other
tccccgcggtggcggccgctctagaactagtggatcccccgggctgcaggaattcgcgcgatatcattacgtacaacatcgtattctaaaaagatccctgtccctcgctcggaactgggcatcggaccaaggaagacctcacgctggggggggacttggtatattccttctcctccctgctcggcttagcgcgcgcggttcattgacgtatcctccactcctcccgtctcaagggatatgagggcgcatcggctataagctggatgaagcggatcgcctcctcatgcggtccgagggatcatcacgtccagttgtcgtactcagaaactttaggctgctacaacaactaaaatctggtgagacaggcattggtgatggcactgtgagatatgcgatgtacgatgctgatgacatatctatgcggacctggacgggaactatcattggtcctcgcagctgtgttgacaagggacgaatctatcagttaaagctgtctcgtgatacccattatcctgataaaccatcgagtgtcctgtacttgactcgcatcgctatgacatgtgtgaatcatgaacacggattcgccgcaccagtccatctcctatgactggcaaggtgcgaaatgttacatacgatgcaggagattctgacgagtctan

SEQ ID NO: 49018 - protein, 107 aa, Zea mays
  misc_feature: Ceres CLONE 1459231-F
  misc_feature: SWISSPROT Homolog: EC 6.3.2.19 Ubiquitin--protein ligase
MRSEGSSRPVVVLRNFRLLQQLKSGETGIGDGTVRYAMYDADDISMRTWTGTIIGPRSCVDKGRIYQLKLSRDTHYPDKPSSVLYLTRIAMTCVNHEHGFAAPVHLL

SEQ ID NO: 49019 - DNA, 581 bp, Zea mays
  misc_feature: Ceres CLONE 1459235-F
  misc_feature: Encodes the peptide sequence at SEQ ID NO. 49020
  misc_feature (386)..(386): n is a, c, t, g, unknown, or other
  misc_feature (445)..(445): n is a, c, t, g, unknown, or other
  misc_feature (527)..(527): n is a, c, t, g, unknown, or other
ctggagctccccgcggtggcggccgctctagaactagtggatcccccgggctgcaggaattcgcacgagaccattacctagaacatcctaatcgaaaaacttcacccctctcaatctcgctcatcactctctccctcctcatcctcacgtcgccactagcgtacctgctctctatgttctcgagctagctcacatcagggggaggaaccagcacctgcctcgccatgtcgtcctccatggtgtccaagaacgcgccgccgccggccgggtacggcgacggcgaaggcagcgtcgtcgaggccgcgccggtgacgagctgcctgtacctgcgccccggggcgggggcgctggacagggacgccgtgctgcgccccgcatccggcaancgggaaggcgcacgacggcctcacgacacgctgcgctcatggtgcaagcgccgccccgnccgcttaccccgacggcatggaccgcacgaacagcacctccggtgccgctcaacaaccctttctcggggcgtaaccttttgnaaaaaaaaattaaccccttggggccaattaacccattgccctggaaaatggtcc

SEQ ID NO: 49020 - protein, 119 aa, Zea mays
  misc_feature: Ceres CLONE 1459235-F
  misc_feature (54)..(54): Xaa is any aa, unknown, or other
  misc_feature (74)..(74): Xaa is any aa, unknown, or other
  misc_feature (101)..(101): Xaa is any aa, unknown, or other
MSSSMVSKNAPPPAGYGDGEGSVVEAAPVTSCLYLRPGAGALDRDAVLRPASGXREGARRPHDTLRSWCKRRPXRLPRRHGPHEQHLRCRSTTLSRGVTFXKKKLTPWGQLTHCPGKWS

SEQ ID NO: 49021 - DNA, 650 bp, Zea mays
  misc_feature: Ceres CLONE 1459246-F
  misc_feature: Encodes the peptide sequence at SEQ ID NO. 49022
  misc_feature (587)..(587): n is a, c, t, g, unknown, or other
  misc_feature (650)..(650): n is a, c, t, g, unknown, or other
aaactggagctccccgcggtggcggccgctctagaatagtggatcccccgggctgcaggaattcgcacgagaccattacctagaacatcctaatcgaaaacttcctcctccgcctcctcttcctctcttttgcttttgtgttgctgttaggttcttggatagtgtgcatcggccccagcatcagcagtaataattcatactaatgggcggtgtgataccaccaatgatatcaaagaaaggatggaggtgttcatccacgaggactacgtgaacaaacgaaacgagctgaggagggagcagaggcgccgggaactgcaaaggctgcaggaggagagcaaccccgacgcctcccgggaggcgctggcaagccaggatagcccgaggactccggctcagtgcctgacgcccaccgacgcgtcaccgtccagcttcatatccccgacttcgaggagcacgctgcactctccggccgcaccggaggagcaggctgctggattgacgtcggaacatctccgcctctacgactgcctcaagccatactagtatgtaggcagagatggactgccactcatcctgatgcgtacacngccagacgaggcatgtcttctaactgataagcacggagacactcctgtggtcaaagcactctn

SEQ ID NO: 49022 - protein, 100 aa, Zea mays
  misc_feature: Ceres CLONE 1459246-F
MEVFIHEDYVNKRNELRREQRRRELQRLQEESNPDASREALASQDSPRTPAQCLTPTDASPSSFISPTSRSTLHSPAAPEEQAAGLTSEHLRLYDCLKPY

SEQ ID NO: 49023 - DNA, 660 bp, Zea mays
  misc_feature: Ceres CLONE 1459253-F
ccccgcggtggcggccgctctagaactagtggatcccccgggctgcaggaattcgcacgagaccattacctagaacatcctaatcgaaaaaaaataatcctccctttctctcctctcctgcctttcgccattactactccccagacccactcccacccgaaggcagagccgccccagcaaatctcacgcacagaaacaccaaaaccccaaaagcccaaactcaccacactaccaatggagaacggcgaccaaagcctcgcctcctcgagggcgccgccgagacggacacgctcaacggcggcgtcccggatgagaagcaggtccccatcacccactccgcaaagtcttacgtcacgctcgccgactacaactccgctcctaatagatgcgtcctgaaagaggaggacggcggtgcccacaccaccgcgaagtcctacgcagctgtcaccgcccaagccgagatcgacgacctccgcgccgacaagctcgacctggaggagaagctcactgaggcccgccgtgagaacaagtccctcgacgaggacacgcaccgcatcgagcggatcttcacgcaggccctgggaggaggtcaccatcgccgagatcgccgccacctctgccgagaaggaagacacctcgctcctgacggaagtcgaaccc

SEQ ID NO: 49024 - DNA, 664 bp, Zea mays
  misc_feature: Ceres CLONE 1459255-F
  misc_feature (475)..(475): n is a, c, t, g, unknown, or other
acagctggagctccccgcggtggcggccgctctagaactagtggatcccccgggctgcaggaattcgcacgagaccattacctagaacatcctaatcgaaaaaacttcccagcccaaaccccgacgcgtccccacctccgtcgccgatgacaccgcgtgctccgcagcttcggaatcacccgccgcacctcctcctcgccgaggttgtcgcctcctgaaaccccttccacaagaagccctgtctcacggaccgctccacggttcccccctcctcggcccgcctccctgatgcggagactccgacgcctgccctctcggggggcggaagcggcggatccttccggtggttcggggtctgaaagcgcccccgccgggggcgggggggggggtccttgtcccgccacaacaacaacccccggagatccggcacgggctccgactccatttcccgtgcgccccccggggggtggccccnccggcgccccggactcccagggggaattgggggctccgaaagtcggggaaggggccaataatggaccttccaatggggaactgattctcgcccccgcccccgggtgggggggggggggtcccccgcatggatgcgccacccccccaccccccaaaagatgccgtcccccttttcttaaaaaggtggacg

SEQ ID NO: 49025 - DNA, 653 bp, Zea mays
  misc_feature: Ceres CLONE 1459262-F
  misc_feature: Encodes the peptide sequence at SEQ ID NO. 49026
  misc_feature (639)..(639): n is a, c, t, g, unknown, or other
cgattgggtacgggcccccctcgagccctgcagtggtaaaggagttgcccacaaaaacccagtaactcgcatcttcctccgtgatccaagttctagcagcgcagcgctcggtttcggcaatgtcggggcgcggcaagggcggcaagggtctgggcaagggcggcgccaagcgccaccgcaaggtcctgcgcgacaacatccagggcatcaccaagccggcgatccggaggctggctaggaggggcggcgtcaagcgcatctccgggctcatctacgaggagacccgcggtgtgctcaagatctttctggagaacgtcatccgtgacgccgtcacctacaccgagcacgcccgccgcaagaccgtcaccgccatggatgtcgtctacgcgctcaagcgacagggccgcaccctctacggcttcggcggctaggtcgcttcctcatctggtggcgaactgcatctgtgtcggcggtggtcgtgttgtgtgcctaatctagtgtagtccgttctctatatcgtcgctgtgttctgtggtgtcttgtatcccatttcctggcataccaacttgccattatcaatggaaaaccctcgttttcatcaaaaaaaaaaaaaaaaaccagagctggggaatcctgcancccgggggatccat

SEQ ID NO: 49026 - protein, 103 aa, Zea mays; identical to SEQ ID NO: 6459
  misc_feature: Ceres CLONE 1459262-F
  misc_feature (25)..(94): Pfam Name: Histone Pfam Description: Core histone H2A/H2B/H3/H4

SEQ ID NO: 49027 - DNA, 656 bp, Zea mays
  misc_feature: Ceres CLONE 1459274-F
  misc_feature: Encodes the peptide sequence at SEQ ID NO. 49028
  misc_feature (621)..(621): n is a, c, t, g, unknown, or other
cgattgggtaccgggccccccctcgagcctgcagtggtaaaggatgctggcatgctgctggccatcgctgtagcctcccatgtcgtccaccagaatcgagccccctggcggcggcggcagccacgcggcccatgacccgcgcgcccgtgagcagcagagccccggccgccgcggcgctctccagccggcggaatggcagacgtggagggggcgcgaggaggaggagcctcagcgtccacgacggtacagcttcaggaggcaccggtcgggcgcggcggagtgggcggcggtagtgctgttcacggtgctggcggtcgtggtgctgctgggcgccgtggccgttcttgtggtggtgctgctgctgcagccccgcgcgccgtacttggcggtgcgggcggcgagcctgaacacgctggtgtacgggcagacgggggcgctggacgacgtgcagctcacggtccgggtggaggcccgcaacggcaacgcgcactcggcggcctacttctcgcgcctcgagtgccgcctcgcgttcgccggcgcgacgctggcggtgctccgcgccgacccgttccgcgtgcccgccaggggcgtcctcccgctggcgtacgtggcgcgcgcgcnaggcgtcccgctgggcgacgccggcagcgctgccc

SEQ ID NO: 49028 - protein, 192 aa, Zea mays
  misc_feature: Ceres CLONE 1459274-F
  misc_feature (181)..(181): Xaa is any aa, unknown, or other
MSSTRIEPPGGGGSHAAHDPRAREQQSPGRRGALQPAEWQTWRGREEEEPQRPRRYSFRRHRSGAAEWAAVVLFTVLAVVVLLGAVAVLVVVLLLQPRAPYLAVRAASLNTLVYGQTGALDDVQLTVRVEARNGNAHSAAYFSRLECRLAFAGATLAVLRADPFRVPARGVLPLAYVARAXGVPLGDAGSAA

SEQ ID NO: 49029 - DNA, 664 bp, Zea mays
  misc_feature: Ceres CLONE 1459276-F
ccgattgggtaccgggccccccctcgagccactgcagtggtaaagatgtggagcgagtccggcacgttcatcgggtacgtggccgtgtaccccgacaaagatacggtgcggctcggccgccgggacatcgccgtggcgtggcgcggcaccatcgcccgcctcgagggggtggccgatctgacagccaaccagatccccctgcgcgagacgggcgtcccctgcccggaccccgacgtgaaagtggaccgatggttcgcggcgctgtacacggacaagggcgccggctgccgctttctgccggtactcaccgcagtaccaagtgctggcctacgtgcacaagctggtggatctgtaccacggtcggtgcgagcatgtgatcgtgacggtcacgggccacagcctgtgcagcgcgctggcgatgctgtgcgccttcgacatcgcggagactcacgcgaacgtgtcgccaggatacaggatggcacctgtgtgcgtgttctcctacgccggcccgcgcgtatgaaacgtcgcctatcagaagccggtctagcgctagctggacgtgctggcgctgcacgatcgtgacatgcaggacagcgtgaccatgtgccttgcagtgtcttcaacgagtctgcgttcacggaactcgtcctgcaggcgcatgacg

SEQ ID NO: 49030 - DNA, 667 bp, Zea mays
  misc_feature: Ceres CLONE 1459277-F
  misc_feature: Translation starting site: 124
  misc_feature (527)..(527): n is a, c, t, g, unknown, or other
cgattgggtaccgggccccccctcgagccctgcggtggtatagggtaggagtcaagttcatgaggccgggccgattccaaaggtaaagctggtgatccagcgcgttgtgtctccagcgatttgatggttgatggcagctttgctccgagatggtctacttcatgccccaaccgcgtgtacagatatgcctacttccacactttttctgaaaggaggagaagggacaggatcatcgagaagctgagatcgttggacgaacttcttcacatactgcaccatagaccgacaaagtttccatgctatatgatccgatcgactacctagtatcgctccagatacagacttcatatgctggtcatggggaagggaggaggaatggcaccggtggatctacctgagctgcatcagtgcatgcactacatcacggcctgaccccgcccaccagatgatgcctccgccgctgcggccctccgcggggaatctgcagccggccgcctgccggatgattcatatggcccaccaagcgncagcagccggcaacgacctcgacccccgacgactacgtaggtccatcgtctagtctcacttcttgagacaaatacacaacctgcgctcctcagatcagacgtctcatcatcgcgactgcctcatgacgtcgagatcgtat

SEQ ID NO: 49031 - DNA, 900 bp, Zea mays
  misc_feature: Ceres CLONE 1459277-R
gcggtggcggccgctctagaactagtggatcccccgggctgcaggaattcccagagctctggtttttttttttttttttagatccagataaatcttactacttttttttggttggtgaagctgttccaaacatacactaaaacatcaaaaactaaaacgaattcaaacgctagcccaaactgagcgccttccaagtaacggttaacatatagcacgtacagacatctcattaattgtcaaaccaagccaagagcttataacacatgattacaccacaacagatttccatatattgacaaagaaaatcttaaacgttgcatcattggtacttctttatatatattggtacaacttctcacttccgcccattagtctttgcaagcagcttctttggtaacttgtccaatggagttgtcttcagaaggaagagtcgggcagcacgctcctgtaaagttccaccacattttaatccgcgagattgcagctctatttttagcttctccagaccaagcacctccaattctgcagatgaactgtactttgcaaggtccaacggctctgaataagagttgctgatgccaacatgttgttctacttgtggcacctcttgattgttttggtttgaagtagctgaagcagtggtatccttgtctgctttccgcacttcttcaacttgtggtaacttctggattattttgggtttgaagtagctaaagcagtgttatcctcatcggcctgtaacttctttctgagggcgccgccaacagaaaatagggataattcaaacatttcctacctttaagcctctggcaccattcccccagaaattacaaagttccaccacccttccagccttcttgagaacttttgtggatccagtgtggggaacattttttcttt

SEQ ID NO: 49032 - DNA, 655 bp, Zea mays
  misc_feature: Ceres CLONE 1459283-F
  misc_feature: Encodes the peptide sequence at SEQ ID NO. 49033
cgattgggtacgggccccccctcgagccctgcggtggtaaagggtcagaagcgagagagctaagctaagccgagctaagaagcacagcaagtctcaccagactagcggctagcgcgagaatggccaaggacatcgaggccgcggcgcacgagggcaaggactactcggacccgcctccggcgccgctggtggacgcggaggagctgaccaagtggtcgctgtaccgcgcggtgatcgccgagttcggggccgcgctgctcttcctctacatcacggtggccacggtgatcgggtacaagcaccagacggacgcggcggcgtcgggccccgacgcggcgtgcgggggcgtcggcgtgctcagcatcgcctgggccttcggcggcatgatcttcatcctcgtctactgcaccgcgggggtgtcgggagggcacatcaacccggccgtcaccttcggcctcttcctggcgcgcaaggtctcgctggtgcgcgcgctgctatacatcgtcgcgcagtgcctcggcgccatctgcggcgtcaggctcgtcaagggcttccagagcgccttctacgtgcgctacggcggcggcgccaacgagctcagcgccggctactccaagggcaccgggctcagcgcggagatcatcggcaccttcgg

SEQ ID NO: 49033 - protein, 178 aa, Zea mays
  misc_feature: Ceres CLONE 1459283-F
  misc_feature (28)..(178): Pfam Name: MIP Pfam Description: Major intrinsic protein
MAKDIEAAAHEGKDYSDPPPAPLVDAEELTKWSLYRAVIAEFGAALLFLYITVATVIGYKHQTDAAASGPDAACGGVGVLSIAWAFGGMIFILVYCTAGVSGGHINPAVTFGLFLARKVSLVRALLYIVAQCLGAICGVRLVKGFQSAFYVRYGGGANELSAGYSKGTGLSAEIIGTF

SEQ ID NO: 49034 - DNA, 691 bp, Zea mays
  misc_feature: Ceres CLONE 1459286-F
  misc_feature: Encodes the peptide sequence at SEQ ID NO. 49035
cgattgggtaccgggccccccctcgagccctgcagtgggcaagcaaggcagccgaatcccaactcctgtgtgtgcctgtcaacgcctcgtcggccgccgccgccgctgcttcgcccctctccgccagccgctcccgctcggagcacgccgccgccgacgtgggcgcgcaccgacggccgtcgtgtcgcatggatatggcccccgcggtcgtctcctccaacccgcgatcggacgaggacatcttcaaagacttctccggtcggcgcgcggggctcgtccgcgccctcacctccgatgtggacgatgtctgcagcttctgcgacccagatagggagaactgtgtctctacggccttcccaacggtacctggaaggtctcgcccgccgacgaacaaggttcttccggatttggccgacgcggcgctcggaatcaacttttccccggacagcatgaatcggccggaattggtctcaattgaacggggcccctttgaataggggattattccaattcccttttttaagggggccgctttagggcccacggggggaaccgtttttcccggggagaccgggttttctccttggcctttaaaaattttgggaaaagaaaacacccccggaaaagggggggggtaaaaaaacgggggggaccccccgcctcccctaaagaaagaagaaggggccctccc

SEQ ID NO: 49035 - protein, 102 aa, Zea mays
  misc_feature: Ceres CLONE 1459286-F
MDMAPAVVSSNPRSDEDIFKDFSGRRAGLVRALTSDVDDVCSFCDPDRENCVSTAFPTVPGRSRPPTNKVLPDLADAALGINFSPDSMNRPELVSIERGPFE

SEQ ID NO: 49036 - DNA, 590 bp, Zea mays
  misc_feature: Ceres CLONE 1459299-F
  misc_feature: Encodes the peptide sequence at SEQ ID NO. 49037
  misc_feature (315)..(315): n is a, c, t, g, unknown, or other
  misc_feature (359)..(359): n is a, c, t, g, unknown, or other
  misc_feature (395)..(395): n is a, c, t, g, unknown, or other
  misc_feature (401)..(401): n is a, c, t, g, unknown, or other
  misc_feature (422)..(422): n is a, c, t, g, unknown, or other
  misc_feature (423)..(423): n is a, c, t, g, unknown, or other
  misc_feature (431)..(431): n is a, c, t, g, unknown, or other
ccctcgagccctgcagtggtaaagggcggcctccacggctccacgtgacctcccaacctagacctagttgtccttcctgttcaacctgcatagcggcggcgcgtcctgccttcagagagagagggagagagagcgcttgatctccgtaggcatggcatgggaggaggaggcggtagaagaggaggattacggggaggagatgtcggcttcggagtcggaggaggacgtcgtggtggggcagatgccgacggttatggtgccaaagcatatcaataagcggtccctgaagacaaggcgctgtctgttaccctcgancagaaagcgctcagggatttcgtgactggggtccacaagcggangaaaaagagaagaaaggaggcgcagaagattttgcnggagangggagagaagaagaatatccnngaccgccngaggaggaaagaagagaaggagattgctctgtatggaaaactcctggaatccggaaaaaaaatgatgggggctgggattagaaaaccaaaaaatccccccaatggatgggggagggatttgggaaattggccacacccttttgcttgaaaacccaaaag

SEQ ID NO: 49037 - protein, 62 aa, Zea mays
  misc_feature: Ceres CLONE 1459299-F
  misc_feature (55)..(55): Xaa is any aa, unknown, or other
MAWEEEAVEEEDYGEEMSASESEEDVVVGQMPTVMVPKHINKRSLKTRRCLLPSXRKRSGIS

SEQ ID NO: 49038 - DNA, 644 bp, Zea mays
  misc_feature: Ceres CLONE 1459305-F
  misc_feature: Encodes the peptide sequence at SEQ ID NO. 49039
  misc_feature (500)..(500): n is a, c, t, g, unknown, or other
  misc_feature (527)..(527): n is a, c, t, g, unknown, or other
tccccgcggtggcggccgctctagaactagtggatcccccgggctgcaggaattcgcacgagaccattacctagaacatcctaatcgaaacgcagagaccatacctagaacatcctaatcgaaaagctaccaccgtgctctcacgacagatttccgagctcggtatttatcctgctgtcgatcctttggattccacatccagaatgttgtctcctcatgttcttggcgaggctcactacaacactgctcgtggtgttcagaaggttcttcagaattacaagaatcttcaagatattattgccattttgggaatggatgagctcagtgaggacgacaagttaacagtcgctcgcgctaggaaaattcagcggttccttagccaacctttccatgttgctgaagttttcacaggcgcacctggaaagtatgttgagcttaaggagggtgttcaaagtttccagggtgttctggatgggaaatacgatgacctttcagagcangcattctacatgggtggaggaatagangaggtcattgccaaagctgaaaagattgccaggagaacgcttgatagaaactttctctttacaagccaccttgcattttaaccctttttcgggccaacctgttgggctttttactgg

SEQ ID NO: 49039 - protein, 134 aa, Zea mays
  misc_feature: Ceres CLONE 1459305-F
  misc_feature (12)..(119): Pfam Name: ATP-synt_ab_C Pfam Description: ATP synthase alpha/beta chain, C terminal domain
  misc_feature: SWISSPROT Homolog: EC 3.6.3.14 H(+)-transporting two-sector ATPase
  misc_feature (99)..(99): Xaa is any aa, unknown, or other
  misc_feature (108)..(108): Xaa is any aa, unknown, or other
MLSPHVLGEAHYNTARGVQKVLQNYKNLQDIIAILGMDELSEDDKLTVARARKIQRFLSQPFHVAEVFTGAPGKYVELKEGVQSFQGVLDGKYDDLSEXAFYMGGGIXEVIAKAEKIARRTLDRNFLFTSHLAF

SEQ ID NO: 49040 - DNA, 708 bp, Zea mays
  misc_feature: Ceres CLONE 1459308-F
  misc_feature: Encodes the peptide sequence at SEQ ID NO. 49041
  misc_feature (610)..(610): n is a, c, t, g, unknown, or other
aagctggagctccccgcggtggcggccgctctagaactagtggatcccccgggctgcaggaattcgcacgagaccatacctagaacatcctaatcgaaaaaggcacagccgcacagccgccgccgctccatccacctctccacaccatctgacgctgctcccaccgaggtctccaaggctcactcctcaccagcttctgctctctccctcctcatctctgctctgctctggaccgttaactctccagctccccctcgctccgttcccttccgcccaaatcaccgggaccaccaccgccttcttcaagatcggcgggcgggcaccggccggctatgacatccaccgtcaccacaaccgttgggtgcggggggctccccgtccgcccgtcgtcgacggcgaccagaggacgcccacgcagatgcgccgtccgagcccaggccgcgggagcggatgcccctccatgatagtcagtggaagtcatgcgcaagttctccgagcagtacgcccgccgctccaacacttcttctgcgccgacaagacagtcactgccgtcgtcatcaaggaacttgctgatcccagggatactcttggagctcttcatgccttgtangcattagaatgacaacctgcggaggtaccaaaggatttgggattgcccctgtgtccccggcgggaaagaaaggaatccccgtatgctttttctacccc

SEQ ID NO: 49041 - protein, 43 aa, Zea mays
  misc_feature: Ceres CLONE 1459308-F
MTSTVTTTVGCGGLPVRPSSTATRGRPRRCAVRAQAAGADAPP

SEQ ID NO: 49042 - DNA, 725 bp, Zea mays
  misc_feature: Ceres CLONE 1459311-F
  misc_feature: Encodes the peptide sequence at SEQ ID NO. 49043
  misc_feature (433)..(433): n is a, c, t, g, unknown, or other
  misc_feature (618)..(618): n is a, c, t, g, unknown, or other
caaagctggagctccccgcggtggcggccgctctagaactagtggatcccccgggctgcaggaattcgcacgagaccattacctagaacatcctaatcgaaaaacacttctcctaaagtttccccacccccgtccgccgatccaccaccgatctggtctcactgcatcctcctcccctcgccgtccaagagcgccggtccgatgggtcgtccgccgagcaccactggtgctccggccttccgcttcctcccttccgaggtggcggagatggaggcgcgcttgctgcagctcaacaacggcatccccacccgcgccatgctccagactctcgccgataagttctccgcctcgcccgagcgcgccggcaaggtggccatccagcccaagcaggtgtggaactggtttcagagcaggcgttactcgcatcgggccnagaccaccaggtcgtgccgtctccaccggctaagatgaccccctcgggggccgatcaccaccagcacgcccgctacgcctccgctttcaggccgctcagccctcttctgtcgctgttgctcaccatgcctcctcctccacgggaagaatcttaggaaagggggccccatttgatttgaggccaancccctccgggaggcgcaggaaaaattttcctcccttccgccccaaggttgtttaaacccgggcaccggaagtggggtttctttttttcgatttgggcaaaaggaata

SEQ ID NO: 49043 - protein, 89 aa, Zea mays
  misc_feature: Ceres CLONE 1459311-F
  misc_feature (78)..(78): Xaa is any aa, unknown, or other
MGRPPSTTGAPAFRFLPSEVAEMEARLLQLNNGIPTRAMLQTLADKFSASPERAGKVAIQPKQVWNWFQSRRYSHRAXTTRSCRLHRLR

SEQ ID NO: 49044 - DNA, 699 bp, Zea mays
  misc_feature: Ceres CLONE 1459315-F
  misc_feature: Translation starting site: 172
  misc_feature (699)..(699): n is a, c, t, g, unknown, or other
aaagctggagctccccgcggtggcggccgctctagaactagtggatcccccgggctgcaggaattcgcacgagaccatacctagaacatcctaatcgaaaaactctggactggagggcaccaagctaacatttagttgcaaaggagcgctaggaagaagaagcaacgagccatggcctccggtggcccgaaacccaaactggcctacatcatcttgtacgtgagggacgtggagaaggccgcctccttctacgacgccgccttcggctacaccgtccgccgcctcgaccagtcccgcaagtaaaacgcgtgcgcgcgcgcctgtgcccgcctgatccggatgcgcgcctaatctgccgcatctgcgcgcctttctgggtttactttgcaggtgggcggagctggagagcggggcgacgaccatcgcgttcacgccgctgcaccagcgggagacggacgagctgtcgggggcggtgcagctgccggactcgtcggccgccgggaggggctccgtagaggtctgcttcgcctacgcggacgtcgacgcggcgtacaagcgcgccgtggacaacggggccgtggccgtgagcgcgccggaggacaagccctggggccagaagtccggcttcgtgcgggacatggacggcaacatcgtgcgcatcgcgagctacgtgcgagagtagtcgcattccgctgcatn

SEQ ID NO: 49045 - DNA, 718 bp, Zea mays
  misc_feature: Ceres CLONE 1459320-F
  misc_feature (397)..(397): n is a, c, t, g, unknown, or other
  misc_feature (427)..(427): n is a, c, t, g, unknown, or other
  misc_feature (449)..(449): n is a, c, t, g, unknown, or other
  misc_feature (478)..(478): n is a, c, t, g, unknown, or other
  misc_feature (479)..(479): n is a, c, t, g, unknown, or other
  misc_feature (483)..(483): n is a, c, t, g, unknown, or other
  misc_feature (493)..(493): n is a, c, t, g, unknown, or other
  misc_feature (502)..(502): n is a, c, t, g, unknown, or other
  misc_feature (504)..(504): n is a, c, t, g, unknown, or other
  misc_feature (507)..(507): n is a, c, t, g, unknown, or other
  misc_feature (560)..(560): n is a, c, t, g, unknown, or other
  misc_feature (664)..(664): n is a, c, t, g, unknown, or other
  misc_feature (668)..(668): n is a, c, t, g, unknown, or other
  misc_feature (669)..(669): n is a, c, t, g, unknown, or other
  misc_feature (671)..(671): n is a, c, t, g, unknown, or other
acaccaggagatcaccgcggtggcggccgctctaaaactagtggatcccccgggctgcaggaattcgcacgagaccattacctagaacatcctaatcgaaaatcttattcttatcgcccccaggggggtctccactctctccagacagccgccaccgccgccggtggttcacaagcagccggtacgtactcaacccaaaccgcaaggaggacatggatcccaaattctagcgcgactcctccagcctggagcccaaacgaacctaaggcgcttgaactctttcccccacggcgggaggcggggtccgcctcgggttccagcgcccctccgaccttgtggcgccgaggccccggctctttttgcccccccacgagaggggggggcgcgcgcagataanaacacccaattcattttttcaccccccccncaagaaccacgcccccaccaanccccggcccgcggccccggcggaaaggcnngacncggaacgcancccactagncntcnccaccccggtagggtagagtttagaaacaccaagctacattgaacgccggagncaaaggacatcataaaacaaccgaaccccccccccctcaccgattcggaatccccccacggaatttacccccccaagcccccacaatgcgtcgacgcccgcccnccanngntccgtatattaccgccacccaccgctaggaggcgagggcccagacca

SEQ ID NO: 49046 - DNA, 719 bp, Zea mays
  misc_feature: Ceres CLONE 1459321-F
  misc_feature: Translation starting site: 186
  misc_feature (409)..(409): n is a, c, t, g, unknown, or other
  misc_feature (455)..(455): n is a, c, t, g, unknown, or other
  misc_feature (457)..(457): n is a, c, t, g, unknown, or other
  misc_feature (459)..(459): n is a, c, t, g, unknown, or other
ctggagctccccgcggtggcggccgctctagaactagtggatcccccgggctgcaggaattcgcacgagaccattacctagaacatcctaatcgaaaagtccgattgtgcgctgtcgcagcctctgccctctcccagcccgctcctccatctccggtgagacgcgaattgaatcgcatcgaatccatgggcagctcctcgaataccaacacgagcggcggggccagcgacaaggaggagaagaagaaggaggacaagatcaaaggcaaggactcgtcggggccatccttcaaggagaacgaaagggtcctcgcctaccacggccccctcctctacgaggccaaggttcaaaggatcgaaaaccatgaagatgaatggcgctactttgtccattatctcggttggaatanaaactgggatgaatggggtgcaaatgaccgcttggtggaattgacngnangaaaacgtgcgcaaacaaccagagcttgaatagaatcaggtagatgacaaaacaatgaagtctgaacgggtcaccacgcataaaccaaagttctccatgcggaagcaaaagctgaaaaagaggaccctaaaagtccctggaaggggaaaaacctaaaaatccccttggggctggaattcccgggaagggaaaaaaaaccccccaagcccaaagggggggggttttcctttgccccgagaaaacccttgtgggaaatggtg

SEQ ID NO: 49047 - DNA, 713 bp, Zea mays
  misc_feature: Ceres CLONE 1459322-F
  misc_feature: Encodes the peptide sequence at SEQ ID NO. 49048
  misc_feature (472)..(472): n is a, c, t, g, unknown, or other
  misc_feature (713)..(713): n is a, c, t, g, unknown, or other
aaagctggagctccccgcggtggcggccgctctagaactagtggatcccccgggctgcaggaattcgcacgagaccattacctagaacatcctaatcgaaaaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgagggcaagtacgacggcgacctgccgcccgcgcacgcgtcgctgctggccgcgcacctggcgcgcatgaaggagtcgggtgagctggtcttcgtcaagaacaactacttccgcgccgacgcgcccgacgcgccgccgaagcgcgggcgcgggcggcccccgaaggcgcgggaccccggcgcgccggtgtcccgccatcggggccncggggcgcgggcgcccgcccaagcccaaggacccgctggacgccgccgtgaagcaggccaccgcgggcatgcccagggcccgcggccgcccgcccaagaaggcaagaacgaggggcggcgcgtccccggcccccgccggcgacggctccaccccggtcaagcggcggccgcggccgcccccccaaggaccgcccccgtcgtgcccagcgagacgggccgcggcttgacggacgctgctgcn

SEQ ID NO: 49048 - protein, 190 aa, Zea mays
  misc_feature: Ceres CLONE 1459322-F
  misc_feature (13)..(81): Pfam Name: Linker_histone Pfam Description: linker histone H1 and H5 family
  misc_feature (110)..(110): Xaa is any aa, unknown, or other
MATEEVAKPSPIPPYPEMILAAIEDLGDKSGSNKSAISRYIEGKYDGDLPPAHASLLAAHLARMKESGELVFVKNNYFRADAPDAPPKRGRGRPPKARDPGAPVSRHRGXGARAPAQAQGPAGRRREAGHRGHAQGPRPPAQEGKNEGRRVPGPRRRRLHPGQAAAAAAPPRTAPVVPSETGRGLTDAAA

SEQ ID NO: 49049 - DNA, 916 bp, Zea mays
  misc_feature: Ceres CLONE 1459323-R
  misc_feature (110)..(110): n is a, c, t, g, unknown, or other
  misc_feature (131)..(131): n is a, c, t, g, unknown, or other
  misc_feature (137)..(137): n is a, c, t, g, unknown, or other
  misc_feature (301)..(301): n is a, c, t, g, unknown, or other
  misc_feature (393)..(393): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (766)..(766): n is a, c, t, g, unknown, or other
  misc_feature (839)..(839): n is a, c, t, g, unknown, or other
  misc_feature (840)..(840): n is a, c, t, g, unknown, or other
  misc_feature (843)..(843): n is a, c, t, g, unknown, or other
  misc_feature (860)..(860): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (916)..(916): n is a, c, t, g, unknown, or other
cgattgggtacgtcgagcgctcgtgagacgactgcctgcagcccgggggatccatctagttctagagcggccgccaccgcggtggagctccagcttttgttccctttagntgagggttaattacaaaaccncgcccntccaaaaggaacagtcttggttatctagcctcgacaacatcgttcaaaaaaccaaaacggcttaccccccaaaatttttcgccgggcaagcacagtgtattttggcagcgggattactcgttacgaaatccgggactcgggagactcgataaacgggcgctccntctccgaaagaccaaaaagcagagagtttttttttccgttcatccctttgaggaaacctggtccattgttccttcttcaggaaatgggccgngtcggcccctctttagggggcgacggggtatgcctactggtgaatgagggaaaacaccaccatctcaaggatcaccagggctttcgggatcgccgccgggaagtgctccccctctgccgtaaaggcggggaattggccccccctgtctgggctaaaaacttggggggcataaccctgccctgagaggggaagaggaccttcccttttgatgtacaaaatctttgggagaggnnntggggagagggcgaagctcttagaagaaacaggggggaaaaaaaaaaccaatgggtttaaaagagccttggaggactggaaagcccccgcttaaaaaaaaacgcccccggctgacccgccccccgggaaaccgcccagnaacccgggggtggaaaaatttaagggggaaccagtgggcctccaaaatttacaaattgtccggggccaaaatnntcnaaaagctacagtggccnggggccgccccctcggaatttggggggggggaatagannnnaacgcggtagatttn

SEQ ID NO: 49050 - DNA, 723 bp, Zea mays
  misc_feature: Ceres CLONE 1459324-F
  misc_feature: Encodes the peptide sequence at SEQ ID NO. 49051
  misc_feature (362)..(362): n is a, c, t, g, unknown, or other
  misc_feature (539)..(539): n is a, c, t, g, unknown, or other
  misc_feature (549)..(549): n is a, c, t, g, unknown, or other
  misc_feature (558)..(558): n is a, c, t, g, unknown, or other
acccgcggtggcggccgctctagaactagtggatcccccgggctgcaggaattcgcacgagaccattacctagaacatcctaatcgaaaagacgacacaaaccccagtttaggaacagttggaaaagagggagaaatggagaacggcggcggcaaaggcgacgttcccaacgatgcgaacgaacattgccctggaacgcagtcggaggaggcggggaaggcggatgcctgcgctgggtgccccaaccagcagatttgcgccaccgcccccaagggccccgatcccgatgtggttgctattgttgagaggttggctactgtgaaacacaaattattagttttgtctggaaagggaggtgtggnaaagagcacattctcagccccactctcctttgccttagctgaaatggaccatcagggtggcctttctgactaaatatatgtgggcctagcatcccaaaaatgtagggcctcgaggggacagataatccatcaaagcaccctgggttggccacctggggatgtccagtccaacttggncgggaagtcnaattggttnctgctgcccaatcaaaatgaccctggcttagggaggggccccccaagaatggactggtccaccctttcttaaaggattttaacgggggggaaaattacatccttggaggggagcccccccgagaaacttgaagggcccttctcgatggggaaacctttccccccc

SEQ ID NO: 49051 - protein, 99 aa, Zea mays
  misc_feature: Ceres CLONE 1459324-F
  misc_feature: SWISSPROT Homolog: EC 3.6.3.16 Arsenite-transporting ATPase
  misc_feature (76)..(76): Xaa is any aa, unknown, or other
MENGGGKGDVPNDANEHCPGTQSEEAGKADACAGCPNQQICATAPKGPDPDVVAIVERLATVKHKLLVLSGKGGVXKSTFSAPLSFALAEMDHQGGLSD

SEQ ID NO: 49052 - DNA, 703 bp, Zea mays
  misc_feature: Ceres CLONE 1459327-F
  misc_feature: Translation starting site: 173
cagagctggagctccccgcggtggcggccgctctagaactagtggatcccccgggctgcaggaattcgcacgagaccatacctagaacatcctaatcgaaaaactctggactggagggcaccaagctaacatttagttgcaaaggagcgctaggaagaagaagcaacgagccatggcctccggtggcccgaaacccaaactggcctacatcatcttgtacgtgagggacgtggagaaggccgcctccttctacgacgccgccttcggctacaccgtccgccgcctcgaccagtcccgcaagtaaaacgcgtgcgcgcgcgcctgtgcccgcctgatccggatgcgcgcctaatctgccgcatctgcgcgcctttctgggtttactttgcaggtgggcggagctggagagcggggcgacgaccatcgcgttcacgccgctgcaccagcgggagacggacgagctgtcgggggcggtgcagctgccggactcgtcggccgccgggaggggctccgtagaggtctgcttcgcctacgcggacgtcgacgcggcgtacaagcgcgccgtggacaacggggccgtggccgtgagcgcgccggaggacaagccctggggccagaagtccggcttcgtgcgggacatggacggcaacatcgtgcgcatcgcgagctacgtgcgagagtagtcgcattccgctgcatcacc

SEQ ID NO: 49053 - DNA, 716 bp, Zea mays
  misc_feature: Ceres CLONE 1459333-F
  misc_feature: Encodes the peptide sequence at SEQ ID NO. 49054
  misc_feature (372)..(372): n is a, c, t, g, unknown, or other
  misc_feature (384)..(384): n is a, c, t, g, unknown, or other
  misc_feature (410)..(410): n is a, c, t, g, unknown, or other
  misc_feature (413)..(413): n is a, c, t, g, unknown, or other
ctggagctcaccgcggtggcggccgctctagaactagtggatcccccgggctgcaggaattcgcacgagaccattacctagaacatcctaatcgaaaattcccaaaagaatgctcctcaggtcataagtttgcagtgttatatgaagcaaggtcaatcacaggaattgatagaatgaaaatcataaacgcagcagcgaaatctgtaccacaacctcataaagttgacctgaagaacccagacaagactattgttgtccagattgcaaagaccatatgcatgattggagttgtggaaaggtacaaagagctctcgaaagtcaacctaaggcagctgaccctcaccgagtcggagaagtaagcctatgagtgancaaatcttccangcaaaacgtggaccaacttaaatcancancagcgtccggtgggtaggcgctaccaaataaaataaagcccgggcgacccccctggcttgaaagaattcaaggtcccaaggttaaggcttaacccccagggtaaggggtgctgggtcatgcttcccaggtaaaaatcccaattttttttttgaggttgaaaaaaaaattgaaaaaaccttgggggggggtttcccccagaaaaggggtcccaaaagggggttaaacaaaaaaaaaaaatattttgtggacccccctttgtttaaaactctttttaattgaaaaaaaacccccgggcgggagtt

SEQ ID NO: 49054 - protein, 118 aa, Zea mays
  misc_feature: Ceres CLONE 1459333-F
GAHRGGGRSRTSGSPGLQEFARDHYLEHPNRKFPKECSSGHKFAVLYEARSITGIDRMKIINAAAKSVPQPHKVDLKNPDKTIVVQIAKTICMIGVVERYKELSKVNLRQLTLTESEK

SEQ ID NO: 49055 - DNA, 708 bp, Zea mays
  misc_feature: Ceres CLONE 1459341-F
  misc_feature: Translation starting site: 151
  misc_feature: SWISSPROT Homolog: EC 3.2.1.23 Beta-galactosidase
aagctggagctccccgcggtggcggccgctctagaactagtggatcccccgggctgcaggaattcgcacgagaccattacctagaacatcctaatcgaaaagataaaaggagggttcaaggagttcaaaaagttacttgcgtccccggatatgatggtcccggttgctggcctgggaaatattcttggcctacaaggactcatgccaaatcccacggctggtaccgtcacacctaacattccccaggttataaaagatttctataccggaaaagtacaattcacagcgaaacacaactgggattgttcacattccgtttgggaaactgaatttcacataggaagacctggtcgtaaacatccttgcaccagtgaaatcggtggagacaaacaagccagagggagcataaggaacgcacaggaaaagcgcacacctatgttcgtcaatggggacatccctcacgttgaacctaaaggagatgatagacttcaggccgtaaaaaaccacatttgtgtttttttttttgtgactggaggctaacatatctataccgtctatctcgagggggggcccggtacctacttcgccctatagcgagtcgtattacacgcgctcaatggtcgtctgtttagggcgtcgtgacagggaaaaccctggcgttacccaagttaatcggcttgcagcacatccccctttcgccagctggac

SEQ ID NO: 49056 - DNA, 696 bp, Zea mays
  misc_feature: Ceres CLONE 1459344-F
  misc_feature: Encodes the peptide sequence at SEQ ID NO. 49057
aagctggagctccccgcggtggcggccgctctagaactagtggatcccccgggctgcaggaattcgcacgagaccattacctagaacatcctaatcgaaaaatttagattccgaccccaaaatcgctctccgagctcgaccaaaaagcaccctctctgattcattccgcccacgtccacgtacgtacgtacattcccaccagctcccagtgtagcgccggtctgtaacccataaacatagacatatcatggtggtcctcaccaaaggcgagctggaccacatcgcgctgccggccgtgcagcgcgcatcgcgacgtcgcgggcagcgtgctggaagtcgacctgcgagtttgggatgctgacgcaggggccgggggacgaggcttgcaaagatcacgttttcccaccgcaacggtcatgggaaggcaaaacacctcctgggggcctcagggccccgggggcgggtttttaaggcccccgaaggggaaaaggacgggcccccggtgcccctttcggaacccaccaaggggatggggccaaggggaatcatgggggggaaagaatttcggggggcaaaaacaccccgggaaattcccccccttttttaaaaagggggggaaacccctttttccgagaaccccccgcgcccttatttttttgggaaaaaaaaggggggggccccaatttaaaaaaaaaa

SEQ ID NO: 49057 - protein, 37 aa, Zea mays
  misc_feature: Ceres CLONE 1459344-F
MVVLTKGELDHIALPAVQRASRRRGQRAGSRPASLGC

SEQ ID NO: 49058 - DNA, 724 bp, Zea mays
  misc_feature: Ceres CLONE 1459346-F
  misc_feature: Encodes the peptide sequence at SEQ ID NO. 49059
  misc_feature (291)..(291): n is a, c, t, g, unknown, or other
ctggagctccccgcggtggcggccgctctagaactagtggatcccccgggctgcaggaattcgcacgagaccattacctagaacatcctaatcgaaaaactcctgacctcacctctccgaactgcagcacctcccctcccgccacccacacgtgctcccatggccgccaccgcgatctcagtccgcctccacccaaccgccgcgcgccatgtggcctccgcccgccgcgcccgcctcggggccgtccgcgcgcagtccgcgccggcggcggcggcggcggcgctgacgcangacgacccctcagcgctggcggcggtgcgcgccgtcgagcaggtgaagagcgggatggtgctcgggctcgggaaggggtcaacggccgccttcgccgcccccaaaatcggggccgtcccggccccggggaaactccaaaaaaatagtcggggggccccaattccaaggcaacctttcaaaaagggggaaatcctttcgggatcccccttttcccagggtgaaaaaaaacccggttatataaacctcccattaaaaagggggccaaaaaagagtaacccccccccccccccccttttaaaaaggggggggggggggcgcctctcctcccagaaaaaaaatggtaaaaacgcccccccacaaaaattttttttgttttttttgggaaaaaaaaaaaacatttttttttggtttgaaaggaggggcggcccccccc

SEQ ID NO: 49059 - protein, 188 aa, Zea mays
  misc_feature: Ceres CLONE 1459346-F
  misc_feature: SWISSPROT Homolog: EC 5.3.1.6 Ribose-5-phosphate isomerase
  misc_feature (44)..(44): Xaa is any aa, unknown, or other
MAATAISVRLHPTAARHVASARRARLGAVRAQSAPAAAAAALTXDDPSALAAVRAVEQVKSGMVLGLGKGSTAAFAAPKIGAVPAPGKLQKNSRGAPIPRQPFKKGEILSGSPFSQGEKKPGYINLPLKRGPKKSNPPPPPLLKRGGGGRLSSQKKNGKNAPPQKFFLFFLGKKKNIFFWFERRGGPP

SEQ ID NO: 49060 - DNA, 690 bp, Zea mays
  misc_feature: Ceres CLONE 1459347-F
  misc_feature: Encodes the peptide sequence at SEQ ID NO. 49061
aagctggagctccccgcggtggcggccgctctagaactagtggatcccccgggctgcaggaattcgcacgagaccattacctagaacatcctaatcgaaaagataaaccacagagccaccccactaactactttcaccattgtttccagaaaaatctccgcgcataatattctctagagcaaacgctctgtcatcacacaacactagttcgtccgcacgacactcccgcagttcctcgacaggggagaggtttccattccaggcggttgcggttgcggttggcggcggaaatgagccgggggagcaagctccggtggctgtggcgcgcgccggcgcgggcgctggggcgggcgcgggacctgtacgtgcgggggctgacggggtgcgcgcgccacgtcccctccgacgccgtgttcgggtaccccgtgttcgtgccggcgccgctgtccaggagccacagcgccgtcggctggggcgccgggtcgtccgaggccgacgaggacctgcgcgaggtggtccgcgccgcgtcgcagcgccgcgtggagcagcgccgcgccgagctgcaggccgtgccccggagccagaacatggccgcctcgctctccatggcgcgcatcgacgaggacgcgccgtgcgacttcggggcgcccggggcgctgtgcccgaagagccagagctgtgtcggcgacc

SEQ ID NO: 49061 - protein, 133 aa, Zea mays
  misc_feature: Ceres CLONE 1459347-F
MSRGSKLRWLWRAPARALGRARDLYVRGLTGCARHVPSDAVFGYPVFVPAPLSRSHSAVGWGAGSSEADEDLREVVRAASQRRVEQRRAELQAVPRSQNMAASLSMARIDEDAPCDFGAPGALCPKSQSCVGD

SEQ ID NO: 49062 - DNA, 662 bp, Zea mays
  misc_feature: Ceres CLONE 1459356-F
  misc_feature: Encodes the peptide sequence at SEQ ID NO. 49063
tccccgcggtggcggccgctctagaactagtggatcccccgggctgcaggaattcgcacgagaccattacatagaacatcctaatcgaaaacacaagatagttctacacttgtccaaaatgagggcaccacaaaagaccccctatcatccactttgccagactccttagatgagatcaatcaattaagatctggcaccggtgaacaatcttcagttaccggttctgcaacagattcaatgcaggtgggattcacggcatcagatcatatggatctactgattgaacaaattaagatgcttgctggggaggtcgcatttggtaccagttcgctgaaaagactaatcgaacagtccatagatgaccctgaagcaacaaaagaccaaatcgagaatttagagcgtgaaatccagcaaaagaggagacatatgcgagccctggaaaaacaaatcatggaaagtggcgaggcatcagttgctaatgcatccatgatggatatgcagcagactatcacgaaactaacagctcaatgcagtgagaaggctttcgacttagagttaaagtcagctgataatcgtgtcctccaggagcagctacatcagaagaatttggaaatctacgatttacaagaaaaagttcttcgcgttgagcaacaactctcaga

SEQ ID NO: 49063 - protein, 141 aa, Zea mays
  misc_feature: Ceres CLONE 1459356-F
MQVGFTASDHMDLLIEQIKMLAGEVAFGTSSLKRLIEQSIDDPEATKDQIENLEREIQQKRRHMRALEKQIMESGEASVANASMMDMQQTITKLTAQCSEKAFDLELKSADNRVLQEQLHQKNLEIYDLQEKVLRVEQQLS

SEQ ID NO: 49064 - DNA, 685 bp, Zea mays
  misc_feature: Ceres CLONE 1459357-F
  misc_feature: Encodes the peptide sequence at SEQ ID NO. 49065
  misc_feature (533)..(533): n is a, c, t, g, unknown, or other
  misc_feature (555)..(555): n is a, c, t, g, unknown, or other
ggagctccccgcggtggcggccgctctagaactagtggatcccccgggctgcaggaattcgcacgagaccattacctagaacatcctaatcgaaaaatcaagccattcgtccctgtggaagtttccacactcccttcccttcccttgtacccactccaatggcgccctccctcctggccgccgtctccgcctcgcccttcctcctacccggcagcagcggcatcagccgcaggccactgggcgctgccccaacccgccgggccggactgcgcgtggccgcgcttaagtacgaccctgctaaggtggcaccgcagaacgaccgggtgctcgtccgtcttcagcagatccctgagaaatctgctggtggtgtattgctaccgaaatctgctgttaagtttgagaagtatctgatgggtgagattctatcggttggtgctgatgttagtgaagttgaagctgggaagaagttctcttctcaacatcaatgcttacgaggtggaccttgatacggatgagaaacactgcttctgccnggagtcagaaattgtagctgtnagtgaatgaattttaccatgaaaatacagacttacttgcccatgctccaactgcatggacttatcttgcacctactttgtggtacttgaactcggcttctagatgagtgtagttatcattgtattttgcc

SEQ ID NO: 49065 - protein, 115 aa, Zea mays
  misc_feature: Ceres CLONE 1459357-F
  misc_feature (48)..(109): Pfam Name: Cpn10 Pfam Description: Chaperonin 10 Kd subunit
MAPSLLAAVSASPFLLPGSSGISRRPLGAAPTRRAGLRVAALKYDPAKVAPQNDRVLVRLQQIPEKSAGGVLLPKSAVKFEKYLMGEILSVGADVSEVEAGKKFSSQHQCLRGGP

SEQ ID NO: 49066 - DNA, 666 bp, Zea mays
  misc_feature: Ceres CLONE 1459360-F
  misc_feature: Encodes the peptide sequence at SEQ ID NO. 49067
  misc_feature (666)..(666): n is a, c, t, g, unknown, or other
ctggagctccccgcggtggcggccgctctagaactagtggatcccccgggctgcaggaattcgcacgagaccattacctagaacatcctaatcgaaaactcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaaaaaaagccatatgttgtggagcttgatcagcgagaggatggctcaaagatttcaggatgccttacttgagatagttggcaggcgtactgtcccctcagtttttgtccatggaaagcacctgggtggttctgacgatactgttgactcctacgaaagtggaaaactggctagacttctaaacatcggagtcaaggacgaacctttgagtgacatgctacatcggtcagccctgttcgtttggtttcaatccgtacccgcttctactacttctatattggttttggcccctatggattacn

SEQ ID NO: 49067 - protein, 167 aa, Zea mays
  misc_feature: Ceres CLONE 1459360-F
  misc_feature (44)..(108): Pfam Name: Glutaredoxin Pfam Description: Glutaredoxin
  misc_feature: SWISSPROT Homolog: EC 1.11.1.15 Peroxiredoxin
MVALLGRRIGVAAAAAAFIALVAFGSASSSPKSFVKSTVSAHDVVIFSKSYCPYCKRAKAVFKELELKKSHMLWSLISERMAQRFQDALLEIVGRRTVPSVFVHGKHLGGSDDTVDSYESGKLARLLNIGVKDEPLSDMLHRSALFVWFQSVPASTTSILVLAPMDY

SEQ ID NO: 49068 - DNA, 688 bp, Zea mays
  misc_feature: Ceres CLONE 1459372-F
  misc_feature: Encodes the peptide sequence at SEQ ID NO. 49069
atagctggagctccccgcggtggcggccgctctagaactagtggatcccccgggctgcaggaattcgcacgagaccattacctagaacatcctaatcgaaaactctcctcccaatctcccattaccccagcggcccagcgtgcggagacgggagacgcgctccccagtccccacccccctctcgtgtcgtggcgacgactggggggctgtcgctgccgccctacgtcaggtggccaggtcgtattagggcacttcgccggcgacgagtaccacaaggcagtggacactttctctggtatcagaggatcaatgtccaattattatgatgactacgatgaccttgacgggatggaggatgattatgatatggatgatcccattgatgacatggtagacgagcagcaagggattaggcacccccatgcggaagataatgattatgggacaacaaaatgataagatcccagatactttctcacctgatgcaggaaaaggaagggacattcaaggaataccctgggagcagataaacaaaccccgtaaaaaatccggacagtccaaattagaccagtacaaaaattatgagaatggtcctaactcctggaaagaagctatgaaggattgcaaaccaaccgagaaaggttgggatatactatgagtttaaacaaattactagatcggttaaatc

SEQ ID NO: 49069 - protein, 78 aa, Zea mays
  misc_feature: Ceres CLONE 1459372-F
MRKIMIMGQQNDKIPDTFSPDAGKGRDIQGIPWEQINKPRKKSGQSKLDQYKNYENGPNSWKEAMKDCKPTEKGWDIL

SEQ ID NO: 49070 - DNA, 689 bp, Zea mays
  misc_feature: Ceres CLONE 1459376-F
  misc_feature: Encodes the peptide sequence at SEQ ID NO. 49071
  misc_feature (562)..(562): n is a, c, t, g, unknown, or other
  misc_feature (638)..(638): n is a, c, t, g, unknown, or other
  misc_feature (672)..(672): n is a, c, t, g, unknown, or other
aagctggagctcaccgcggtggcggccgctctagaactagtggatcccccgggctgcaggaattcgcacgagaccattacctagaacatcctaatcgaaaaaaaccctaaacccctctgatctccctctcgcgccgccgccaccatgtcgccgccgcagccaccacacccggtgccccgagagacggtggccagcgctgtcgcttccctgacaacgtggatgaagaagcgcgctgcggaggcgcgcccgaacctcctcgccgacgagcgcgacgacatcgtggtcctccagctctcgctacgccgcatccccgcctcgcgcagcaccaagccgcgcctcctcccgatgccacatcccgttgttgggcacgacggcgcctccgtctgcgtcatctcggacgaccgcaccaagtcgcggtccccttccgcctccgacctccacgcgtccatgtcgctccaccgtttccccgtctccgaggtcatcccgctctctacgctccgcacggattaccgcccgtacgagtctcggcgccgtctcgcagcctcccacgaactcttcgtcngcgaacgcgccatcctccccctgctgccgcgcgtcctcgggaaggcgttctactccaccaagaaggctccgattgnagtcgatctcaccccgcatcgatgggccgagcangtccgcaggtttcttgg

SEQ ID NO: 49071 - protein, 181 aa, Zea mays
  misc_feature: Ceres CLONE 1459376-F
  misc_feature (140)..(140): Xaa is any aa, unknown, or other
  misc_feature (165)..(165): Xaa is any aa, unknown, or other
  misc_feature (176)..(176): Xaa is any aa, unknown, or other
MSPPQPPHPVPRETVASAVASLTTWMKKRAAEARPNLLADERDDIVVLQLSLRRIPASRSTKPRLLPMPHPVVGHDGASVCVISDDRTKSRSPSASDLHASMSLHRFPVSEVIPLSTLRTDYRPYESRRRLAASHELFVXERAILPLLPRVLGKAFYSTKKAPIXVDLTPHRWAEXVRRFL

SEQ ID NO: 49072 - DNA, 672 bp, Zea mays
  misc_feature: Ceres CLONE 1459377-F
  misc_feature: Translation starting site: 162
  misc_feature (563)..(563): n is a, c, t, g, unknown, or other
tggagctccccgcggtggcggccgctctagaactagtggatcccccgggctgcaggaattcgcacgagaccattacctagaacatcctaatcgaaaaagctggagggcaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtaaaacgcgcgcgcgtgcgcctgtgctgcctgatccggatgcgcgcctaattaatctgccgcatatgcgcgcctttctgggttttactttgcaggtgggcggagctggagagcggggcgacgaccatcgcgttcacgccgctgcaccagcgggagacggacgagctgtcgggggcggtgcagctgccggactcgtcggccgccggccggggctccgtgggagtctgcttcgcctacgcggacgtcgacgccgcgtacaagcgcgccgtggacnacgggggcggtggccgtgagcgcgccggaagacaagccctggggccagaagtccggcttcgtgcgggacatggacggcaacatcgtgcgcatcgcgagctacgtgcgaa

SEQ ID NO: 49073 - DNA, 669 bp, Zea mays
  misc_feature: Ceres CLONE 1459383-F
  misc_feature: Encodes the peptide sequence at SEQ ID NO. 49074
  misc_feature (428)..(428): n is a, c, t, g, unknown, or other
  misc_feature (478)..(478): n is a, c, t, g, unknown, or other
aagctggagctcaccgcggtggcggccgctctagaactagtggatcccccgggctgcaggaattcgcacgagaccattacctagaacatcctaatcgaaaaccggcaccggcagcacgtcgcctcgccccccactcccacgtctctgtccctcccctcccccgtcttcccaaccaccacccacccgttcttttccagccaaaccaacgcacgcacacggcacaccctccttctggcagcagagcggcagccaatggccatcgagacggacgcggcggcggcgagggcgagggcggcgagctcggtttcagagacggcgcccatgtccccggccgccgaggcggcagcggctgcggcggccccgggcccggcgcgcccgcgcgggtggctgaagaaactcatccccacggactacctgcccccgagcanccggcgctggaggctggccgccccgtccgcgccggcgcgtccaggctcgnatcgtcgctctcccgctccctcaagtggaagcgctcccggggttctcctccctcaccctgcgcagcggctccgcgggcgcggcagtggacgccgtcccggttcgcgtcatgtacgtcgtcaaggccgcgtggctgggctcgcgctctcctgcttcttcctcggtgggggtgccccctctaactcccacccc

SEQ ID NO: 49074 - protein, 139 aa, Zea mays
  misc_feature: Ceres CLONE 1459383-F
  misc_feature (59)..(59): Xaa is any aa, unknown, or other
  misc_feature (76)..(76): Xaa is any aa, unknown, or other
MAIETDAAAARARAASSVSETAPMSPAAEAAAAAAAPGPARPRGWLKKLIPTDYLPPSXRRWRLAAPSAPARPGSXRRSPAPSSGSAPGVLLPHPAQRLRGRGSGRRPGSRHVRRQGRVAGLALSCFFLGGGAPSNSHP

SEQ ID NO: 49075 - DNA, 682 bp, Zea mays
  misc_feature: Ceres CLONE 1459384-F
  misc_feature: Translation starting site: 177
  misc_feature (682)..(682): n is a, c, t, g, unknown, or other
tggagctccccgcggtggcggccgctctagaactagtggatcccccgggctgcaggaattcgcacgagaccattacctagaacatcctaatcgaaaaatagaggacagctgagctgcagcatcccgtccaacagcaggaccagcgagggtgtacctccgcctcgcgagtcgggaccatgtggacgggcagcccgctgctccgggacgttggcgccgccgtgctcacggggagtgggcgcggctgccgtgctccgcttctgggaaagatcgccaaccgcgccctgctggaccagaaactctgcaggaaactggtgcacataactgtaggattagtgtttttccttatgtggcctttgttcagctcaaatgatgtgtttgctccatctctcgctccgcttatcatcatcatcaacatcatgaaagtgacagtgatttggacttggtttcgtgaaagctgaaggtgtggttaactccatgactaggcatggagaccgcaaagaacttctcaggggcccgctgtattatgcctgtgctatactctgacaacaatagttttctgggaagaatctcccatctccgatcgcgtgatctggcatttgtgtgcccggaaacgtgttgctgaactagctgggaaaaccattccggcatggttagctccctcacaaccctgaaaaatctatgn

SEQ ID NO: 49076 - DNA, 678 bp, Zea mays
  misc_feature: Ceres CLONE 1459389-F
  misc_feature: Encodes the peptide sequence at SEQ ID NO. 49077
aagctggagctccccgcggtggcggccgctctagaactagtggatcccccgggctgcaggaattcgcacgagaccattacctagaacatcctaatcgaaaagaatttcgaaggagactgtttcataaacaggagccaggcaccggactttccaggaggataccacctcccgaacatggtgcgtcgacgacccgccaccggggcagccccgagaccccacctcgccgccgtcggtcgcgggctgctcctcgcgtccgtcctcgcggccgctgcctcctccctcccagtagccgagtcgtcctgcccgcgagacaactcactggtgagagacataagccgaatgcagcagcgcaactacgggagggaaggattctcgcatataactgtcacaggtgctcttgctcacgggacgaaggacgcggaagtgtggctacaaacatttggtccaggtcaaaggaccccaatccacaggcattcttgtgaagaggttttccttgtcctcaaggagaaaggcacgctcttactcgggtcgagctcgctgaagtacccaggacagccgcaggaagttcctgtcttttcaaaataccacattttcgattccctgtaaatgatccacatcaggtctgggaattctaatgacccacaaaattttgcaagttccttgtgatcatatcccgcc

SEQ ID NO: 49077 - protein, 143 aa, Zea mays
  misc_feature: Ceres CLONE 1459389-F
  misc_feature (39)..(143): Pfam Name: Auxin_BP Pfam Description: Auxin binding protein
MVRRRPATGAAPRPHLAAVGRGLLLASVLAAAASSLPVAESSCPRDNSLVRDISRMQQRNYGREGFSHITVTGALAHGTKDAEVWLQTFGPGQRTPIHRHSCEEVFLVLKEKGTLLLGSSSLKYPGQPQEVPVFSKYHIFDSL

SEQ ID NO: 49078 - DNA, 727 bp, Zea mays
  misc_feature: Ceres CLONE 1459390-F
  misc_feature: Encodes the peptide sequence at SEQ ID NO. 49079
  misc_feature (434)..(434): n is a, c, t, g, unknown, or other
aagctggagctccccgcggtggcggccgctctagaactagtggatcccccgggctgcaggaattcgcacgagaccattacctagaacatcctaatcgaaaaattgctctccaaccaaacctcgtctcgtcttctctccgctaccaccaccactgctcgttttacagaaaccggaaggaaccaaacgcctttccgccccgggccgccgctacccaagcccagcaaccaccactcgttgtcgtcgactactaggcggcaagcaggcgtcctgttttttttttttggtcctcgtcgtcgtccggactccggacaggacaggacatgggcgcggaggcggcggagcgcgacagaatcaggggcccgtggagccccgaagaggacgaggcgctgcggcggctggtggagcgacacggcgcgcgcaactggacggcgatncggcgcggcgtcccgggccggtcgggcaagtcgtgccgcctgcggtggtgcaaccagctgtcgccaagggttggcgcgccgccccttcacggccaacgaggaagggggcattgcccgggccccaggcccgctttgggaaacgggtggggcgccattgggggccttgcttccccggccgaaaccaaaaaccccgttaagaaacccctgggaaatgttccccttcaaaccaaaatttcgggcccccccccccccgggtcccggtttcgggggttttcccgttaaaaaaccccccc

SEQ ID NO: 49079 - protein, 131 aa, Zea mays
  misc_feature: Ceres CLONE 1459390-F
  misc_feature (12)..(58): Pfam Name: Myb_DNA-binding Pfam Description: Myb-like DNA-binding domain
  misc_feature (38)..(38): Xaa is any aa, unknown, or other
MGAEAAERDRIRGPWSPEEDEALRRLVERHGARNWTAXRRGVPGRSGKSCRLRWCNQLSPRVGAPPLHGQRGRGHCPGPRPALGNGWGAIGGLASPAETKNPVKKPLGNVPLQTKISGPPPPGSRFRGFSR

SEQ ID NO: 49080 - DNA, 657 bp, Zea mays
  misc_feature: Ceres CLONE 1459391-F
  misc_feature: Translation starting site: 226
  misc_feature: SWISSPROT Homolog: EC 6.3.2.19 Ubiquitin--protein ligase
  misc_feature (552)..(552): n is a, c, t, g, unknown, or other
ctccccgcggtggcggccgctctagaactagtggatcccccgggctgcaggaattcgcacgagaccattacctagaacatcctaatcgaaaagggccttggtatattccttctcctccctgctcggtttagcacgcccgcttccagcacgcatcctcccctcctcccgtctcaagggatagcagggtgcagcggctcgaagctggaggaagcggacgggttcgccatggggtccgagggatcctcgggtccagttgtcgttcccagaaactttaggctgctagaagaactagaacgtggtgagaagggcattggtgatggaactgtgagctatgggatggacgatgctgatgacatatttatgcggtcctggacaggaactatcattggtccctcccaacactgttcacgagggacgaatctatcagttaaagctgttttgtgatacagattatccagataaaccaccgactgtccgattccagactcggatcaatatgacatgtgtgaaccaagaaactggattgggtgacccaagtctatttcctatgcntggaaaggtggaaagggaacatacgatggaagacattctgaccagctaaaaaagggaaagtccactccacaaaatcgcaggctggaccaaccccatgaaggcaag

SEQ ID NO: 49081 - DNA, 738 bp, Zea mays
  misc_feature: Ceres CLONE 1459404-F
  misc_feature (1)..(1): n is a, c, t, g, unknown, or other
  misc_feature (422)..(422): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (436)..(436): n is a, c, t, g, unknown, or other
  misc_feature (476)..(476): n is a, c, t, g, unknown, or other
  misc_feature (507)..(507): n is a, c, t, g, unknown, or other
  misc_feature (536)..(536): n is a, c, t, g, unknown, or other
  misc_feature (537)..(537): n is a, c, t, g, unknown, or other
  misc_feature (708)..(708): n is a, c, t, g, unknown, or other
  misc_feature (723)..(723): n is a, c, t, g, unknown, or other
  misc_feature (724)..(724): n is a, c, t, g, unknown, or other
naaagctggagctccccgcggtggcggccgctctagaactagtggatcccccgggctgcaggaattcgcacgagaccattacctagaacatcctaatcgaaaaacgattccttccgttccatctccaccggctaaactgccctcgcctccgatcgaacagacgttcctcctccgtcgccgccgcggccgtttgatcctccttgcgagtccgaacctccccacgacggcacgcggccggatccagatcgggagtactccccactcgccgcgcttctccttcgcatcacaagcggccccggccccagacccctagccggatcggatctcgcgcggcgccgtgccggagatgatgtcgtcgtcgtcggacgcggcagcggcgctgactcgagcccgggggggggggggaaaagaacccccccccnaaaannnnnaaaanagaaggggccaaccccaaccggggaccgccccggcaaaancggggccccccggggggggagcaaccaaccngcccccaagggggggcccgcccccccccnncaagggccaaaaaaggaagcggccaagggcccgggacaaagccccggccgggaaaaccggggggggcgcaaaaccggggcccggcccccgggccggccccgaaaaccccggcaaaaaaacacggggaacggccccccaaaggcaaaaaccggggccccccccccccccggnccggggaccgggggnnccccccgaaaaaaa

SEQ ID NO: 49082 - DNA, 695 bp, Zea mays
  misc_feature: Ceres CLONE 1459408-F
  misc_feature: Encodes the peptide sequence at SEQ ID NO. 49083
aaagctggagctccccgcggtggcggccgctctagaactagtggatcccccgggctgcaggaattcgcacgagaccattacctagaacatcctaatcgaaaacatgtggctccgaggtcaccaacatgcactcgcaggctcagcagcaagccagcaggaaggcaaggcggtgctggtcaccggagcttcaccggcggttcgttgccgctttgcacgaactcggtggccctcaagtggctactccgaaacagatcagggaggtgatgcaagtggacgggcttacaaacgatgaagtgaaaagccatctccagaagtaccggttgcacaacagaagatcctcccccggcgcggcggctccggtgagccagtcgatcatgctggtggatggcgtctgggctcctcaggagcaaagcagctcgcagtccgggtctcggcagggcccgcttcagttctccaggccaggtgtggccgtcaatggcggcaacgacgacagcagcagcagcagcgacgaagacgacgacaagtcggaaggctacagcctgaaatgcgtgtgaggctgaggcaggctgcgtttgcggaagatcggatgagagtgtagagagatagcgttgtcgcggcttgatcgagcatgcatcggtggattcttgagaccgagagagtggttgtagtgcaggcaggcatgtatacagggagat

SEQ ID NO: 49083 - protein, 142 aa, Zea mays
  misc_feature: Ceres CLONE 1459408-F
  misc_feature (14)..(65): Pfam Name: Myb_DNA-binding Pfam Description: Myb-like DNA-binding domain
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MHSQAQQQASRKARRCWSPELHRRFVAALHELGGPQVATPKQIREVMQVDGLTNDEVKSHLQKYRLHNRRSSPGAAAPVSQSIMLVDGVWAPQEQSSSQSGSRQGPLQFSRPGVAVNGGNDDSSSSSDEDDDKSEGYSLKCV

SEQ ID NO: 49084 - DNA, 779 bp, Zea mays
  misc_feature: Ceres CLONE 1459410-F
  misc_feature: Encodes the peptide sequence at SEQ ID NO. 49085
  misc_feature (325)..(325): n is a, c, t, g, unknown, or other
  misc_feature (379)..(379): n is a, c, t, g, unknown, or other
  misc_feature (380)..(380): n is a, c, t, g, unknown, or other
  misc_feature (400)..(400): n is a, c, t, g, unknown, or other
  misc_feature (401)..(401): n is a, c, t, g, unknown, or other
  misc_feature (437)..(437): n is a, c, t, g, unknown, or other
  misc_feature (445)..(445): n is a, c, t, g, unknown, or other
aagctggagctccccgcggtggcggccgctctagaactagtggatcccccgggctgcaggaattcgcacgagaccattacctagaacatcctaatcgaaaacttttttttcccttcggggatggtattcgtcgtcttggcttcatcctctcgcccgccgtctcgactgtagcaagcggggctgctgtccgccgcattcaggagccatgcgtgaggggatgagggagagggacagaggcgggagcccggatgcgtcaggccctccgcccttccgcggcccggcgtacaagacgaagctgtgccgctttgaagggggcagggggcgnctgcccccgccccaaactgcggtttcgcccacggcgaggctgagctccgaaggnncgccccctcgcgcctctttnncagcctcgcccacgaccctgggagaaggggattacnggagatcntgagtttaagactcagggcctgaaaagaagacactcccccccatgggaaggaattccccttgaaagaaaaattaaggcggtcctttcatttcatggaaaaaaaaccaatttttgaaaaaaggggaaatccagcctttcagaatcccccttttgggaaaaagggagaaaaaaactttttaaaggctcttggagggggaaaaaaccaattccccccaaaagggttccaaaacccctgtaccccaaaaccggggaaaaaaataaaggggtctttacccggggtgaaaaaaaaggggcttgaaaatcactgaaaaaaaatgtctttgaaaaggaaaac

SEQ ID NO: 49085 - protein, 80 aa, Zea mays
  misc_feature: Ceres CLONE 1459410-F
  misc_feature (59)..(59): Xaa is any aa, unknown, or other
  misc_feature (65)..(65): Xaa is any aa, unknown, or other
  misc_feature (66)..(66): Xaa is any aa, unknown, or other
  misc_feature (78)..(78): Xaa is any aa, unknown, or other
MREGMRERDRGGSPDASGPPPFRGPAYKTKLCRFEGGRGRLPPPQTAVSPTARLSSEGXPPRASXXASPTTLGEGDYXRS

SEQ ID NO: 49086 - DNA, 780 bp, Zea mays
  misc_feature: Ceres CLONE 1459416-F
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (341)..(341): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
ggagctccccgcggtggcggccgctctccaactagtggatcccccgggctgcaggaattcgcacgagaccattacctagaacatcctaatcgaaaactacgcgcagtcgccacgggagctcgttcctctccggcggcagcaccctccactataacccaacccgcaagaaaaaacccgcagcagagaagaggagtcgccgcgaccgagagctccagagcacgcccccgccacagcctccgacgatggatccaaagagacagaggtgaccagatgttcccgttaggacgacacgcctgagtccagtggnnnnnnnnnnnnnnnnncgnnnnnnnnnnnnagtnagnnnnnnnnnnnnnnnnnannnnnnnnnnnntnnnnnnnnnnnnnnnagnnnnnnnnnnnnnnnnnnnnnnntgnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnctagnnnnnnnnnnnnnnnnnnnnnnncnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnncnnnnnnnnnnnnngnnnnnnnnnnnnnnnnnnggg

SEQ ID NO: 49087 - DNA, 673 bp, Zea mays
  misc_feature: Ceres CLONE 1459421-F
  misc_feature: Encodes the peptide sequence at SEQ ID NO. 49088
  misc_feature (318)..(318): n is a, c, t, g, unknown, or other
  misc_feature (536)..(536): n is a, c, t, g, unknown, or other
ggagctccccgcggtggcggccgctctagaactagtggatcccccgggctgcaggaattcgcacgagaccattacctagaacatcctaatcgaaaactggccctctccttggcttttcctctcgctctcctcctctctcgcatcccaccgcatcacaaccacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactganagcgaccggcggcggggatggcgagggagaggcgggagataaagaggatagagagcgcggcagcgaggcaggtcacgttctccaagcgccgccgcggcctcttcaagaaagcccaggagctctccgtgctgtgcgatgccgacgtcgcgctcatcgtcttctcctcacgggggagctctcccagttcgccagctccagtatgaatgagataattgacnagtacaacacgcattctaaaaacttggggaaaacagaaccgccttccctggacttggacttaaagccaaccaaaattgcaaatttgaatgagcaattgggggaagcaacctttcattcccgcaaatgaaagggaaaa

SEQ ID NO: 49088 - protein, 61 aa, Zea mays
  misc_feature: Ceres CLONE 1459421-F
  misc_feature (9)..(59): Pfam Name: SRF-TF Pfam Description: SRF-type transcription factor (DNA-binding and dimerisation domain)
  misc_feature: The sequence is a functional homolog of SEQ ID NO 360 in the 10/666,642 US patent application
  misc_feature: The sequence is a functional homolog of SEQ ID NO 216 in the 10/225,066 US patent application
  misc_feature: The sequence is a functional homolog of SEQ ID NO 2454 in the 10/374,780 US patent application
  misc_feature: The sequence is a functional homolog of SEQ ID NO 118 in the 11/375,241 US patent application
  misc_feature: The sequence is a functional homolog of SEQ ID NO 2234 in the 10/374,780 US patent application
  misc_feature: The sequence is a functional homolog of SEQ ID NO 2238 in the 10/374,780 US patent application
  misc_feature: The sequence is a functional homolog of SEQ ID NO 656 in the 10/225,066 US patent application
  misc_feature: The sequence is a functional homolog of SEQ ID NO 215 in the 11/479,226 US patent application
  misc_feature: The sequence is a functional homolog of SEQ ID NO 470 in the 11/435,388 US patent application
MARERREIKRIESAAARQVTFSKRRRGLFKKAQELSVLCDADVALIVFSSRGSSPSSPAPV

SEQ ID NO: 49089 - DNA, 556 bp, Zea mays
  misc_feature: Ceres CLONE 1459426-F
  misc_feature: Encodes the peptide sequence at SEQ ID NO. 49090
  misc_feature (346)..(346): n is a, c, t, g, unknown, or other
aaagctggagctccccgcggtggcggccgctctagaactagtggatcccccgggctgcaggaattcgcacgagaccattacttagaacatcctaatcaaaaaattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcggggacgacaacgaacaatggtgggcggaaggcccccgggttgcatgggcaagagcagcacactcgttcccctgcatctccgaacgcctcttgggnaaaaaaaggggttaaagggagaaagggggggggggaaccccccgggttaaattccccccccccccctttaggggggggggggggaaaaaaaagggggggggtttaaaaaaaaaaaaaatttttttttttttaaaaaaaaccccccctcttttttttttttttagaaaaaaaaaaaacccccttataaaaaaaaaaaacccccccgtgggg

SEQ ID NO: 49090 - protein, 61 aa, Zea mays
  misc_feature: Ceres CLONE 1459426-F
MELIKSRATVCALLLALLLLSHYDGGDDNEQWWAEGPRVAWARAAHSFPCISERLLGKKRG

SEQ ID NO: 49091 - DNA, 708 bp, Zea mays
  misc_feature: Ceres CLONE 1459427-F
  misc_feature: Encodes the peptide sequence at SEQ ID NO. 49092
ggagctccccgcggtggcggccgctctagaactagtggatcccccgggctgcaggaattcgcacgagaccattacctagaacatcctaatcgaaaatggagagcgtgttggcgctttgagcattgtatgtagaagtgccgatgtagctgttagggttgaaagtcaactcaaacttgtcatcaggcctatgtattcaaaccctcctcttcatggtgcctctatcgtggctaccatactcagggacagcgagatgttcaacgaatggactctggaactgaaggccatggctgataggatcattaacatgaggcaacaactatttgatgctctgaaatccagagaacccctggagattggagccatatcattaggcaaattgggatgtttactttcactgggctgaatagcgacaagtggcattcatgaggcagggataccactttatatgacatctgatggggagatcaccatgcccggtttgaacatgaagactgggccccatcttgaaaagcaaaacccgctgggtttctccactgaatggaggaaagttcccccctttccgggaaaaaacccggatccccccatttaaggtttaaaaaccccccccgggggattttgggggtgaccaatggaatttggccccaaaaaaaaaattttttttacactcgccgggggggatttttttcggggggaaaaaaaaacccctaa

SEQ ID NO: 49092 - protein, 71 aa, Zea mays
  misc_feature: Ceres CLONE 1459427-F
  misc_feature: SWISSPROT Homolog: EC 2.6.1.1 Aspartate transaminase
MYSNPPLHGASIVATILRDSEMFNEWTLELKAMADRIINMRQQLFDALKSREPLEIGAISLGKLGCLLSLG

SEQ ID NO: 49093 - DNA, 753 bp, Zea mays
  misc_feature: Ceres CLONE 1459428-F
  misc_feature: Encodes the peptide sequence at SEQ ID NO. 49094
  misc_feature (337)..(337): n is a, c, t, g, unknown, or other
  misc_feature (346)..(346): n is a, c, t, g, unknown, or other
aaagctggagctccccgcggtggcggccgctctagaactagtggatcccccgggctgcaggaattcgcacgagaccattacctagaacatcctaatcgaaaaacaaattctcagctattgagatttgaacatttcatccaaaaaatgttctttcagattattcagggggttttcaccggcgttgaggcattagctctattggcattcgctggtataacgcttggcggctcggccgtgggactagctttaagcacgccgctttttattctattcagtccgattctcgtgccagcaactatagccaccacttttgtaactacgggtttcacaacctccngggggctangaatcgtggctctccgcatcttctggaaagctctttcagcgtcttaggaagagggggaaaggacccccaaaatttcggggatggggcccgggggctccagaatccaactcacgggcttgggggaaaaacggagaagcttttcgaaataggaaaaaacctttgggggaatttaatggaaaatttgagggggttcctaaaaaaaaaccaaaaattccccggggttttaaaggaaaatggaattacccggggagaaaaaaaggggttcaaaaaccctcctccaaaagaaaaccggggggaacaaaataaaaaaaatgccccccccggtgttttttttttaaaaatatagggggtcccccgggatcccccaaaaaaaaaaaaaaaaaattttttttcccccccggccccgc

SEQ ID NO: 49094 - protein, 82 aa, Zea mays
  misc_feature: Ceres CLONE 1459428-F
  misc_feature (1)..(82): Pfam Name: Oleosin Pfam Description: Oleosin
  misc_feature (65)..(65): Xaa is any aa, unknown, or other
  misc_feature (68)..(68): Xaa is any aa, unknown, or other
MFFQIIQGVFTGVEALALLAFAGITLGGSAVGLALSTPLFILFSPILVPATIATTFVTTGFTTSXGLXIVALRIFWKALSAS

SEQ ID NO: 49095 - DNA, 696 bp, Zea mays
  misc_feature: Ceres CLONE 1459431-F
  misc_feature (691)..(691): n is a, c, t, g, unknown, or other
aaagctggagctccccgcggtggcggccgctctagaactagtggatcccccgggctgcaggaattcgcacgagaccattacctagaacatcctaatcgaaaaaacaacctactcacctcaacaagcgtgaaattgaggacaattccaggaaagtaagggcattgttttcaaaaccaaaaagtgatgacatctctcaaaccggttcatcataagtcaggcagttgtgcagagcaatagatgctagcgattttgccactgcgatgcaactccaggtaaattggaccctgatattttaggcactcttgacaacacgtgactggcacgaaagcaaatcctggctcgcggcattgagaccgatgatcaagacaaggcataatttcagaatgtacaccttgtgacctttttctgcagccggtactgtacaaacctttttctgctgcttgccagagatgatacctgtatcagttcaaagagtatgcctgcacagggatcatatcaggctgattggtactcggctcttgattctgccaacccgctttggcacttcagagctgttacacattatgctactcgcgtttgtgcatccacatcagctatacggtgacctgcgtctgggctgttcgttatgaatgttacttgtaacacgacacttactctgctaagctcgtggatcacctggtgtcagtcttgnactta

SEQ ID NO: 49096 - DNA, 692 bp, Zea mays
  misc_feature: Ceres CLONE 1459433-F
  misc_feature: Encodes the peptide sequence at SEQ ID NO. 49097
aaagctggagctccccgcggtggcggccgctctagaactagtggatcccccgggctgcaggaattcgcacgagaccattacctagaacatcctaatctaaaagaatcgtccgccgtcttctgaaaaggtcactcaaaggcccgccgtctgcagcgctggcgaccgcagagccggcgaccaccgtgcgtcctgtctcctcgtctgctccgtccatctccacagcttgtgcaggtcgctgaaacacttggatcaaaacagagcttgagatgaagcactacaccctgaaggatcagggtgtttatgctcttccatctactgcaaaatccaattggaaggatatctactgcatctacttccaaaacagcatgatgcaatacttgacgacaaaggaaaaggtccaaccgttacaattgaatctccacccaaaaggttcaaaatggacctctacgtattaaagaaaggtcggacacaagatcttccaacaactgaagattttctcagattatcagcagcttttaggttgtagaatgtcctttatataattatatataactgctcaacttttatgaagacatttcatgtaaatataacaaggtagcttgaaatgttgcaacaaacatactaccttctgccagtgctcatttaactctattttactttatacaaatctgctatgctcgaaaaaaaaaaaa

SEQ ID NO: 49097 - protein, 62 aa, Zea mays; identical to SEQ ID NO: 8764
  misc_feature: Ceres CLONE 1459433-F

SEQ ID NO: 49098 - DNA, 772 bp, Zea mays
  misc_feature: Ceres CLONE 1459434-F
  misc_feature: Encodes the peptide sequence at SEQ ID NO. 49099
  misc_feature (371)..(371): n is a, c, t, g, unknown, or other
ccccgcggtggcggccgctctagaactagtggatcccccgggctgcaggaattcgcacgagaccattacctagaacatcctaattgaaaaccatccccaccttgccactgaaacccctgacccaaatcctcaatgtggtcacaggccatcaaggcgctgtgctcgaacaagtcggcggaggtgcgcctgccgctgggtctactccctctcgccgacatggaggaggtcggctacaaccggtccctggccttcgtgtgcctgcgctagcgtggggcgctcacctacaccttccaccaggtcgggagccaggtcttgtacaccgccaagggcaccgccttcgtcgagtatcgcctgatgctgggtatgacccnaatcaagacgaatgaatttctttttttttttcacccacctttaaatgttttgttgacgggaacaaccccctcccgaatccccttcaaaaccccccccccggccttgggaagaatgaaaaccctccaggggtccctaactggggtttaagaaataattggacatagtaatattaatttgggactaaaggtgtgttttttcccaaaaacattttagaggctaggggcccctttcccggggttttttctttcttatttgtgaaaaacaacccccccgaacagagactttcatatcccccctcccgggaatgttgataattaaaaaaagtgaaggcccttatatttcctcatggtaaaataaacttgccccccacccggtgaaagaggctggtgtctccctcttt

SEQ ID NO: 49099 - protein, 44 aa, Zea mays
  misc_feature: Ceres CLONE 1459434-F
MWSQAIKALCSNKSAEVRLPLGLLPLADMEEVGYNRSLAFVCLR

SEQ ID NO: 49100 - DNA, 680 bp, Zea mays
  misc_feature: Ceres CLONE 1459437-F
  misc_feature: Encodes the peptide sequence at SEQ ID NO. 49101
  misc_feature (522)..(522): n is a, c, t, g, unknown, or other
aagctggagctccccgcggtggcggccgctctagaactagtggatcccccgggctgcaggaattcgcacgagaccattacctagaacatcctaatcgaaaaaggaacaaaggaaagcaatcacagccagacgatccgagcagagaaggggagctacctgctacgactagctagataccacgcgcgcgatggcgcccaccaggatccgcgtggccttgctgagcttggcgctggtgggactgctcatctgccacctcgccaccaccgcctccgcggggaagaacagaatccgcatcctcgacagcgtcgacgactcggccggggacaacaacagctccgacgcctcggccggggacaacagcaccgactccgagtcggaaggccgcgtcgtctattccgacatgaagctggctgatgagacgggatctgcgccggctccggcaccggcgcgggggccgacgaccagttgaagcgaggagggtggcaaaactgagggcccgctactatcttttgctatactaangatagggcaaggtttaatttctcaaataattctggccaacaaaaagtaggatgggttttttacccgaaatggaaatgtatgacccccggggggaccaaaaccaaaagcaggggttgggggaactgggggttccgagcgccccccccctccgaattaaa

SEQ ID NO: 49101 - protein, 93 aa, Zea mays
  misc_feature: Ceres CLONE 1459437-F
MAPTRIRVALLSLALVGLLICHLATTASAGKNRIRILDSVDDSAGDNNSSDASAGDNSTDSESEGRVVYSDMKLADETGSAPAPAPARGPTTS

SEQ ID NO: 49102 - DNA, 756 bp, Zea mays
  misc_feature: Ceres CLONE 1459463-F
  misc_feature: Encodes the peptide sequence at SEQ ID NO. 49103
  misc_feature (406)..(406): n is a, c, t, g, unknown, or other
aaagctggagctccccgcggtggcggccgctctagaactagtggatcccccgggctgcaggaattcgcacgagaccattacctagaacatcctaatcgaaaacgtgaacgagggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtcatcggcgggccccacggtgacgccggcctcactggccgcaagatcatcatcgacacgtacgggcggctggggagcccacgggcggtggcgccttctccggcaaggaccccaccnagggtgaaccgccccccctccctacgtggcccagccaggcccccaaaaaacatcggggccaaggggccctcccccgccgttgccctcgggcagggtgtctaacccattggggtggcccgaaaccccctgtcccggtttcttaaattcgaaggggcccgggacaatccccgaaaaggggaatccctcaaaattgggaaggaaaacttccccctttcggcccgggggaaaaacccctcccccccccccccaaaaaagggggggaaaaaggtttttaaaaaaagccccctcaagggactttttttggggggaaagaacccccattttcttgggggggggggggcgccccctcc

SEQ ID NO: 49103 - protein, 128 aa, Zea mays
  misc_feature: Ceres CLONE 1459463-F
  misc_feature (1)..(56): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MVPVRVHTVLISTQHDETVTNDEIAADLKEHVIKPVIPEKYLDEKTIFHLNPSGRFVIGGPHGDAGLTGRKIIIDTYGRLGSPRAVAPSPARTPPRVNRPPSLRGPARPPKNIGAKGPSPAVALGQGV

SEQ ID NO: 49104 - DNA, 688 bp, Zea mays
  misc_feature: Ceres CLONE 1459465-F
  misc_feature: Encodes the peptide sequence at SEQ ID NO. 49105
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaaacaccgcccaggcgccccgcctctgcatccgcccgccctaggccgcagaagggagcattcgccgccccaccctccgtttcccgtcgcctcgcccccgcgctccgtcagccgcccctctccgatggagcgtgtaaaaaactcgatcagcattggaggaactggcaatggcatcataaccaagaagaaaattaggcttccaaatttgagatgaagacgatgactcaaacttgggccatggaggtgttcaccaacagccaaatttgattcaggacaagactctggtaaggaaaagattgatatcaagcaacaacactcgtgtcaaggcagagtctggcacctgttaacgatgatgagtttagtgcaacctcatatcatgctttgtatctgtaactggtagaaacaaagttgttgcaacatcatccattgccgatgatttgtcagaggttgacatgccatcaaaacgcaggaggctgttgaatcaagacacaagactatctagagcagaataccttgatgacaacaactcatgtgttactggtatatcagcagaggggcaacttcttgtggataagaaaaaacttcagcn

SEQ ID NO: 49105 - protein, 45 aa, Zea mays
  misc_feature: Ceres CLONE 1459465-F
MPSKRRRLLNQDTRLSRAEYLDDNNSCVTGISAEGQLLVDKKKLQ

SEQ ID NO: 49106 - DNA, 694 bp, Zea mays
  misc_feature: Ceres CLONE 1459466-F
  misc_feature: Translation starting site: 403
ctccccgcggtggcggccgctctagaactagtggatcccccgggctgcaggaattcgcacgagaccatacctagaacatcctaatcgaaaaaccttcctctttaaattgcccctcctattcccccgtcccgaagctagaggctctctggcgccgacggccgacccacacgcgcgtccagcgatttcgccggggggagatcttgccattccgtggagcaccatccgcggtagcctagccgcgactggggatcggggcttgcgggccgtggagccacccagaaggtagccgggaaaagcttgatccggccggggacggggccttcggaggttcgtccctcgatcgggtgtcgtctgcgaaagccgggtcgaacaaatcgtcgcgactggaggcggcgcggggtcatgggggcgtgggtctcggtcctgctcgggatggacggagccgcggcggccgggcctgctgctgtgggcctgggcgacctgccggagctctgcgccgcccagtgctgctccggctcgacccgccggagatctgcaggctcgcgcaggtcaaccacccgttccgcggccccgcgggggctgacttcgtgtgggaagccaagctgccggagaactacaatatcgaataccgtccacctcgaggggggggcccgggaacccattcccccctataggggagtcgtatttccccccc

SEQ ID NO: 49107 - DNA, 692 bp, Zea mays
  misc_feature: Ceres CLONE 1459482-F
  misc_feature: Encodes the peptide sequence at SEQ ID NO. 49108
  misc_feature (397)..(397): n is a, c, t, g, unknown, or other
  misc_feature (438)..(438): n is a, c, t, g, unknown, or other
aaagctggagctccccgcggtggcggccgctctagaactagtggatcccccgggctgcaggaattcgcacgagaccattacctagaacatcctaatcgaaaaccccgattctgacacctcctcttcccaacaactcccttcctatagatctcgccgccccctttctccccatttccgcaccacgcccagtcgcccacgcagccggcccaagcccaaaaacctttctccatcctctactctcatccccacgatggccgccgccgccaccacgccgcactccctcctcctccagcgcgccgcgatcccggccgcgccgtcgagggcgtccgccgccgcctctcccgtccgcctcccggtccgcgccgccaggatctcgtgcgcggcggtggcggccccntccccggccgcagccgccgcggcggacgaggtggagcgcgncgtctacaacttcgcggcgggtcccgcgacgctccctctctccgtgctcaagcgggcgcaggcggagctggtggactaccacggctccgggatgagcatcatggagatgagccactgcggggaaggagttcaacgccgccatcaagaaggccgagtccaacctgcgcgcgctcctcgcggtgcccgacacccacgcccgtgttctttcttcagggggggggccaccacgcagttcgcccgccgtcccgctcaac

SEQ ID NO: 49108 - protein, 147 aa, Zea mays
  misc_feature: Ceres CLONE 1459482-F
  misc_feature: SWISSPROT Homolog: EC 2.6.1.52 Phosphoserine transaminase
  misc_feature (63)..(63): Xaa is any aa, unknown, or other
MAAAATTPHSLLLQRAAIPAAPSRASAAASPVRLPVRAARISCAAVAAPSPAAAAAADEVERXVYNFAAGPATLPLSVLKRAQAELVDYHGSGMSIMEMSHCGEGVQRRHQEGRVQPARAPRGARHPRPCSFFRGGATTQFARRPAQ

SEQ ID NO: 49109 - DNA, 700 bp, Zea mays
  misc_feature: Ceres CLONE 1459568-F
  misc_feature: Encodes the peptide sequence at SEQ ID NO. 49110
agctccccgcggtggcggccgctctagaactagtggatcccccgggctgcaggaattcgcacgagaccattacctagaacatcctaatcgaaaactcttccgtgggggggggcgcatactataaccctagatccgctcccgtccttgtctctgaagagctcaccacccgattgggcagtccgcaatacctacatggaggcgcttctgcaaagggccgctgctgcgttcatggctcgcgtctacgtgtgcaatctggatattcgcctcgctacgctcgagcatccaggacaagttcacggggctgggggttctctaaaccgcgcgcgctagcctgcaagcgactacaatttgctatggttgtcttccatgacacctccgagacgaaggaggccattcgtgaattgctctccaagaaagggtggagggttgacctgtcaaccgaatcaaatagggacggagaccgacatctcgaacgcaccggcggctctgataagaacagcgaccagtgcggtgaaaggggtcactttcctgtagacaatgccctacggcatggttccaggatcatgattagatgaatacgccgtaacctaagcccgaggaaccgcacccgaatgcctaagtaccgcacacagagctgtaacagtagccctatatagcgcatgatgctgaggtaatgcataacgagcttcggcctagcgga

SEQ ID NO: 49110 - protein, 73 aa, Zea mays
  misc_feature: Ceres CLONE 1459568-F
MVVFHDTSETKEAIRELLSKKGWRVDLSTESNRDGDRHLERTGGSDKNSDQCGERGHFPVDNALRHGSRIMIR

SEQ ID NO: 49111 - DNA, 710 bp, Zea mays
  misc_feature: Ceres CLONE 1459577-F
  misc_feature: Encodes the peptide sequence at SEQ ID NO. 49112
aagctggagctccccgcggtggcggccgctctagaactagtggatcccccgggctgcaggaattcgcacgagaccattacctagaacatcctaatcgaaaaccaaccaaccgaagaaaaccatcgacacagcgctacactgcaatggcggccaccgacacccgcctctccgtcgcccaccagacgcgctttgcactccgcctcgcctccgccatctcctcgccctccaacgccgacggtgctgccggcaacgcagccttctccccgctctccctccacgtcgcgctcagcctcatcgccgccggcgcgggcggtgccacccgcgatcagctggccgctacactcggtgccgtagggcaaggcgaggcggagagcctccacgcgctcgcccagcaggtggtgcagctggtgctcgccgacgcgtcggtcgagggcggtccgcgcgtcgcgttcgctaacggcgtcttcgtcgacacgtcgacgccgctcaagtcgtccttcaaggaggtcgccgttgggaagtacaaggccgagacccactccgttgacttccaaactaaggctggtgaagttgcatgtcaagtgaacacatgggtagagaaaatcacatcaggtctcatcaaagagatcctcgcggatggatctgtcgacagcaccagtagacttgttcttggcaatgcgctttatttcaaaggagcctggacagaggaa

SEQ ID NO: 49112 - protein, 189 aa, Zea mays
  misc_feature: Ceres CLONE 1459577-F
  misc_feature (3)..(189): Pfam Name: Serpin Pfam Description: Serpin (serine protease inhibitor)
MAATDTRLSVAHQTRFALRLASAISSPSNADGAAGNAAFSPLSLHVALSLIAAGAGGATRDQLAATLGAVGQGEAESLHALAQQVVQLVLADASVEGGPRVAFANGVFVDTSTPLKSSFKEVAVGKYKAETHSVDFQTKAGEVACQVNTWVEKITSGLIKEILADGSVDSTSRLVLGNALYFKGAWTEE

SEQ ID NO: 49113 - DNA, 724 bp, Zea mays
  misc_feature: Ceres CLONE 1459582-F
  misc_feature: Encodes the peptide sequence at SEQ ID NO. 49114
aagctggagctccccgcggtggcggccgctctagaactagtggatcccccgggctgcaggaattcgcacgagaccattacctagaacatcctaatcgaaaaccatccaaccgaagaaaaccatcgacacagcgctgcgctgcaatggcggacaccgacacccgcctctctgtcgcacaccagacgcgctttgcactccgcctcgcctccgccatctcctcgacctccaacgccaagggtgctgccggcaacgtagccttctctccgctgtccctctacgtcgcggtcagcgtcatcgcccatcggcgggggcggtgccacctgcgatcagctggtacttacacttcgttgccctacggcaaagcaaggcgaaaaccctccccgactcgcccaacaggaggtcaaggtgggcctccccaaactttggccaaagatggccccccctcccggttgctaaaggggccttcggaaaaaaatgaacccgctcaagtcttcttttaggggccccccctgggaaaaaaagggcaaaccccccctcctttaatacaaaaaaaggcggggaaactcccccccccgggaaacccggggcggaaaaaaaaaagggggccccaaaaaaacccccccgggggaaacccccacaaacccaaaaaaaatttttgggaaaggcttttttaaaaagggggggtggaaaaaattttctcccccaaacaaaaaggggggtgttc

SEQ ID NO: 49114 - protein, 118 aa, Zea mays
  misc_feature: Ceres CLONE 1459582-F
MADTDTRLSVAHQTRFALRLASAISSTSNAKGAAGNVAFSPLSLYVAVSVIAHRRGRCHLRSAGTYTSLPYGKARRKPSPTRPTGGQGGPPQTLAKDGPPSRLLKGPSEKNEPAQVFF

SEQ ID NO: 49115 - DNA, 703 bp, Zea mays
  misc_feature: Ceres CLONE 1459637-F
  misc_feature: Encodes the peptide sequence at SEQ ID NO. 49116
  misc_feature (566)..(566): n is a, c, t, g, unknown, or other
aaagctggagctccccgcggtggcggccgctctagaactagtggatcccccgggctgcaggaattcgcacgagaccattacctagaacatcctaatcgaaaattatcctattccctcgtgtcatggcgcttctcctgcgcctcgctgctccgtcggtgccgccccggcggagctccggcctcagagcattgccgcgcgtcgtccttccggaggtcgtttccaaacaatcatttcttcgtttactagttgacagcactgcaagtatgccctgtcctattaagtgttctgcggctcggtgtgccccatcattgactgaacacaacgattctaggaataatggcatccatgcatctagtgtatatggacatgatctcatgaagtccatgtctgatctccaggtatgatggaagttgtattttcctcctttagcaaagcatgtcttctcagtagttgtatcatatatggtctaccacccagttgtatagcagaaccatgggcatccttgcaaagacaaggcaagtacaaggaagccataaattatcattccatggtgctaaacatctccnaggtgaccggagaggatgcgggtgtcactgaagcatacggagcaatagcggattgctacaccgagcttggtgagctcgagaaggcaggcaagttctacgacaagtacatagcaagatgggagacgaatgagaaaacg

SEQ ID NO: 49116 - protein, 101 aa, Zea mays
  misc_feature: Ceres CLONE 1459637-F
  misc_feature (56)..(56): Xaa is any aa, unknown, or other
MMEVVFSSFSKACLLSSCIIYGLPPSCIAEPWASLQRQGKYKEAINYHSMVLNISXVTGEDAGVTEAYGAIADCYTELGELEKAGKFYDKYIARWETNEKT

SEQ ID NO: 49117 - DNA, 690 bp, Zea mays
  misc_feature: Ceres CLONE 1459638-F
  misc_feature: Encodes the peptide sequence at SEQ ID NO. 49118
aagctggagctccccgcggtggcggccgctctagaactagtggatcccccgggctgcaggaattcgcacgagaccattacctagaacatcctaatcgaaaactgcccctcctccgccgtttcgcctctctccactttccccgtccttcgccgtcgcggccgcgtcctagtctagtctgatggccagccgctgggtccgacccgaggtgtacccgctgttcgcggcgatgggagttgccgttggcatctgcgggtttcagctcttccggaacatcaccggcaacccggaagtcagggtaaacaaggcagggagggcagccggcgtgcttgagaaccatgaggaggggaggcgttacgccatgcatggcctcagaagctttgtgcacgacaagacccccgagatcatgccagctatcaacaagttctttactgaccccaagtgaagcaaagcagctttggttggccgctgatgacgatggttctgctactagttgcccttggggattgtgtaccctttttatggcaattcgatatgtgaatgagttcgacggtccctgtttgttcctcgtactcacctgtcatgtggatttgatgcacttaagtgataaaactgtcagccaacgttcattacaagtggatttttgcaaactggttatgtaaaggataagtaattgtagtttacaagtgtttt

SEQ ID NO: 49118 - protein, 87 aa, Zea mays; identical to SEQ ID NO: 40041
  misc_feature: Ceres CLONE 1459638-F
  misc_feature (2)..(88): Pfam Name: B12D Pfam Description: B12D protein

SEQ ID NO: 49119 - DNA, 622 bp, Zea mays
  misc_feature: Ceres CLONE 1459652-F
  misc_feature: Encodes the peptide sequence at SEQ ID NO. 49120
ctccaccgcggtggcggccgctctagaactagtggatcccccgggctgcaggaattcgcacgagaccattacctagaacatcctaatcgaaaaaacaaggccacatcagcagagagcccagcaactgaaaaaaccaaccatcgcgcgggcacggttgcggttgctacctcccgatcccgtcctcccgcaagccaagctctctctctccccctccccttcagcacgatcggagtccaagtccatcccatccagacccactcgacagtcgacccgatggcgccgtccatctccgtcggcgccgcggcgccgtcccgtgcagcgggcgcgagcacgaagaagagcgcggacgaggtggagctcctgcggcggcggaacgcgaagctggagcgggaagttgccgcccctccccctgggaacttgggggcccggcccggtccccccccccccccaaaaaagcgcgaaaaaaaaaacccccacaaaaaaagccccgtccctttttttttccctttaccctccccccccgcccccacctccccacacaacaaagagagagggggggcggcccccccccttcccccctttttttgtcccccccccccccccccctttacgttcttccccg

SEQ ID NO: 49120 - protein, 116 aa, Zea mays
  misc_feature: Ceres CLONE 1459652-F
MAPSISVGAAAPSRAAGASTKKSADEVELLRRRNAKLEREVAAPPPGNLGARPGPPPPPKKREKKNPHKKSPVPFFFPLPSPPAPTSPHNKERGGAAPPLPPFFCPPPPPPFTFFP

SEQ ID NO: 49121 - DNA, 662 bp, Zea mays
  misc_feature: Ceres CLONE 1459654-F
  misc_feature: Encodes the peptide sequence at SEQ ID NO. 49122
aaagctggagctccccgcggtggcggccgctctagaactagtggatcccccgggctgcaggaattcgcacgagaccattacctagaacatcctaatcgaaaaaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggggcactacgccagctcttccaccctgagcagctcatcagtgggaaggaggatgcagccaacaactttgcccgtggtcactacaccattggcaaggagattgttgacctgtgccttgatcgcatcaggaaagctgggcgacactgcactggtctcccagggcttctccggcttcaaccttgttggggggaggaacgggctccggc

SEQ ID NO: 49122 - protein, 148 aa, Zea mays
  misc_feature: Ceres CLONE 1459654-F
  misc_feature (49)..(143): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGALRQLFHPEQLISGKEDAANNFARGHYTIGKEIVDLCLDRIRKAGRHCTGLPGLLRLQPCWGEERAP

SEQ ID NO: 49123 - DNA, 675 bp, Zea mays
  misc_feature: Ceres CLONE 1459655-F
  misc_feature: Translation starting site: 183
  misc_feature (442)..(442): n is a, c, t, g, unknown, or other
  misc_feature (443)..(443): n is a, c, t, g, unknown, or other
  misc_feature (462)..(462): n is a, c, t, g, unknown, or other
  misc_feature (469)..(469): n is a, c, t, g, unknown, or other
  misc_feature (488)..(488): n is a, c, t, g, unknown, or other
  misc_feature (604)..(604): n is a, c, t, g, unknown, or other
aagctggagctccccgcggtggcggccgctctagaactagtggatcccccgggctgcaggaattcgcacgagaccattacctagaacatcctaatcgaaaaacacgcacctcacctctcacaattccaagcccaccagtccaccactctccgcttcgcttcttgtcgctgcggcgcgcggccatggtctccctccgcttccctaccgctgcaatcccccgcctcccgccatcccaggcccccaacggcgtcgccatcgccgccacggtcgccgctgcagccgcggccgcagctgcagtagcggccagcttgaccctcacgggcaagtccaccggccggccagtcccgcaccctgcccctctctgggcctccctctccctggccgacgcggcggcccccagctccgtcgaaccccggacggcgcgacattcccacccgagccnngcgtgggcgccgcctactncgcatangcctccggaagaacagcgntctcgggctcaagtccatcgacgtctacgcattcggcgtgtatgcggatgacaacgatttgagcagcagctgaaggaaaaatactcgaattcctcggcctcgaactgaggggaacngtgacctgatcaacgatgccctaaaacgggaatacccattaacggcaggtttcaaaattgtttatgggagg

SEQ ID NO: 49124 - DNA, 649 bp, Zea mays
  misc_feature: Ceres CLONE 1459658-F
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
gggctgcaggaattcgcacgagaccattacctagaacatcctaatcgaaaaagaggacacaggaccgaccacagtaccggacacgccctgagggggaggaatgaagccataaggaggaccgagcaggcctatgccctagggtagtcccgtccggtcccctgcggtgcaagtccgggccgcgggcgggatgactgcctggcgtcggtagggggcgacagctatctatatctgtcgatggcctactggtgggacctcctcatgctgacagtgctgcgggcctggcatcatcggtcggcgtccgcttcggggttcggcagacggtgaggnnnaaagggaaagtacaacgattttgtgctgcccccccattatttttggtctgaactgcgctgacctgcactaccaccgcgccgactgaccccgacgctgctcgctgctttgtgcacggtttttccaagctgccgatggtactgagcccggaccgagttcgaagaacttggccttgtgagggaaatgtggagccgctacatggatccggacccctttgctggacatcccggttccggccccaccctccaaacgtgtggacaagaggtttcgttccctccaaattctcttcctgcttttagtcccacctccgcgcacttctcgt

SEQ ID NO: 49125 - DNA, 727 bp, Zea mays
  misc_feature: Ceres CLONE 1459670-F
  misc_feature: Encodes the peptide sequence at SEQ ID NO. 49126
  misc_feature (570)..(570): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacatcctaatcgaaaatccgccggctcccccactcagaaaacccagccgccgccgcatcggcctcccaggtaagcagtagcgtccaccccagccgccgccatgaagcgcaacccccgcgtcacgagctcccgccggaagtgccgcaaggcgcacttcacggccccgtcctccgtccgccgcgtgctcatgtccgcggcgctatcgacggagctccgccacaagtacaatgtgcgttccatcccgatccgcaaggacgacgaggtgcaggtcgtgcgcggcacctacaatggccgtgagggcaaagtggtgcaagtgtaccgccgtcgctgggtcatccacgttgagcggatcaccccgcgaaaaagtgaacggctcccacgggaaggtgggcatccacccttccaaggtcatggttaccaaagctgaagcttgacaaggaccgcaaggggctcctccaaccgcaagggcccggggcccgcgccnccaaaaaggctaaaggcaaattttactggcaaaaaaaatccccaccccttgttggggtgggccccccgncccatgtggggggttccccccaggaaaataaaaataggccctttccgggggaaaccttatggggtggcccccccccccctctaaacac

SEQ ID NO: 49126 - protein, 108 aa, Zea mays
  misc_feature: Ceres CLONE 1459670-F
  misc_feature (51)..(82): Pfam Name: KOW Pfam Description: KOW motif
MKRNPRVTSSRRKCRKAHFTAPSSVRRVLMSAALSTELRHKYNVRSIPIRKDDEVQVVRGTYNGREGKVVQVYRRRWVIHVERITPRKSERLPREGGHPPFQGHGYQS

SEQ ID NO: 49127 - DNA, 698 bp, Zea mays
  misc_feature: Ceres CLONE 1459672-F
  misc_feature: Encodes the peptide sequence at SEQ ID NO. 49128
  misc_feature (559)..(559): n is a, c, t, g, unknown, or other
aaactggagctccccgcggtggcggccgctctagaactagtggatcccccgggctgcaggaattcgcacgagaccattacctagaacatcctaatcgaaaaactctcccccatcccagtcagtcctctccatgacctccgccgcggccgcctccccggaccccatggtggcgtaatttctgccgccaattcccttgcctccagacttcaaatccccaccaccatcgaacctccccaacccggcaaatcctaaatccaatataggctaaccctagccgcccatccgcccgccatgaaggcgtcgatcaagttccgcgacgacgaccgaccgctgctgcgcgccaaggtgccgattggcgtgctggggctgcccttcctctcgggcctcgcggcggggggagacgccaaggatctccgctttgaactcttcaccgccttctcctctggcccggcgctccgcctctcataccgccccaacgaacccctccagcctttcgccctctccgtccgcaccgggctggggacgctgggggtccctgcccgggccccatcgcccttcncgccgaatcaaactcacctcctccacccgcccgacttctcgctcctctttcagcccggaatcggggatttcccgtcgccagcttccgtcgctccccgccgacacggcgcccaaattcaatctcgccccggtagcgataa

SEQ ID NO: 49128 - protein, 135 aa, Zea mays
  misc_feature: Ceres CLONE 1459672-F
  misc_feature (90)..(90): Xaa is any aa, unknown, or other
MKASIKFRDDDRPLLRAKVPIGVLGLPFLSGLAAGGDAKDLRFELFTAFSSGPALRLSYRPNEPLQPFALSVRTGLGTLGVPARAPSPFXPNQTHLLHPPDFSLLFQPGIGDFPSPASVAPRRHGAQIQSRPGSD

SEQ ID NO: 49129 - DNA, 752 bp, Zea mays
  misc_feature: Ceres CLONE 1459680-F
  misc_feature: Encodes the peptide sequence at SEQ ID NO. 49130
  misc_feature (319)..(319): n is a, c, t, g, unknown, or other
  misc_feature (367)..(367): n is a, c, t, g, unknown, or other
  misc_feature (402)..(402): n is a, c, t, g, unknown, or other
aagctggagctccccgcggtggcggccgctctagaactagtggatcccccgggctgcaggaattcgcacgagaccattacctagaacatcctaatcgaaaaaaatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggcctgcatacngcagccgaacgggctagtaccgcgggaggaaaggtgggggccagaacngaaagtgcggacgtggaaggcaacggcaaggtgcngaacctcggcggtttctccgtccccaaataaaacccgcaagtccccaaaaagggggcgggggccgccggcagggcccatttcggaaggggggggggggcccacccgccaggggggtcccggggccaaaagaaaaccccccccccctggcccctgaaaaaagggggcccgggaaaaccggccaaaaactttttttaaaaccctctttttttaaaaacccgggtaaaattccccaccccgtttaaattttgcccggggggggcccaaaaaaggggggggccccccccgggggaaaacccccgggagaaaaatcccggggggccccccccccgaaaaaaggggggggaaataa

SEQ ID NO: 49130 - protein, 115 aa, Zea mays
  misc_feature: Ceres CLONE 1459680-F
  misc_feature (37)..(37): Xaa is any aa, unknown, or other
  misc_feature (53)..(53): Xaa is any aa, unknown, or other
  misc_feature (65)..(65): Xaa is any aa, unknown, or other
MARALGACVLLAVLLGALAPAAAARAHDDQGSGACIXQPNGLVPREERWGPEXKVRTWKATARCXTSAVSPSPNKTRKSPKRGRGPPAGPISEGGGGPTRQGGPGAKRKPPPPGP

SEQ ID NO: 49131 - DNA, 673 bp, Zea mays
  misc_feature: Ceres CLONE 1459681-F
  misc_feature: Translation starting site: 110
  misc_feature: SWISSPROT Homolog: EC 1.2.3.4 Oxalate oxidase
  misc_feature (588)..(588): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaaaccaacaatggcctcgcgccacctgctcctcctcctgctcgccgcgctgctcccggcggcggccacggcggacccggacgcggtgcaggactactgcgtgccggacacgggcggcgggcgcgggcgggccgtggatctagcgctgctcccgtcctacccgtgcaggagccccgccaacctgacggcggcggacttcgccttcgcgggcgtgcgcgccgcgggcaacttctccgcggacacggggttccgcgggggtgtccgtgacccccgcgcagttcccggcgctgcacaccctcggcgtgtccttcgcgcgcgccgacctgtccgcggcgggcggggtcaacccgccgcactaccacccgcgcgccaccgagacggcgctggtcctggccggccgcgtctacgcgggattcgtcgactcgggcggccgcgtcttcgccaagtgctcgagaaaggggaaggcattgtgttcccgcgcgccatggntgcacttcagatgaacgtcngcgacgagccggcccacgtgtacggcaccttcacagcgagaacccgggatcgggcgcatcccggg

SEQ ID NO: 49132 - DNA, 703 bp, Zea mays
  misc_feature: Ceres CLONE 1459689-F
  misc_feature: Encodes the peptide sequence at SEQ ID NO. 49133
  misc_feature (466)..(466): n is a, c, t, g, unknown, or other
  misc_feature (467)..(467): n is a, c, t, g, unknown, or other
aagctggagctccccgcggtggcggccgctctagaactagtggatcccccgggctgcaggaattcgcacgagaccattacctagaacatcctaatcgaaaaagaccgacaacgcctaggcaagcagcaagcgtacacgtaaacgtacacctacctcggcgagcaaaaggcaaaacgctgatcggagcaaccaacgaagcccgcagccatgccgacggccacggccacggcggctcctcgccacgccgcgctcttcctgctgctgctgctcggcctccacgccacgttcgccgccgccgcgcgcgcgggcgtcgccgtggacgccgagctcacgtccaccaagccgtccccggtcccgaagaagcccagcgtgaagccgcccggccccggcgccgcgagcccgaccttcccgggcttcggcatccccgggatgggcgggttcggcatccccgggatgggcgccggcnngtggggcgcggctacggcgggcccgccggcggtacgcccgcggcgcgtgttggcgcccacgtgacgtgctccagaagggccctgctacagaagaagggtcccggcccaaaaatggttttcctctaaaaagggccccggaaagaaaacgggggggggggggggggggaaatttccccccctaaggaaggggaatggcccccccccttttttaccccccccccccttcaagggtaaaa

SEQ ID NO: 49133 - protein, 107 aa, Zea mays
  misc_feature: Ceres CLONE 1459689-F
  misc_feature (87)..(87): Xaa is any aa, unknown, or other
MPTATATAAPRHAALFLLLLLGLHATFAAAARAGVAVDAELTSTKPSPVPKKPSVKPPGPGAASPTFPGFGIPGMGGFGIPGMGAGXWGAATAGPPAVRPRRVLAPT

SEQ ID NO: 49134 - DNA, 643 bp, Zea mays
  misc_feature: Ceres CLONE 1459691-F
  misc_feature: Encodes the peptide sequence at SEQ ID NO. 49135
  misc_feature (433)..(433): n is a, c, t, g, unknown, or other
  misc_feature (573)..(573): n is a, c, t, g, unknown, or other
aagctggagctccccgcggtggcggccgctctagaactagtggatcccccgggctgcaggaattcgcacgagaccattacctagaacatcctaatcgaaaaacaataggcattcaatcattcaagcgaagcagccaccactctctccactgtgactccgtgacctgcctgccctgctgcacaagcacagcacacacaccccgcacaccgcaccagctcagcgcagctcaccaagacaatcaatcatggctcacccgcgcagtgtcgctgccgctgcccccctcctcctgctgctcgccgccgccgccgccgccgcagcggggctcgtgtccgccgcgtcgccggcagccagcgacttcgtccgcaagtcgtgccgcacgacgcagtacccgtcggtgtgcgagcagagcctggcgtcgtacggcgggtcgccngccgccgcgaagccccgcggagctggcgcgcgccgcgctgtcggtgagcgcggaccgcgcgcgcgccgcgtcggcgtacgtgggccgcctgtgcggcgccagcaaacggcaaagccgaaagaggggtcgggatcggcgtncgggtccgcgtcggcaagttccgtgcaagactgcctgaacaatctggcggaaggcgggggccacctcccc

SEQ ID NO: 49135 - protein, 133 aa, Zea mays
  misc_feature: Ceres CLONE 1459691-F
  misc_feature (110)..(110): Xaa is any aa, unknown, or other
MAHPRSVAAAAPLLLLLAAAAAAAAGLVSAASPAASDFVRKSCRTTQYPSVCEQSLASYGGSPAAAKPRGAGARRAVGERGPRARRVGVRGPPVRRQQTAKPKEGSGSAXGSASASSVQDCLNNLAEGGGHLP

SEQ ID NO: 49136 - DNA, 709 bp, Zea mays
  misc_feature: Ceres CLONE 1459692-F
  misc_feature: Encodes the peptide sequence at SEQ ID NO. 49137
  misc_feature (402)..(402): n is a, c, t, g, unknown, or other
  misc_feature (495)..(495): n is a, c, t, g, unknown, or other
aagctggagctccccgcggtggcggccgctctagaactagtggatcccccgggctgcaggaattcgcacgagaccattacctagaacatcctaatcgaaaagccatggacgacgaggagcacgaggtttacggccaggagatccctgaggacggcgatatggacggcgctgacgttgatatggccgccgccggggacgacgcggcgaagcttcaggagcttgacgagatgaagcgcaagctgaaggagatggaggaggaggccgccgccctccgcgatatgcaggccaaggtcgccaaggagatgcaaggaggtgaccctagtatatctacagctgaggcgaaggagcaggtggatgcccggtctgtgtatgttggaaatgttgattatgcttgcaccccanaagaagtgcagcagcatttccaagcttgtggaactgtcaacagggtgacaatcttgactgacaagtttgggcagctaaaaggttttgcttatngtgaatttctgggaacagaagctgtccagggaagctcttgaacttgaatggaatccggaattgcctgggccaaccgattaagggtgcgcccaaaagaactatgtccctgggatgaaaacaccgcccccccgcgggttaaccccccccggggctccccttaaaaacaagggagacccggttttccccccaacgggtgggggagggcccccattcc

SEQ ID NO: 49137 - protein, 143 aa, Zea mays
  misc_feature: Ceres CLONE 1459692-F
  misc_feature (100)..(100): Xaa is any aa, unknown, or other
  misc_feature (131)..(131): Xaa is any aa, unknown, or other
MDDEEHEVYGQEIPEDGDMDGADVDMAAAGDDAAKLQELDEMKRKLKEMEEEAAALRDMQAKVAKEMQGGDPSISTAEAKEQVDARSVYVGNVDYACTPXEVQQHFQACGTVNRVTILTDKFGQLKGFAYXEFLGTEAVQGSS

SEQ ID NO: 49138 - DNA, 713 bp, Zea mays
  misc_feature: Ceres CLONE 1459696-F
  misc_feature: Encodes the peptide sequence at SEQ ID NO. 49139
aagctggagctccccgcggtggcggccgctctagaactagtggatcccccgggctgcaggaattcgcacgagaccattacctagaacatcctaatcgaaaaatccggttcatctatttttagagttgccacgcgcgagacttcccgcctccctatccctctctagtctctacccccatctgtagtgcggtctgcggccaagcagagcccggggaaacgatcgagacgatatgtgcgggggagcgatccttgccgaactcatcccagcacgggtgcaccggccgctgaccgccgccacgctctgggcggcggccctgagtgggaccactaccgtcggcaagtggaaggccgatgcagccgccgctaccgacgacgacgacgacgaagagttcgaggccgagttccagcttttcgacgacgatgacgagtgcgaggccgagttccagcttctcgacgaccaccaaccatctcccgcagcttcgcctgaggccagcggctgcaagcggaagcctgcccttgctcctcctgctggtgcccccgcttccacggatccggcgaccccgtgctccaggaagtacaggggcgtccggtaccgccggtcaggcaggtgggccgcggagatcagggacccgcggcaggggcgccgcgcctggctcggcacgtaccgcaccgccgaagaggccgccctggcgtacgaccgcgagggccgccggg

SEQ ID NO: 49139 - protein, 161 aa, Zea mays
  misc_feature: Ceres CLONE 1459696-F
  misc_feature (114)..(160): Pfam Name: AP2 Pfam Description: AP2 domain
MCGGAILAELIPARVHRPLTAATLWAAALSGTTTVGKWKADAAAATDDDDDEEFEAEFQLFDDDDECEAEFQLLDDHQPSPAASPEASGCKRKPALAPPAGAPASTDPATPCSRKYRGVRYRRSGRWAAEIRDPRQGRRAWLGTYRTAEEAALAYDREGRR

SEQ ID NO: 49140 - DNA, 739 bp, Zea mays
  misc_feature: Ceres CLONE 1459699-F
  misc_feature: Pfam Name: zf-C2H2 Pfam Description: Zinc finger, C2H2 type
cacagctcgagctccccgcggtggcggccgctctagaactagtggatcccccgggctgcaggaattcgcacgagaccattacctagaacatcctaatcgaaaagattcctttgttctctatatctcttcctgcaaactcctccgccccccccaaaaaaaacaatctcttgcaaaatattcccctctctctccatctctcatagcttgtctctactaccgctcacacccaccgagagaaagctgaaacaaaaacaaatatcttgcccagattactataccatcgctactagctcccaccatcgtttcttaatcataccccgacgctgaggtgatcgcgctgtcgcccaagacgcttatggcgaccaacaggttcgtgtgcgaggtgtgcaacaaggggttccagcgcgagcagaacctgtagctgcaccggcgcgggcacaacctgccgtggaagctgaagcagaaaaaccgctacaggcgcagcggcggcccgtgtacctgtgcccgggagccaacgtgcgtgcaccacgaccccgggccgcgcccttgggcgacctgaacggggataaaaaagcacttttgcccccagcaccgtggagaaaaaatggaaattgcgaccagggcttcaagcgcttacgcccgggcaatcgaaccggaaaggcccaccccaagatatttgggtgaccccgtgagatacccaatgccaaccggccgaaaactcttcttccaaaaaaggaaa

SEQ ID NO: 49141 - DNA, 712 bp, Zea mays
  misc_feature: Ceres CLONE 1459701-F
  misc_feature: Encodes the peptide sequence at SEQ ID NO. 49142
aaagctggagctccccgtcggtggcggccgctctagaactagtggatcccccgggctgcaggaattcgcacgagaccattacctagaacatcctaatcgaaaaataaaatgattaggcttgtcacaatgggtttaggaggtgaaggctatctaaatttcatgggaaatgagtttgggcatcctgaatggatagattttccaagaggtcctcaaagtcttccaaatggctccgtcattcctgggaataacaatagctttgataaatgccgccgtagatttgaccttggagatgcagattatcttagatatcgtggtatgcaagagtttgaccaggcaatgcagcaccttgagggaaaatatgaattcatgacatctgatgactcatatgtatcacggaaccatgacgaggataatgtgatggtctttaacagaagagatttggtcttcatgttcaacttccactggagcaatagctattttgactatcgcgttggttgtttcaagcctgggaagtacaagatcgttttagattctgacgatggccttttcggtggatttagtcggcttgatcatgatgcccagtacttcactgctgactgggcgcatgacaacagggcctgttctttctcggtctatgcaccccacagaacaacccacgtatatccacctgcaggggcaaaaaaccaatagggcacaccaccggttgttggga

SEQ ID NO: 49142 - protein, 193 aa, Zea mays
  misc_feature: Ceres CLONE 1459701-F
  misc_feature (93)..(188): Pfam Name: Alpha-amylase_C Pfam Description: Alpha amylase, C-terminal all-beta domain
  misc_feature: SWISSPROT Homolog: EC 2.4.1.18 1,4-alpha-glucan branching enzyme
MIRLVTMGLGGEGYLNFMGNEFGHPEWIDFPRGPQSLPNGSVIPGNNNSFDKCRRRFDLGDADYLRYRGMQEFDQAMQHLEGKYEFMTSDDSYVSRNHDEDNVMVFNRRDLVFMFNFHWSNSYFDYRVGCFKPGKYKIVLDSDDGLFGGFSRLDHDAQYFTADWAHDNRACSFSVYAPHRTTHVYPPAGAKNQ

SEQ ID NO: 49143 - DNA, 712 bp, Zea mays
  misc_feature: Ceres CLONE 1459702-F
  misc_feature: Encodes the peptide sequence at SEQ ID NO. 49144
  misc_feature (712)..(712): n is a, c, t, g, unknown, or other
aagctggagctccccgcggtggcggccgctctagaactagtggatcccccgggctgcaggaattcgcacgagaccattacctagaacatcctaatcgaaaaaccacggccagaaccctagtcacttccccgccgcccactccatggaggacgacgccatctcgacgctcatggacatcgacgactcgccgctcagcgctgcgggggccgggttcctcgacgaggaggacggggaaggcgagatgttcttcgccccgcaccgcgcggcccgcggcggcgctggcgatgcccgcgggcccctccccttttccgggttcttcaacagcttcgacggcgccgatttcgacgacgacgacctcgcctgagggaactgccgcccggttcggtaacggatgttgttcgtggatcgcgaatcgtgttatgtcgataccgtgatggggtctcttaattagcgcatcgattcagactcgtttgggcaatctgaagatgtttagggatcaacattacctttgtggcctatggttcgtggatgcacatgcacagggatcaatataagtacctttgtgccccatggttcgtggatcactgtgcatgtgttcttccgcgtctttgttgttattttggctccatctgtatgatctaatgaaccttcctttgttatcattctgtctctgttactcgatgacttgttataggttgttaaatgcctatan

SEQ ID NO: 49144 - protein, 73 aa, Zea mays; identical to SEQ ID NO: 11368
  misc_feature: Ceres CLONE 1459702-F

SEQ ID NO: 49145 - DNA, 748 bp, Zea mays
  misc_feature: Ceres CLONE 1459704-F
  misc_feature: Encodes the peptide sequence at SEQ ID NO. 49146
  misc_feature (339)..(339): n is a, c, t, g, unknown, or other
tggagctccccgcggtggcggccgctctagaactagtggatcccccgggctgcaggaattcgcacgagaccattacctagaacatcctaatcgaaaaacaaggagaaacaaattcttctattttagctctagctcgctcgccatcccctgcccggctgctgcccccaacggaacgacggccagaggaagctagcagagtcgagagagagagagagagagagagagagagagagagagagagagcatggctggcaggagtttcctgattcggtcccccaaggaggaggagtccgacgccgccgtcagagaagctgtactgctgggagcaaagaacgccgncatagctggtactgtggttgcagttcccccacgtggtggctgccgtgtccttccttgggctaaggcgaatctcaactacactgcacaagcactcattatatctgcagcccggaatgctggcttcttcatcactgctgacaaaaccattcttcggaacgcccgaaaaaaccccctcgggaaccttgacaagccaccctgatccaaaaatggaccttaaacctaaaaaggttctcggggttcccccggggggtgaaaagggggtctttttgccccctatggcggggcccccttttttcttccggggaaaaagaaatttttggggggggtggggcttttcaaacccaaaggtgtttccgagaaaggacttgtcaaacaaggggggccccaccatttttgttccccgctttcc

SEQ ID NO: 49146 - protein, 97 aa, Zea mays
  misc_feature: Ceres CLONE 1459704-F
  misc_feature (11)..(89): Pfam Name: ENOD93 Pfam Description: Early nodulin 93 ENOD93 protein
  misc_feature (32)..(32): Xaa is any aa, unknown, or other
MAGRSFLIRSPKEEESDAAVREAVLLGAKNAXIAGTVVAVPPRGGCRVLPWAKANLNYTAQALIISAARNAGFFITADKTILRNARKNPLGNLDKPP

SEQ ID NO: 49147 - DNA, 725 bp, Zea mays
  misc_feature: Ceres CLONE 1459707-F
  misc_feature: Encodes the peptide sequence at SEQ ID NO. 49148
aaagctgaagctcaccgcggtggcggccgctctagaactagtggatcccccgggctgcaggaattcgcacgagaccattacctagaacatcctaatcgaaaaagacgcaacgcaatacacccctcctgcccacaccacctcgctgtaccagaagacccgcacacacacgccacttgtattaccatggcgccccgggtggcggacaagtcgccgctaccgccggccaccggcctggggctgggcgttggcggaggagtcgggggcgtgggcatgggcccgcactacagaggcgtgaggaagcgtccatggggacgctacgccgccgagatccgcgaccctgccaagaaaagccgtgtgtggctcggcacgtacgacacggccgaggaggccgccaaggcgtacgattccgccgcccgcgagttccgaggcgccaaggccaagacgaacttcccgttcccctcccagtgctccgtcgcctccgttgctgccggtagcgctagtagcaacagcaccgtggattcgagcggtggcggtagcggctgtggcatccaggcgcctatgcaggccatgcccgctcctccggctctcgatctcgacctctttcatcggggcggccgccgtgaacgcagtctccaccggcatgcgggtttccgttcaagggctatcctgtcgcctgcccgacagcacagcagtactttttcctacgagcaagcaagcggccgccg

SEQ ID NO: 49148 - protein, 180 aa, Zea mays
  misc_feature: Ceres CLONE 1459707-F
  misc_feature (32)..(83): Pfam Name: AP2 Pfam Description: AP2 domain
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASVAAGSASSNSTVDSSGGGSGCGIQAPMQAMPAPPALDLDLFHRGGRRERSLHRHAGFRSRAILSPARQHSSTFSYEQASGR

SEQ ID NO: 49149 - DNA, 682 bp, Zea mays
  misc_feature: Ceres CLONE 1459709-F
  misc_feature: Encodes the peptide sequence at SEQ ID NO. 49150
  misc_feature (567)..(567): n is a, c, t, g, unknown, or other
aaagctggagctccccgcggtggcggccgctctagaactagtggatcccccgggctgcaggaattcgcacgagaccattacctagaacatcctaatcgaaaaaactggggcccatcgataaatgtagcgcgtgcgccgaggctgcagatgctcggctaccttgggatcggtatcccggagctgcagctcggctcggcgttgtttcgttccatgtgcgctgttagactggcggcggacctccggtctgtgaggacgctggcgctggagatgtcagatccgcagctgaagtttgtggccgacttcctgatgtgtttcccctgcttggagacgctccatgtcacgtctcacatggttattcctcagggcatgagaatattgaattatgagatgggtgatgatcgcatagagtgcctcagccatcacctcaagaaagtagtgctgaaaggttacttggggcgaaagcatgagatgcagcttgccatttcccttgttcgtcatgctagggttctacaggttttcaaattcttgtgttgaaatgagtgcacaggcaatgggtgacaacccagnaagacagttacggtggacagcccggcatctttgctggctcaatttgtttttgagaattccagcaaggcctacatcggggtttcccagcgcgcaaaaaaaaaaaaaaagctttcca

SEQ ID NO: 49150 - protein, 177 aa, Zea mays
  misc_feature: Ceres CLONE 1459709-F
  misc_feature (128)..(177): Pfam Name: FBD Pfam Description: FBD
KAGAPRGGGRSRTSGSPGLQEFARDHYLEHPNRKNWGPSINVARAPRLQMLGYLGIGIPELQLGSALFRSMCAVRLAADLRSVRTLALEMSDPQLKFVADFLMCFPCLETLHVTSHMVIPQGMRILNYEMGDDRIECLSHHLKKVVLKGYLGRKHEMQLAISLVRHARVLQVFKFLC

SEQ ID NO: 49151 - DNA, 725 bp, Zea mays
  misc_feature: Ceres CLONE 1459724-F
  misc_feature: Encodes the peptide sequence at SEQ ID NO. 49152
  misc_feature (725)..(725): n is a, c, t, g, unknown, or other
aaagctggagctccccgcggtggcggccgctctagaactagtggatcccccgggctgcaggaattcgcacgagaccattacctagaacatcctaatcgaaaaatcaggattttccttgcctctgctcgttctcatggccgagcacacctcttcctcaagtgtcgcctgctgtaccagtgtccagctccccacgcccgccgctactcctagcccctctcctccttggatttcgcccagcctccatctctctttccagccatggatgccgcccctccctagcaccctcatctccacgggagctcaccctagctccagcttcaaccatggaagggggcctctcctgcctacagcaggtcagcgccccatctcctcaacatctcggctccctgtcccatctctctctcacgagccactctcctcgttctccatgacgtcgacatggggctcgcccctgcaacctcgcctcgctgggtctcctcagggcgccggggtgttgcttcctatacatcatgcgacttcctagtgcttgctctcgccctaggccatggagcagcagcagccacgacactccttcgtgtcgcgccctcgacgtgttcgatgaaataccgcagcgagctccaactcgatcttcacagcccctgcacgacgtcacaaactccgctcgttgtcgatgtcgtgcttcgtgcatcgcgtgttcgacgaaaatcccaagtccatggacagcn

SEQ ID NO: 49152 - protein, 95 aa, Zea mays
  misc_feature: Ceres CLONE 1459724-F
MGLAPATSPRWVSSGRRGVASYTSCDFLVLALALGHGAAAATTLLRVAPSTCSMKYRSELQLDLHSPCTTSQTPLVVDVVLRASRVRRKSQVHGQ

SEQ ID NO: 49153 - DNA, 701 bp, Zea mays
  misc_feature: Ceres CLONE 1459725-F
  misc_feature: Encodes the peptide sequence at SEQ ID NO. 49154
  misc_feature (25)..(25): n is a, c, t, g, unknown, or other
  misc_feature (38)..(38): n is a, c, t, g, unknown, or other
  misc_feature (44)..(44): n is a, c, t, g, unknown, or other
  misc_feature (385)..(385): n is a, c, t, g, unknown, or other
aaagctggagctccaccgcggtggngcggccgctctangaactnagtggatcccccgggctgcaggaattcgcacgagaccattacctagaacatcctaatcgaaaactcttcctctcggttaagtccagcccactccgccgccgccgaccgcgagaggagttctcttcgccgcctcaaggacgagatggacacatcaagccctgcagcacttgtcaatgcaaagattatgaacatgtttgttgggcaaagagtgcgcacagttgttcaagtccaacacaatgatggtggaatgcttgtcgggcagtcccctgatgggcatcaattgagtatcaaaagcgccatggatgtccctgtatcacactttatgggagtttaatggattngcctgaaacaaccagaaccatccccgctgaagtttgcaccgaattttgtcctgactttgaacccgaaacttttaatcaatgggccaactggccaagaaaaaattccaacccatggtccctgtaaagggccttcttccaagggaggaaccttcgggccaacgaaagctttggttgaaaaacccaaagggtttccccccctcaaaggggtttttttccccccccccccgaactctttttgtggaaaaaatagggaaccccccttttggcccgggggttttttcttcgcccgcccctataaaaacctcccaaaggcggg

SEQ ID NO: 49154 - protein, 63 aa, Zea mays
  misc_feature: Ceres CLONE 1459725-F
MDTSSPAALVNAKIMNMFVGQRVRTVVQVQHNDGGMLVGQSPDGHQLSIKSAMDVPVSHFMGV

SEQ ID NO: 49155 - DNA, 776 bp, Zea mays
  misc_feature: Ceres CLONE 1459727-F
  misc_feature: Encodes the peptide sequence at SEQ ID NO. 49156
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (427)..(427): n is a, c, t, g, unknown, or other
ttttccccttttttgttgttctctttttttttnnnntttgtnnnnntcatactggagctccccgcggtggcggccgctctagaactagtggatcccccgggctgcaggaattcgcacgagaccattacctagaacatcctaatcgaaaaacttcactctcctggtttattcctccgtgccgatctcgtcttctccggcgggaccatgacgccgtcctcctcccgattcgacgatccggcggcggtgaggcgccccccgcagcatgaacggaagccgccgtatatgttgcttctcccgctcgtctacgcccccgtcctccccctcatcaggatcgggctgcggcacaatcccgtagtgagggaccgtctcttctacggcgtcctcgccggcgcattcgcccacggcgcctacctcatatcggaactgnatgatgtggagagcaaatgatgggcatccctccaacgatgaggggataagttttcaggtagcaaaatttgattccatcgggattccagattgttggatgagagctgacatggcaattcagactaactagtggggtatgtacccatatgttttctttggccccgctattatgctcggcaaaaggattggaagggttgagctatataaggaaatttcaaattgaaaaaatattttccaccgatggcaaaaaaaaaaaaacaaaaaagcttatccgatcccgttccaaacctccaggggggggggccgggaaacccgaatttcgcccttttaattgaattcgcaatttctcc

SEQ ID NO: 49156 - protein, 80 aa, Zea mays
  misc_feature: Ceres CLONE 1459727-F
  misc_feature (75)..(75): Xaa is any aa, unknown, or other
MTPSSSRFDDPAAVRRPPQHERKPPYMLLLPLVYAPVLPLIRIGLRHNPVVRDRLFYGVLAGAFAHGAYLISELXDVESK

SEQ ID NO: 49157 - DNA, 714 bp, Zea mays
  misc_feature: Ceres CLONE 1459734-F
  misc_feature: Encodes the peptide sequence at SEQ ID NO. 49158
  misc_feature (458)..(458): n is a, c, t, g, unknown, or other
ctggagctccccgcggtggcggccgctctagaactagtggatcccccgggctgcaggaattcgcacgagaccattacctagaacatcctaatcgaaaactcagcgcaacgattacggtaacgccgtcgccgccctacggctcagatcttcgtcgtcatcttctccggcaacgagcacccaaggatggtggtccttcaaccagatcggttcctgagcgagctgacgagcatgtacgagcggagcacgaagaagggctccgtctgggtcaccatgaagcgatcaactctcaagggcaaggcacagttgcggaagatggagaataaggggcaggaggtagagcacaggtgcctcgtccgcgcctccaatggcaagaagaacatctccacctcggtttctctaaaggagtacacaaagttccaagcttcatacgcaacagttcttaaggcccatatgcatgnctctgaagaaaagggagaggaaagacaagaagaaggctgcagatgctgagaaggcaattgagaccgcacccaagaagcagaagaaagcatcttcaaagaaatcttcggggtccaagtcataaggcgctcgcagaaatcagtgtcttctcccttctgttgttaccgcaccgccagactaattagagtgtcgtgaattttatctggtttttatccgaatgtgtgtctgggagatcaaagcctgtgaatcacttttata

SEQ ID NO: 49158 - protein, 107 aa, Zea mays
  misc_feature: Ceres CLONE 1459734-F
  misc_feature (4)..(93): Pfam Name: SRP14 Pfam Description: Signal recognition particle 14kD protein
  misc_feature (92)..(92): Xaa is any aa, unknown, or other
MVVLQPDRFLSELTSMYERSTKKGSVWVTMKRSTLKGKAQLRKMENKGQEVEHRCLVRASNGKKNISTSVSLKEYTKFQASYATVLKAHMHXSEEKGEERQEEGCRC

SEQ ID NO: 49159 - DNA, 792 bp, Zea mays
  misc_feature: Ceres CLONE 1459883-F
  misc_feature: Encodes the peptide sequence at SEQ ID NO. 49160
  misc_feature (376)..(376): n is a, c, t, g, unknown, or other
  misc_feature (460)..(460): n is a, c, t, g, unknown, or other
  misc_feature (461)..(461): n is a, c, t, g, unknown, or other
  misc_feature (550)..(550): n is a, c, t, g, unknown, or other
  misc_feature (564)..(564): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (591)..(591): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (635)..(635): n is a, c, t, g, unknown, or other
  misc_feature (636)..(636): n is a, c, t, g, unknown, or other
  misc_feature (650)..(650): n is a, c, t, g, unknown, or other
  misc_feature (651)..(651): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
tggagctccccgcggtggcggccgctctataactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggncgtgcgcgtgaactatgaatgtatgagtcactcccaagctaaactgtttgtagtactatgctaagctgaggagctgcattcacnntcatcatcttgtggagacgcgagggaagctctttatcggacagcctcacttgtcaccgacgcaatcaggcacccccccaagccgtgganctacgctggggttngggctttggcatgagaacgnnnnnacnacgcggtgtgcannnnnnnnnntctctctacttagaaaaacagnngcacttttatcccnnccgtggtgtccacccgtcctcacactnnnatgagggcgccattgacctgaggcggaaaaataaaaaaaactactactcttcaaaaaataaaaaacagacgcctccaggtnnnnnnnncccatcctctattgggaggctctc

SEQ ID NO: 49160 - protein, 71 aa, Zea mays
  misc_feature: Ceres CLONE 1459883-F
GAPRGGGRSITSGSPGLQEFVSPLIENKWERQRFGLQGGFVTNPLAEPNISSAGKTMVTHEGRKKDKTLQK

SEQ ID NO: 49161 - DNA, 766 bp, Zea mays
  misc_feature: Ceres CLONE 1459897-F
  misc_feature: Encodes the peptide sequence at SEQ ID NO. 49162
  misc_feature (637)..(637): n is a, c, t, g, unknown, or other
ctggagctccccgcggtggcggccgctctagaactagtggatcccccgggctgcaggaattcgtctcacccctaatcgaaaacactctacccgcacagcgcccctcgcccccacaccccaacccaaccatccgctccttgtcgccttccgacgctgagtttgctggtgtcgatttgcgccggcggatgctcgatctggtagctgcatgtgccgacctactcgtcgaatccgttatctaacgtaatggatgggcaaggcacaaagcacaggattttgatggtgtccgactttttctttccaaactttggtggggtggaaagccatatctactacctgtcacaatgtctacttaagcttggccataaggttgttgtcatgacacatgcatatggaaacagatctggagtacgatatgtcacaaatggtttaaaggtctattatgtaccatggaggccattcctgatgcagaatacacttcctacactatccttgacgtttccaattgtaaggacaattattattcgagagaagatttctgtcgtgcatggacatcaagctttttcaacactgtgtcatgaagcattaatgcatgctaggacaatgggatattgatcaggcaatatgtgtctcacatacnagcaaagagaacactgtcttgaggtctgggatatctccagagaaggttttcatggggtcctatgcagttgacaactgcatgtttactccctctcccagcgctttaactgtgatgaaatagttattgttg

SEQ ID NO: 49162 - protein, 122 aa, Zea mays; identical to SEQ ID NO: 47963
  misc_feature: Ceres CLONE 1459897-F
  misc_feature (47)..(122): Pfam Name: PIGA Pfam Description: PIGA (GPI anchor biosynthesis)
  misc_feature: SWISSPROT Homolog: EC 2.4.1.198 Phosphatidylinositol N-acetylglucosaminyltransferase

SEQ ID NO: 49163 - DNA, 751 bp, Zea mays
  misc_feature: Ceres CLONE 1459898-F
  misc_feature: Encodes the peptide sequence at SEQ ID NO. 49164
ccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcacccccaccctaactgtttgagtactatgctaagctgaagagctgcttcacatcatggtgtggaccccgaggaaggcttctttatcggacgcctccctttgtcccaaccaatcaggcccccccccagccgggaaaaacccggggtttgctttggcaaaaaaaaaccccttggtttgccaaagcccatttccaaccaagaaaaacagactttaaaacccagtgtccccccctcccaaaaaatggggggcccctttaaaaaggcggaaaaagccctttaaaaaaaaaaaaaaaaaagagccgggggccccctccccccaaaggggaaaaaaaaccccccccgcgcccgtatttaaa

SEQ ID NO: 49164 - protein, 69 aa, Zea mays; identical to SEQ ID NO: 47176
  misc_feature: Ceres CLONE 1459898-F

SEQ ID NO: 49165 - DNA, 658 bp, Zea mays
  misc_feature: Ceres CLONE 1459899-F
  misc_feature: Encodes the peptide sequence at SEQ ID NO. 49166
  misc_feature (531)..(531): n is a, c, t, g, unknown, or other
  misc_feature (569)..(569): n is a, c, t, g, unknown, or other
aaagctggagctccccgcggtggcggccgctctagaactagtggatcccccgggctgcaggaattcgcacgagaccattacctagaacatcctaatcgaaaaactactctctctcgccccaaaaccagatcgccacgacaagggccgagggccccggaggggcgcgtagcaatggcggcaggctaccgggccgaggacgattacgattacctcttcaaggtggtcctgatcggcgactccggcgtcggcaagtccaacttgctctcacgcttcacgcgcaacgagttcagcctcgagtccaagtccaccatcggcgtcgagttcgccactcgctctctccaggtcgacggcaaggtcgtcaaggcccagatttgggacaccgccggccaggaacgataccgtgcaatcactagtgcgtattaccgaggcgctgttggggcgttgcttgtatatgacgtcactcgccactcaacctttgagaaacgtgagcgttggctgaaggagctgagggacacacagacccgaatatangtgttatgctggttggcacaaatctgatctccgcatcntgtagcagttcaaacgacgaaggaaagcttcgccgaaagggatcgttgacttcatgaaacctctgcccctggatccacaacttggaaag

SEQ ID NO: 49166 - protein, 128 aa, Zea mays
  misc_feature: Ceres CLONE 1459899-F
  misc_feature (16)..(129): Pfam Name: Ras Pfam Description: Ras family
  misc_feature: SWISSPROT Homolog: EC 2.7.11.1 Non-specific serine/threonine protein kinase
  misc_feature (120)..(120): Xaa is any aa, unknown, or other
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFEKRERWLKELRDTQTRIXVLCWLAQI

SEQ ID NO: 49167 - DNA, 663 bp, Zea mays
  misc_feature: Ceres CLONE 1459900-F
  misc_feature: Encodes the peptide sequence at SEQ ID NO. 49168
  misc_feature (541)..(541): n is a, c, t, g, unknown, or other
  misc_feature (568)..(568): n is a, c, t, g, unknown, or other
  misc_feature (573)..(573): n is a, c, t, g, unknown, or other
  misc_feature (584)..(584): n is a, c, t, g, unknown, or other
aaagctggagctccccgcggtggcggccgctctagaactagtggatcccccgggctgcaggaattcgcacgagaccattatctagaacatcctaatcgaaaaacttttcgaagtagcagcccggaactccggatccaccgctaccgccgccgcgtctaaaccctccaccgccgcggtgcgtcagaggcagaggcagagaggcagaggcagaggcagccatggggagccgcctcgggcgccgcgtgatccactttgccaacctcccgctgaaggtcatgctgccccccgcgccgctctcctccgtgcaggagttcgccgtgcggaccgtcccctccgcttccaaggtggacatccggcgctgcctcgagtccatgtacggtttttccgtcgccgaggtccgcacgcttaacatggagggcaagaagctccgccgggggcccctttctctcccgcaagcctgactactagaagggctacgtcacgcttcgcgccccgctcgcggtctcgcgcgacctggtccccatcggggccatcctcgcgnagcgggagccgaaagccagcgcacctnctgcnaggaggaagcngtgagcgccccccaaggtggaagggggagagcaggggaagccactgatgggaggaccagaaggagggtttctccgggct

SEQ ID NO: 49168 - protein, 80 aa, Zea mays
  misc_feature: Ceres CLONE 1459900-F
MGSRLGRRVIHFANLPLKVMLPPAPLSSVQEFAVRTVPSASKVDIRRCLESMYGFSVAEVRTLNMEGKKLRRGPLSLPQA

SEQ ID NO: 49169 - DNA, 750 bp, Zea mays
  misc_feature: Ceres CLONE 1459903-F
  misc_feature: Encodes the peptide sequence at SEQ ID NO. 49170
ggagctccccgcggtggcggccgctctattaactagtggatcccccgggctgcaggaattcgtctcacccctaatcgaaaaactatcctaccaggcaccactcgcatcgtgtgctcagtcagatccccgtcccgcatttcctaaggccagttggcattgaagacgatgactgcttctgcagctgctggtgtgcagatggtggctgcacgcccttgcatttcggcctcgccaggaattcttaccgcacgggtagcagtttctaggactgattgcatgctcagtaccactgctacattccccaaaatcagctgctcctggcctctaaggtttaagcgcaatgatgttgttgtaagagcaatatcggaagagtgtggcccgcaggggcttcccattgatctcagaggtaaaagggcattcattgctggagttgctgatgataatggctatggatgggcaattgcgaaggcacttgctgcggctggtgctgaaattcttgtgggtacatgggtgccggcacttaacatatttgagacaagtctgaggcgtggaaagtttgatgaatcacggaagctgccagatggatctcttatggatattgttaaagtctatccacttgatgctgtctacgattcccctgatgatgttcctgacgatgtcaaatccgaccaaagatatgcacgcgcatcaaactggacagtaaaggaagtggttgatccactgagcatgatttttgcagcattgacatactag

SEQ ID NO: 49170 - protein, 194 aa, Zea mays
  misc_feature: Ceres CLONE 1459903-F
  misc_feature: SWISSPROT Homolog: EC 1.3.1.9 Enoyl-[acyl-carrier-protein] reductase (NADH)
MTASAAAGVQMVAARPCISASPGILTARVAVSRTDCMLSTTATFPKISCSWPLRFKRNDVVVRAISEECGPQGLPIDLRGKRAFIAGVADDNGYGWAIAKALAAAGAEILVGTWVPALNIFETSLRRGKFDESRKLPDGSLMDIVKVYPLDAVYDSPDDVPDDVKSDQRYARASNWTVKEVVDPLSMIFAALTY

SEQ ID NO: 49171 - DNA, 752 bp, Zea mays
  misc_feature: Ceres CLONE 1459904-F
  misc_feature: Encodes the peptide sequence at SEQ ID NO. 49172
  misc_feature (724)..(724): n is a, c, t, g, unknown, or other
  misc_feature (752)..(752): n is a, c, t, g, unknown, or other
ctggagctccccgcggtggcggccgctctagaactagtggatcccccgggctgcaggaattcgtctcacccctaatcgaaaaccagccacgtcttcatcacacacggtcgcggcgcgaagcaatggcgaccacggcgccgctgctctcgccccagcgcgcttgccctacccatctccggcgccgcctctcgcccctacatctcgtattccccctcgacgcgtcagcgaggcggctgcgccttcgccgggcgccgccaccttgttcggccaagttcggcaagttcgacgcctccgacgccccggcggaggccgaggaggcggggggcgcgacggatggtgggctggcgcagcccgtggaggaggacgacagttgcttgccatcggatttggagggcgcgattcggcagtcagggaaggcgagcgcagatttcgtaaactccggaggcatgcgagctatctggtgtcaatattgcaggcagaactgctgatccctcagttggaattcctcaacgaggaaggagcacaggctgaactctgggcgttgtcaaagattttcctggacacacttgtacaagagacaggacagaaagttactgccattttccctgacgctggagcagctgcccttctcaagcatcaatggaaagatgcacaattcaagtgtgccagataaaacctcttgtcatgtggaacccacggcttgttagtggagatgttggagtangctttaatgtacggaatctgcggagaan

SEQ ID NO: 49172 - protein, 121 aa, Zea mays
  misc_feature: Ceres CLONE 1459904-F
MATTAPLLSPQRACPTHLRRRLSPLHLVFPLDASARRLRLRRAPPPCSAKFGKFDASDAPAEAEEAGGATDGGLAQPVEEDDSCLPSDLEGAIRQSGKASADFVNSGGMRAIWCQYCRQNC

SEQ ID NO: 49173 - DNA, 707 bp, Zea mays
  misc_feature: Ceres CLONE 1459908-F
  misc_feature: Encodes the peptide sequence at SEQ ID NO. 49174
  misc_feature (371)..(371): n is a, c, t, g, unknown, or other
  misc_feature (441)..(441): n is a, c, t, g, unknown, or other
  misc_feature (442)..(442): n is a, c, t, g, unknown, or other
  misc_feature (498)..(498): n is a, c, t, g, unknown, or other
  misc_feature (504)..(504): n is a, c, t, g, unknown, or other
aagctggagctccccgcggtggcggccgctctatcaactagtggatcccccgggctgcaggtattcgcacgagaccattacctagaacatcctaatcgaaaaacgcatcggtccaccgagccacaccgtcaccacaccaccgtctcgcggagaaactcctccaaaacccccaaaccctttcaatcggcggcaatggcggcgccggcggccgacgatgcctcggcatccccaggctacgtcctccgctccacacttgaggggcaccgccgcgccgtatcaaccgttaagttctccccggatggccgccttctcgcctccgcctccgccgacaagcttcttcgcgtgtggtcttcctccgatctcacccccgnttgcgagctcgagggccatggagagggtgtctcagacctctctttctccccgacggccgcctccttgccnntcgctccgatgatcgcaccgtcgcatctgggacctcgccgtcggcggaaggccccngcttcntcagacgcttaagggccaaaccaactaaggctttcggggttttcttagccccatgggaacgtccttcccctcccggtcctttaacaaaaaggggcccctgtgggaagtcaagggcccgggaaggccccccccgtgggtgcgggccaattttaaaaccgtccccccggggaatatttattccggaggggacaaatattgggtcg

SEQ ID NO: 49174 - protein, 107 aa, Zea mays
  misc_feature: Ceres CLONE 1459908-F
  misc_feature (15)..(53): Pfam Name: WD40 Pfam Description: WD domain, G-beta repeat
  misc_feature: SWISSPROT Homolog: EC 2.3.1.48 Histone acetyltransferase
  misc_feature (60)..(60): Xaa is any aa, unknown, or other
  misc_feature (84)..(84): Xaa is any aa, unknown, or other
MAAPAADDASASPGYVLRSTLEGHRRAVSTVKFSPDGRLLASASADKLLRVWSSSDLTPXCELEGHGEGVSDLSFSPTAASLPXAPMIAPSHLGPRRRRKAPASSDA

SEQ ID NO: 49175 - DNA, 718 bp, Zea mays
  misc_feature: Ceres CLONE 1459913-F
  misc_feature (308)..(308): n is a, c, t, g, unknown, or other
  misc_feature (461)..(461): n is a, c, t, g, unknown, or other
  misc_feature (462)..(462): n is a, c, t, g, unknown, or other
  misc_feature (538)..(538): n is a, c, t, g, unknown, or other
aaagctggagctccccgcggtggcggccgctctagaactagtggatcccccgggctgcaggaattcgcacgagaccattacctagaacatcctaatcgaaaaatcggtctatctatccttctatccccattcccatcccgagacaggagaaggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtnggaggtggtgcgcctggctccacaccccaagtacaagcgccgggagcgcatcaagaagaagtaccaggcgcacgaccccgacaaccagttcaaggtcggcgacgtcgtcgagctccaaccctcccgtcccatctccaagaccaagcacttccnntcgcatccgctcccgccccgcgacagtcgccgcaagtctcagctcctaccgccgctccagtccgacgacgaccagnagccgtcctcgcgagagtgattgattgtgattgattgctgcctgtctatgggctcgtcgtaagctcctctcatcagaggtgctgcttcccaattccaatgcgaatcatggtggttttggccgaccttttccttttctttcaacaaaggcttagcccatttccccaaaaacttttggcttg

SEQ ID NO: 49176 - DNA, 734 bp, Zea mays
  misc_feature: Ceres CLONE 1459916-F
  misc_feature: Encodes the peptide sequence at SEQ ID NO. 49177
aaagctggagctccccgcggtggcggccgctctagaactagtggatcccccgggctgcaggaattcgcacgagaccattacctggaacatcctaatcgaaaacatccagctattgggacctgttgagagcacacctctctgatcctttaacaggtgttctcatggatgatgcattgattttatcatgtggccattcatatggaagtagtggaatgcaacatgtctacagaatgaaagcttgtggtaagtgtggcatgccaattactgaggccgccattcgaccaaacttggctcttcgccttgcagttcaggcattcaaacgtgaagaagactcagcaaagtcattgaaaagaagaagagagcgccttgaactggtatacgcccttttccagcttatcagtcacccttcaaatcgggcagctatatttgttgcatgttcttaaatccattctaccctatgtgaggataaatgtggtgacgatgatccaaatcgaactgaacttgctactagaggtaaaggtgtgcagtttcctttttctgtcttcgacagggtcataatcaagggaaacaagaggaccccggaacggtttgtgggacgtcaagcagttgtgacagcgcagtgcttaaatggatggtatgttgtgaagacttcagacaacgcagagagtgtgaagctgcaataccgttccttggcaaaggttgctgatggcaatgggccttctggtcttgtccaa

SEQ ID NO: 49177 - protein, 93 aa, Zea mays
  misc_feature: Ceres CLONE 1459916-F
MDDALILSCGHSYGSSGMQHVYRMKACGKCGMPITEAAIRPNLALRLAVQAFKREEDSAKSLKRRRERLELVYALFQLISHPSNRAAIFVACS

SEQ ID NO: 49178 - DNA, 717 bp, Zea mays
  misc_feature: Ceres CLONE 1459918-F
  misc_feature: Encodes the peptide sequence at SEQ ID NO. 49179
  misc_feature (336)..(336): n is a, c, t, g, unknown, or other
  misc_feature (337)..(337): n is a, c, t, g, unknown, or other
  misc_feature (349)..(349): n is a, c, t, g, unknown, or other
  misc_feature (352)..(352): n is a, c, t, g, unknown, or other
  misc_feature (355)..(355): n is a, c, t, g, unknown, or other
agagctggagctccccgcggtggcggccgctctagaactagtggatcccccgggctgcaggaattcgcacgagaccattacctagaacatcctaatcgaaaatcaaaggcataggagtaacagtcttcgcacaaatattccctcccccaaggcccgaagccccgaaactttccggatctttcttccgccgcttcatcttctttgcgcaaaactagttttgtttctcgttcttctcttcgatttcggccgaataaagatggcgtcggctgcgcgcctcctcgcgccgttctccaggcgcggcgtcgtctctgtgggctctgcggggggtgaaaagcnngcgccctgagcngcntcnctcatgggggcgcctgtgctggctacggtggaaagctgcgcttcgatcaaggtcattcctttgtcgaaatcgctgggctcgatactcgacaactgcatttcagaggttttgggttttcaacttcagcccccccacaagagggataggggaacaaaccagccccccaaataagggggttaataaaaatgtgttggagcaagtcctgggacttcccagggaacccaaaaaatggcccgggaacccaaaaaggccccgggaaccgggttcctcttgttttttattccagtttctaaggggagagggggcctttaaacaaccgggttttttgtggtcaattttaaaaaccccctcccttcttgggg

SEQ ID NO: 49179 - protein, 29 aa, Zea mays
  misc_feature: Ceres CLONE 1459918-F
  misc_feature (27)..(27): Xaa is any aa, unknown, or other
MASAARLLAPFSRRGVVSVGSAGGEKXAP

SEQ ID NO: 49180 - DNA, 754 bp, Zea mays
  misc_feature: Ceres CLONE 1459921-F
  misc_feature: Encodes the peptide sequence at SEQ ID NO. 49181
  misc_feature (649)..(649): n is a, c, t, g, unknown, or other
aaagctggagctccccgcggtggcggccgctctagaactagtggatcccccgggctgcaggaattcgtctcacccctaatcgaaaactcccgcagagccgccgacaactctctctaccgtccgataccccaagcaccagcgcggcggcggcgaccatggctgacggaaagaaccagacgatctccgagggaaagaagggtggcaagaaaaacaccgtccaccctttctctaataaggattggtatgacatccaggcaccgtcggtgttcagagtgcgcaacatcgggaagactctcgtatccatgacacaaggtaccaggattgcttctgagggtctgaagcacacagtctttgaggtttgcctagctgatcttccgggcgacaaggatcaagcttacatgaaaatcacgctccgtgctgaatatgtgcaggccacgaatgtgctcacaaacttttgggctatgaattttaccactgataaactgacatccctactgaacaagtggcacacattaatctaagcccatgttgatgtcatgacaaccgacaactacatgttgcgtttgttctgcatctgcttcacgaagatgcgcccaaaccagatctagataacctgctatgctcaggcatcccagatccgtcagatccngccgtagatggttgagattatgatcaaccaggcttctacatgtgacctgaaagaacttgctacgaagtcattccagaactattggcaaggagactgagactctac

SEQ ID NO: 49181 - protein, 121 aa, Zea mays
  misc_feature: Ceres CLONE 1459921-F
  misc_feature (11)..(121): Pfam Name: Ribosomal_S3Ae Pfam Description: Ribosomal S3Ae family
MADGKNQTISEGKKGGKKNTVHPFSNKDWYDIQAPSVFRVRNIGKTLVSMTQGTRIASEGLKHTVFEVCLADLPGDKDQAYMKITLRAEYVQATNVLTNFWAMNFTTDKLTSLLNKWHTLI

SEQ ID NO: 49182 - DNA, 766 bp, Zea mays
  misc_feature: Ceres CLONE 1459924-F
  misc_feature: Encodes the peptide sequence at SEQ ID NO. 49183
aagctggagctccccgcggtggcggccgctctagaactagtggatcccccgggctgcaggaattcgtctcacccctaatcgaaaaatcggactcatctccttcgattcagcagaggacagcgctctgcctctccactacttgacagccacggatccttccatccctcgcctagcgaacagacccggctggccatcctcaacgcacccctcccattttccattcggatgtatgcgtgggtgaccagcacatcgaggagttccacaagcacacatgaggtatctgaaactgaatccaaagtacgaagtcagtaatgaggagtgtgtctctctcaggcttgaactgtcgcagagttcagtgaaactcgacactatctttgaggcatctttcaagttcatgatatatgatcagttaatcggaaagcacaaggtgcatctaggtaaccacagcttccagactgcaagtacgagctctgccatcgcattcatgttacctctgaaagcactcagacaatcctctagatttattgtcaataacagctgcgtatttggcattggcttcatcaaagttgccactatcaaagttaacacgacgctagaaacactgtttgtcaggaagatgaacatcttcaacgaggccaaagtttacacttggaaaatcgaggatttctctgctctgaagacccgtcccactcaccgaagtttgagatcgctggatacacatggattatctctttgaaatcatcctacgatggtaacagcctgtcct

SEQ ID NO: 49183 - protein, 154 aa, Zea mays
  misc_feature: Ceres CLONE 1459924-F
MRYLKLNPKYEVSNEECVSLRLELSQSSVKLDTIFEASFKFMIYDQLIGKHKVHLGNHSFQTASTSSAIAFMLPLKALRQSSRFIVNNSCVFGIGFIKVATIKVNTTLETLFVRKMNIFNEAKVYTWKIEDFSALKTRPTHRSLRSLDTHGLSL

SEQ ID NO: 49184 - DNA, 719 bp, Zea mays
  misc_feature: Ceres CLONE 1459928-F
  misc_feature: Encodes the peptide sequence at SEQ ID NO. 49185
  misc_feature (719)..(719): n is a, c, t, g, unknown, or other
ctcaccgcggtggcggccgctctagaactagtggatcccccgggctgcaggaattcgtctcacccctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgaccgcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaccgtagtggaggtagctatgcctctgcatgctcgttggatggcagcgtggccatcagcagcatgcggtcgtcgtcgtcaacctagcagatgtcctagctacgtgtgtgtcctcagactggcactgtggcacataataaagaagtagatcatgccn

SEQ ID NO: 49185 - protein, 126 aa, Zea mays; identical to SEQ ID NO: 15591
  misc_feature: Ceres CLONE 1459928-F
  misc_feature (36)..(122): Pfam Name: Tryp_alpha_amyl Pfam Description: Protease inhibitor/seed storage/LTP family

SEQ ID NO: 49186 - DNA, 736 bp, Zea mays
  misc_feature: Ceres CLONE 1459942-F
  misc_feature: Encodes the peptide sequence at SEQ ID NO. 49187
  misc_feature (1)..(1): n is a, c, t, g, unknown, or other
  misc_feature (393)..(393): n is a, c, t, g, unknown, or other
  misc_feature (394)..(394): n is a, c, t, g, unknown, or other
  misc_feature (398)..(398): n is a, c, t, g, unknown, or other
  misc_feature (736)..(736): n is a, c, t, g, unknown, or other
naaatgtggagctccccgcggtggcggccgctctagaactagtggatcccccgggctgcaggaattcgtctcacccctaatcgaaaaagcagtccgatagccaggaagcccgtgcacgtcgaccgacgtacgccaccatgccggggctcaccataggcgacaccgtccccaacctggagctggactccacccacggcaagatccgcatccacgactacgttggcgacggctacgctatcatcttctctcacccagccgacttcacgcccgtgtgcacgacggagatggcggcgatggcggggtacgccaaggagttcgagaagcgtggcgtgaagctgctgggcatctcgtgcgacgacgtggagtcccacaggcaggggaccgaggacgtgnnagcntacggcgggaaccaccaccagcagcagcatacgacgacaaaggtgacgttcccgatcctggcggacccggcgcgggacgccatccggcagctgaacatggtggaccccgacgagaaggacgcggcggggcgaaccatgccgtcccgcgcgctccacgacgtcgggcccgaaaaggccgtgaagctgaactttcctgtaccggccaccacggggcggaaaatggacaaggtgttgcccgccctcgactcgctgctcacggccgccaacacggggggaaaggggccacccccgctaactggaaagccgggaaaggccccgtcatccccccccagggttcn

SEQ ID NO: 49187 - protein, 199 aa, Zea mays
  misc_feature: Ceres CLONE 1459942-F
  misc_feature (6)..(150): Pfam Name: AhpC-TSA Pfam Description: AhpC/TSA family
  misc_feature: SWISSPROT Homolog: EC 1.11.1.15 Peroxiredoxin
  misc_feature (86)..(86): Xaa is any aa, unknown, or other
MPGLTIGDTVPNLELDSTHGKIRIHDYVGDGYAIIFSHPADFTPVCTTEMAAMAGYAKEFEKRGVKLLGISCDDVESHRQGTEDVXAYGGNHHQQQHTTTKVTFPILADPARDAIRQLNMVDPDEKDAAGRTMPSRALHDVGPEKAVKLNFPVPATTGRKMDKVLPALDSLLTAANTGGKGPPPLTGKPGKAPSSPPRV

SEQ ID NO: 49188 - DNA, 774 bp, Zea mays
  misc_feature: Ceres CLONE 1459948-F
  misc_feature: Encodes the peptide sequence at SEQ ID NO. 49189
  misc_feature (364)..(364): n is a, c, t, g, unknown, or other
  misc_feature (440)..(440): n is a, c, t, g, unknown, or other
atagctggagctccccgcggtggcggccgctctagaactagtggatcccccgggctgcaggaattcgtctcacccctaatcgaaaaaagacggatcgagactacacgacgccgatcctagctagctctcccgtttctgctcgcaagtcacacacagctccggtagatccgcccctcgcctctgggctccaggaagagattagcttcagacggcagggatcgatactagcaagcaagcatggcgcacgacttgtgcgaggacttggagctcgtcgccgacgacggcggcttcgatgactactactgggacgacgacttccatttccacgacgacgacggcttctccgcctccctacgacccccgncagcgttggtgcgccccgccagcagcagcagcagcagcagatgggtgatatttcagcctcggactacaaagaggcnaagaactgcaggggataccctggggaaagctcaactaccccagggaccgtatcgtcggatgaggctcaaagaatcagaagcttccaaaccccccgaaggccaaaagggcctaaaaaacggggggaaagaaaggaacattcccagatttcccttgaaaccgaacccgcaaagcaaaaaattggcttttccgggcaaaaaaaaaaggggggagactttggggggccccctcccctttcctcgggggaaacccccccatttaaaaaaacacccgggggggggccccccccccccggggggaaccccccggggggtggaaaacttataatgtggtccc

SEQ ID NO: 49189 - protein, 175 aa, Zea mays
  misc_feature: Ceres CLONE 1459948-F
  misc_feature (43)..(43): Xaa is any aa, unknown, or other
  misc_feature (68)..(68): Xaa is any aa, unknown, or other
MAHDLCEDLELVADDGGFDDYYWDDDFHFHDDDGFSASLRPPXALVRPASSSSSSRWVIFQPRTTKRXRTAGDTLGKAQLPQGPYRRMRLKESEASKPPEGQKGLKNGGKERNIPRFPLKPNPQSKKLAFPGKKKRGETLGGPLPFPRGKPPHLKKHPGGGPPPPGGTPRGVENL

SEQ ID NO: 49190 - DNA, 776 bp, Zea mays
  misc_feature: Ceres CLONE 1459949-F
  misc_feature (729)..(729): n is a, c, t, g, unknown, or other
gcggtggcggccgctctagactagtggatcccccgggctgcaggaattcgtctcacccctaatcgaaaactttctctcccccttctctcttgctgctacaactgggtaggctgcggacgcctgccttatgccaggtcccccgggaccaagaatgcgtattcttccgttttccttcgccgggtgagcccagcttggttgccacttggagtggccacgcaaaattttacgataagtcatcgcagcctcccgccccaagaacaaaggctgcgactgtgacccccttgataatgggccacacgcccgcgcagagatttgctccagagtgcacgctgttttcccaccagtgtagtgttatgaaggtttttaccaaggaggatcccaccaagatacaccctaacccaacaagacctgtatttcggtagtagtccttctcgcctccttcctccgggcctcctcatacaccacaaggtagggaatggaagacaagtgtcccactggtcatatatggggatctcagtccacgtcctaccgcttgctgctcttgactttgcccttaggggctgcactagacgctccggtcagctccaagcctaacgtgagtttcatcgcatttccaccattacaatctcgaattgcctgtcttcttctgcctggctagactgatttagagtgagagcctaaaatcgatcatatttcgccttctaacagcggctgagagtaaagagaaancttcttcgccatattctcaagtataccatctgaacaggctgttgagg

SEQ ID NO: 49191 - DNA, 730 bp, Zea mays
  misc_feature: Ceres CLONE 1459950-F
  misc_feature: Encodes the peptide sequence at SEQ ID NO. 49192
  misc_feature (410)..(410): n is a, c, t, g, unknown, or other
  misc_feature (478)..(478): n is a, c, t, g, unknown, or other
ctccccgcggtggcggccgctctagaactagtggatcccccgggctgcaggaattcgtctcacccctaatcgaaaactcttcgcttctaactccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaaaagtcaggagctcccacaancctatgaggttttgagtgatccaaagaacgtgagatttatgatcagtatggtgaagatgccctaaagnaagaaatggcggtggaggatccctggtgatcccttggaacccttcccccattttggaccccctttggaggagggggggaacccccggggaaaagcgaaggggggaaaaaaatttttccccccttaagtttttctggaaaattttagggccccccaaaaaccttctttttcccaaaatgttttctcccaaggaagggagaggggccaaatggggcccaaaaagggcccccttttccccgcccaaaaaaaaaaa

SEQ ID NO: 49192 - protein, 77 aa, Zea mays
  misc_feature: Ceres CLONE 1459950-F
  misc_feature (13)..(71): Pfam Name: DnaJ Pfam Description: DnaJ domain
  misc_feature (57)..(57): Xaa is any aa, unknown, or other
MFGRAPKKSDNTKYYEILGVPKSASQDDLKKAYRKAAIKNHPDKGGDPEKSQELPQXYEVLSDPKNVRFMISMVKMP

SEQ ID NO: 49193 - DNA, 742 bp, Zea mays
  misc_feature: Ceres CLONE 1459960-F
  misc_feature: Encodes the peptide sequence at SEQ ID NO. 49194
  misc_feature (361)..(361): n is a, c, t, g, unknown, or other
ctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcgcttccagnagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaatttccatgatggggtgataatctgtcaatgtcatttctttgctcagttttagttcaaccccatttcacctttccatatgcatatacggtatctgtgcctggcaaacatattttgaggctagctaaatatgacccttttgtctctaaagtggtaaataaagaaattatctgacaaaaaaa

SEQ ID NO: 49194 - protein, 72 aa, Zea mays
  misc_feature: Ceres CLONE 1459960-F
  misc_feature (20)..(20): Xaa is any aa, unknown, or other
MGKTPVRMKAVVYALSRFQXKVMPGLWKDITTKIHHKVTENWISATLLLTPVVGTYQYAMWYKEQEKLSHRY

SEQ ID NO: 49195 - DNA, 803 bp, Zea mays
  misc_feature: Ceres CLONE 1459965-F
  misc_feature: Encodes the peptide sequence at SEQ ID NO. 49196
  misc_feature (430)..(430): n is a, c, t, g, unknown, or other
  misc_feature (431)..(431): n is a, c, t, g, unknown, or other
aaagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccagcgtgaactgctcgagtttgcttattatcatggaggcggctgtagttctcttttccaccgcaaccccttttttttcctaaggaacgaacattgcaatttttgaaaggttttgaaaaccccccccggccggggaacttttgaatgtttgaatagggtgccacccccccctccnnaaaaaaaaaaggaaaatttagaaactgattttcccatcattggggggaaaccccaggaaagtttttttttatggaaaacccccccttttgtcccaaattaaatttgggcccccccaccagccgggggaaaaacccgggggttgtgctttttggcacaaaaaaaacccgctctggtttttcgcaaaatgttctcctcaccatcaaaaaaaaacacatcgtctttatatacacaagtgttcccccctccctcacaaaaaaatgagggggctcgtttttaaaaacgcggcgaaaaaccgctctcataaaaaaaaaaaaaaaaaaagaaggcgtggggcccccttcccctctaaaagtggggctttattatccccg

SEQ ID NO: 49196 - protein, 73 aa, Zea mays; identical to SEQ ID NO: 46214
  misc_feature: Ceres CLONE 1459965-F

SEQ ID NO: 49197 - DNA, 779 bp, Zea mays
  misc_feature: Ceres CLONE 1459966-F
  misc_feature (444)..(444): n is a, c, t, g, unknown, or other
  misc_feature (521)..(521): n is a, c, t, g, unknown, or other
  misc_feature (522)..(522): n is a, c, t, g, unknown, or other
  misc_feature (559)..(559): n is a, c, t, g, unknown, or other
  misc_feature (611)..(611): n is a, c, t, g, unknown, or other
  misc_feature (640)..(640): n is a, c, t, g, unknown, or other
  misc_feature (641)..(641): n is a, c, t, g, unknown, or other
  misc_feature (654)..(654): n is a, c, t, g, unknown, or other
  misc_feature (655)..(655): n is a, c, t, g, unknown, or other
  misc_feature (681)..(681): n is a, c, t, g, unknown, or other
  misc_feature (689)..(689): n is a, c, t, g, unknown, or other
atagctggagctcaccgcggtggcggccgctctagactagtggatcccccgggctgcagggattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaaccacggcgtgcgcgtgaactatgaatgtatgagtcactccccacccaaactgtttgagtactatgctaagntgaggagctgcattcacatcatgcgctggagcgcgagggaggcttctttatcggacagcctcacttgccaccgaagnnatcaggcacccccccaagccgtgaactaccctggggnttggcttttggatggagacaaccgctgtggttgcccaaaacccatatccgtncctccacgaaaccagaagctttaactatnnaaatgtaatcacnntccttaacgaactatgggatgccgcnttcgcccntacgcccggataaacggcgcttccttaaaaaaaacaaaaaaaaaaccgagacgcctcggagggaccccaattcgccccctaccctggacc

SEQ ID NO: 49198 - DNA, 752 bp, Zea mays
  misc_feature: Ceres CLONE 1459969-F
  misc_feature: Encodes the peptide sequence at SEQ ID NO. 49199
  misc_feature (543)..(543): n is a, c, t, g, unknown, or other
  misc_feature (622)..(622): n is a, c, t, g, unknown, or other
  misc_feature (656)..(656): n is a, c, t, g, unknown, or other
  misc_feature (672)..(672): n is a, c, t, g, unknown, or other
aaagctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaangtgctgcggcttgtcgcagttgaattttccatgatgggttgtataatctgtcaatgtcatttctttgctcagttttagntcaacccattttcaccttttcatatgcatatacngtatctgtgcctggcnaacatattttgaggctagctaatatgaaccttttggctcctaagttgttaaataaagaaaatatctgacaaaaaaaaaaa

SEQ ID NO: 49199 - protein, 72 aa, Zea mays; identical to SEQ ID NO: 46899
  misc_feature: Ceres CLONE 1459969-F

SEQ ID NO: 49200 - DNA, 754 bp, Zea mays
  misc_feature: Ceres CLONE 1459971-F
  misc_feature: Encodes the peptide sequence at SEQ ID NO. 49201
  misc_feature (589)..(589): n is a, c, t, g, unknown, or other
  misc_feature (600)..(600): n is a, c, t, g, unknown, or other
atagctggagctcaccgcggtggcggccgctctagaactagtggatcccccgggctgcaggaattcgtctcacccctaatcgaaaatccgaccttccagtcttctccgtaggggcttcgctccatagatttcgccgcaaggggcaacggcacacccaccaactgacctgacccacgagggatccgcagatgaagatcattccggtcccttgcctggatgacaactatgcctacttaatcgtggacgagagcaccaagaaggcagcggccgttgaccctgtggaaccggagaaggttctcaaggcggccggcgaggtcggcgcctacgtcgactgcgttctcaccacccatcaccactgggatcatgctggtggcaatgaaaagatgaggctgcaggtgccagggataaaggtatttggaggatccctggacaatgtgaaaggctgcactgatcaggtggagaatggaatgaagttgtcacttgggaaggacattgagatactatgcctacacacgccttgccacactaaaggtcatatcagctactatgttactagtaaggagggtgaagatccagcggtcttcaccgnagataccttgnatcatgctgggtgtgggagttttttgagggtcctgcagagcaatgtatcagtcccttaatgttacactgggttcgctgccaaagtcaacccgagtttaactgtggcatgagtacacttgtgagaacctaaatttcatgctgaccctggagccaa

SEQ ID NO: 49201 - protein, 156 aa, Zea mays
  misc_feature: Ceres CLONE 1459971-F
  misc_feature (11)..(149): Pfam Name: Lactamase_B Pfam Description: Metallo-beta-lactamase superfamily
  misc_feature: SWISSPROT Homolog: EC 3.1.2.6 Hydroxyacylglutathione hydrolase
  misc_feature (134)..(134): Xaa is any aa, unknown, or other
  misc_feature (138)..(138): Xaa is any aa, unknown, or other
MKIIPVPCLDDNYAYLIVDESTKKAAAVDPVEPEKVLKAAGEVGAYVDCVLTTHHHWDHAGGNEKMRLQVPGIKVFGGSLDNVKGCTDQVENGMKLSLGKDIEILCLHTPCHTKGHISYYVTSKEGEDPAVFTXDTLXHAGCGSFLRVLQSNVSVP

SEQ ID NO: 49202 - DNA, 784 bp, Zea mays
  misc_feature: Ceres CLONE 1459973-F
  misc_feature: Encodes the peptide sequence at SEQ ID NO. 49203
  misc_feature (417)..(417): n is a, c, t, g, unknown, or other
  misc_feature (419)..(419): n is a, c, t, g, unknown, or other
  misc_feature (560)..(560): n is a, c, t, g, unknown, or other
aagctggagctccccgcggtggcggccgctctagaactagtggatcccccgggctgcaggaattcgtctcacccctaatcgaaaattcctcgtgcccgtcccctcaggcgctcttgctggttctggaagccggagcatcggcgctgtcgctcaggtctgtccattcccctccaaagccctaaagctaggcttcctgtgctaacccgaatcaagcaagccccgtcaacctcccccgccgtcgtcttcttctctgttgctctcctctccaccgggtccccatctcctcccttcaccgccccagaactcctcactcgggcgctgccgctgcgaggtctccgtggcatcgggccttcgtcattacgcagcagacgaagcagtgggaaacttggaactgcatgcacccaaggcaaaaccccngncatatatcccaacgaaaaatggaacagccatgatgcttccgctcccatatcattacgaagatgtactacgtcaggatctggtgctcaaacagaatcatgccaatatcatgcaagttccaggggttgtttgaaggtcaaaanagccacaaaagcctggctctgaatctcaaagatcccaattggaaaaatgcgcattgagggttttaaatgggcccgaaattctaaaaggcacaaaattgaccccttccccaaaagcaaaaaaagcctcctcgaaacacatcccttttttgggggccaacaaggaacggaaacactgttttctccgaaccaaaaccgttttctcggggggggcaagggaaacattt

SEQ ID NO: 49203 - protein, 33 aa, Zea mays
  misc_feature: Ceres CLONE 1459973-F
MMLPLPYHYEDVLRQDLVLKQNHANIMQVPGVV

SEQ ID NO: 49204 - DNA, 726 bp, Zea mays
  misc_feature: Ceres CLONE 1459974-F
  misc_feature: Encodes the peptide sequence at SEQ ID NO. 49205
  misc_feature (1)..(1): n is a, c, t, g, unknown, or other
  misc_feature (370)..(370): n is a, c, t, g, unknown, or other
nagagctggagctcaccgcggtggcggccgctctagaactagtggatcccccgggctgcaggaattcgtctcacccctaatcgaaaagaaggggaatctccggaggatggaggtgggcaggactccgcggcgacgggcgtccccagcggcggctgtgccttcgctgcttctgttcgccttgctattcgtgtgccgggcggcggcagcgttgggcggcccggcgccggcgctatacaagcacgcgtcgttcttcgaccgcgacggcgacggcgtcgtctccttcgcggagacgtacggcgcgtttcgggccctcgggtttggactcggcctgtccagcgtcagcgccgccttcatcaatggcgcccttggnagcaagtgcaaacctcaaaacgcgacgtcgtcgaagctggacatctacatagaggacatccggagagggaagcacgggagcgactccggctcgtacgacgcccaaggaaggttcgttcccgagaagttcgaggagatattcgccaggcacgcgaggacagtccccgacgccctgacctcggacgagatcgaccagctgctccaagcgaacccccagcccggggactacagcggctgggctgcccccgaacccgagtgcaagatcctgtacagtccccgcaaggacggggacggcctcctccccaggacgtcgcaaggagcgtcttacacgggaccattgttcccccggctcccccc

SEQ ID NO: 49205 - protein, 206 aa, Zea mays
  misc_feature: Ceres CLONE 1459974-F
  misc_feature (30)..(205): Pfam Name: Caleosin Pfam Description: Caleosin related protein
MEVGRTPRRRASPAAAVPSLLLFALLFVCRAAAALGGPAPALYKHASFFDRDGDGVVSFAETYGAFRALGFGLGLSSVSAAFINGALGSKCKPQNATSSKLDIYIEDIRRGKHGSDSGSYDAQGRFVPEKFEEIFARHARTVPDALTSDEIDQLLQANPQPGDYSGWAAPEPECKILYSPRKDGDGLLPRTSQGASYTGPLFPRLP

SEQ ID NO: 49206 - DNA, 763 bp, Zea mays
  misc_feature: Ceres CLONE 1459976-F
agagctggagctccccgcggtggcggccgctctagaactagtggatcccccgggctgcaggaattcgtctcacccctaatcgaaaatttttcgttgaagccgcatccgtcgcgtttcataatgtcaaatctctcgcgagcgagggagacccacgggccgcggccatctcacggtggaaggagccaagcagccggcctggcgcccctccccttccgtcccgccgctgctgccgtgcctcgtgcctgccagcggcggatgccgccccgccccgctgctgaccaccgccgctgctgagcatggacgccgctcccgcgggcgctcacaaccgctgcaaactgcaggaagtgatccggaagctcggatctattcagaaggggagagccgactggcgtggcctcctctgaagtcacccaacccacccccttatcattttaaggtaatttgggatcgacctactgccgccaagttcatccgacttgacgctgattcacctgcacctcactctccatatctaaacgacactgtcctcgaagtatgggagcccacttggacgtgtctggggatgaatagagagctcatttccagtcggcttcaactcaagcttgccagggcttaatattgcgcactcatgattcacggctcgtgcaagaagatccattgtcttccacttataacatgatgtcgcatatggaaaagggtccccactcccagggggatttagcaactgaaaaaactcctttctgaccagattgatggcaagtcg

SEQ ID NO: 49207 - DNA, 730 bp, Zea mays
  misc_feature: Ceres CLONE 1459978-F
  misc_feature: Pfam Name: Esterase Pfam Description: Putative esterase
  misc_feature: SWISSPROT Homolog: EC 3.1.2.12 S-formylglutathione hydrolase
atagctggagctccccgcggtggcggccgctctagaactagtggatcccccgggctgcaggaattcgtctcacccctaatcgaaaaatttcctttccctaccgttgcgacatctgtatggaatataccttcacaggatgttattacgggttcatatctgatgtgccatggccggaacgccgcccttggctgctccaggacttgctgcatctacctgcgcccgtgctcgggggcgaaccatcgcgtgtgatgctggctctcgggtctcacctgtgccaatgatagtttcatcataaatggcggagcccaaggtgcattcattgcccactgcatcaagactcgtgttacctgatacctcatcacttatattgtgcatgaaaaaaacatttgagccaaccatgtcagacctcttactgcgcaacatcccatcacatgctccgtcacatcgcaccatcatatgcacaatctacttaagacgatgacatccagcatgactatcccctggactagccaacacggtagatcctgcaccgatggaacatcgactactagcttgtgactacagtcatgagtatctgataaccagtgtgcgatcaataatctcacctcccatacatgcaatggacattgtgtaggtggaacgtgaaattggtagctttctctgccctgcaccctctgcactgctgcaaaacccttttccctggcctgctcgaggaacctcattacgcctt

SEQ ID NO: 49208 - DNA, 813 bp, Zea mays
  misc_feature: Ceres CLONE 1459983-F
  misc_feature: Encodes the peptide sequence at SEQ ID NO. 49209
  misc_feature (414)..(414): n is a, c, t, g, unknown, or other
  misc_feature (785)..(785): n is a, c, t, g, unknown, or other
aaagctggagctccccgcggtggcggccgctctagaactagtggatcccccgggctgcaggaattcgtctcacccctaatcgaaaaatccgaagttccgaacccacgccaagccccagggtccgaccgcagaaccgacccaaaatgtcgcccgcctcttccatgctcaccgccgtgtcgctctcctccccgctcccagccccgcgcctccgcgccgccgccgccgcctcctccttcgctccgccgcgccgcgcggcagtcgcactcgtcgtgcgcgcggcgtccgcatcttccaagtcccctgccacggcggaggcggccccgaagaagaagagggcgaccggcatcacccagccgaagtccgtgtcgccggcgctgcaggcaatcgtgggcgacccggtttatccccgcaccnacccccccaagcgcctctgggcctatatcaaggagcataacctccagaatccttctgataaaaagggggtggtttgtgaagagaaactgaaaggccttgtccctggggcgggaaccaagtggaaatcccttgagaatcgcaaggtttccaaccccccctttctggaaggatttaaggagaaccccgcccccttccggaaaaccaggttacctttatggggggggggggggacactggggggcgggcccaaaagggggcccgggctcttgggtttttgacaccccaaaagggcgccccccccaccttaaaaaaagggggtgtttcccttttttataaagccccccccgccctcccccgcgtgtggagacaanccggggggggggagcttcacccctaaac

SEQ ID NO: 49209 - protein, 182 aa, Zea mays
  misc_feature: Ceres CLONE 1459983-F
  misc_feature (68)..(145): Pfam Name: SWIB Pfam Description: SWIB/MDM2 domain
  misc_feature (91)..(91): Xaa is any aa, unknown, or other
MSPASSMLTAVSLSSPLPAPRLRAAAAASSFAPPRRAAVALVVRAASASSKSPATAEAAPKKKRATGITQPKSVSPALQAIVGDPVYPRTXPPKRLWAYIKEHNLQNPSDKKGVVCEEKLKGLVPGAGTKWKSLENRKVSNPPFLEGFKENPAPFRKTRLPLWGGGGTLGGGPKRGPGLLGF

SEQ ID NO: 49210 - DNA, 778 bp, Zea mays
  misc_feature: Ceres CLONE 1459985-F
  misc_feature (424)..(424): n is a, c, t, g, unknown, or other
  misc_feature (429)..(429): n is a, c, t, g, unknown, or other
aagctggagctccccgcggtggcggccgctctagaactagtggatcccccgggctgcaggaattcgtctcacccctaatcgaaaaacaattttgcacttccacccctagccgccacaacctttctccctctcctctcctttcagccaacgtgcggctccagcagggagcctttctccccaagcgcatagaagcatctcctggcgtcttccccttcccagcgtaggagcaagggcttcccatggcggcctcccttgtgacatctccccctacaggttccaggtcggcgcccttctctagcctggacttgtagcgcctgatgcccatcttcgccctctgctgtcgaaggcacgggcaccattttcccccatggccgagctcaacacctgccaggacaagctgcgggcccctctgccccccccccgncgtgngaccttctctggttggagctcgagcaggtgagctcgccccatggccttggctccttgtttgcttgctgcacgtacgctccctctcccatctggctttctgcccttctcaagtccggccatccccgccttgccgtggatttcctcgagcagccccacctggccgccatcctcctcagatcgacctcccctttttggtgtagctcaccatctccccatacgcggcgctagctggaagccattccgagctcccgccaacccgggctggcaactccctctccgctggcttccctgtggacagccggaagctccaagggccgaaccctcgcgtctccatgggccaaaccagaaa

SEQ ID NO: 49211 - DNA, 832 bp, Zea mays
  misc_feature: Ceres CLONE 1459986-F
  misc_feature: Encodes the peptide sequence at SEQ ID NO. 49212
  misc_feature (447)..(447): n is a, c, t, g, unknown, or other
  misc_feature (456)..(456): n is a, c, t, g, unknown, or other
  misc_feature (463)..(463): n is a, c, t, g, unknown, or other
  misc_feature (474)..(474): n is a, c, t, g, unknown, or other
  misc_feature (532)..(532): n is a, c, t, g, unknown, or other
ctaagctggagctccccgcggtggcggccgctcttgacatagtggatcccccgggctgcaggatttcgtctcacccctaatcgaaaaaacaagtctctcggccaggtctccctctccccggctctccgccttcctcttccagtccccgcgcgcgagatcgccgccccgggtgggcgctagatcccgatggcctcgcgccgccgcaccctgttcaaggtcatcatcctcggccatagtggggtagggaagacttccttgaggaaccaccacgtgaacaagaagttcatactcccatacaggggtacgagcggggcgggacttcctcatccaaggggtgccagttcaaagaacaggctccttatttttgttgttatggttttccccccggcgcggataaactatcggaaggcttgatatgaatgccgaacggtccgtcccaccaaaacnaaaaaaaanaaaaaanaaaacaccggncacaccccaccacaacccaccacgacccccccacaaccaaacctccccacctcgcaangagtcctaacccccgcgtgacgccccccctgttcgcgttagagtagttcaccccagcgcacaccttctccccagtatgtcggacttttatttctcacgagtggggtcgacgaggtattgacgacttatcgccgccaccacacagacccgagagcgcgggcttcctgattaacgcgcacacgcggcatcagcctgtcagtcctccagagggaaagtgaagcccgcgatgcatccaacacgcgggtatcggcaacgctccctcactacattcgcggcgctcgtgagtgcctcccgcgccctc

SEQ ID NO: 49212 - protein, 75 aa, Zea mays
  misc_feature: Ceres CLONE 1459986-F
MASRRRTLFKVIILGHSGVGKTSLRNHHVNKKFILPYRGTSGAGLPHPRGASSKNRLLIFVVMVFPPARINYRKA

SEQ ID NO: 49213 - DNA, 774 bp, Zea mays
  misc_feature: Ceres CLONE 1459989-F
  misc_feature: Encodes the peptide sequence at SEQ ID NO. 49214
  misc_feature (410)..(410): n is a, c, t, g, unknown, or other
  misc_feature (428)..(428): n is a, c, t, g, unknown, or other
aaagctggagctccccgcggtggcggccgctctagaactagtggatcccccgggctgcaggaattcgtctcacccctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgaacgcctccgtggntgggctggccgtggccancccggtgtcctgatcctcgccccgtgctggtccccgcccgctgccatcgggaggccgtcatggggtccctcactccggccccttggctcgggggctgtcctcctaagtgcctgccaaacgggcggaaggggttccggccccccgaatacctggaagaggccccccaagaggggaaagccgggcccaccgggccaaaaacccccaggggggccgccccccgggggggcccaaaaccccccccggagaaaagaaatcccccctttttggggggaagggtttctcccaaaaaaccccctcccttttttaaaaaaacccgcctgtgtgttttaaataaaaccccgggggc

SEQ ID NO: 49214 - protein, 83 aa, Zea mays
  misc_feature: Ceres CLONE 1459989-F
  misc_feature (74)..(74): Xaa is any aa, unknown, or other
  misc_feature (80)..(80): Xaa is any aa, unknown, or other
MADRDRSGIYGGAHATYGQQQQQGGGGRPMGEQVKGMLHDKGPTASQALTVATLFPLGGLLLVLSGLALNASVXGLAVAXPVS

SEQ ID NO: 49215 - DNA, 758 bp, Zea mays
  misc_feature: Ceres CLONE 1459991-F
  misc_feature: Encodes the peptide sequence at SEQ ID NO. 49216
cgaagctggagctccccgcggtggcggccgctctttcatagtggatcccccgggctgcagtttttcgtctcagccctaatctaaaactacgtacacaggattggaagaactggaatatttggcaagagcggacttgccactgccttcttcaatgataataactcatcactggcaagatctcttgctgacctaatgcaagaatctaaccaagaggtacctgcatggctattgcgctatgcagctcgcccttcttatggtggtggtggtggtgggaggaaccggcgatcagggggagggagccgctttggtggccgagacttccgcaatgattcttcgtcatttggcaaggggggatcccttgttggtggttgattaataccccggaggcagtattgctggttatggtggtggctccccctcctggtggtggcgtacacggtggagctggggctccaagtgcctgggaatgatgttacagattgctcccaagtagaggggtctgccaagtttacgcccattttatactccagttctatttaaagaaaccatttttggtacgaactggtaatacaacaacaattaccaaggtgaaaggtggacatccccatttcttctatctggattgctactggactggcagattttaacacttcggaatgtgcattaacacaaaagccgcccttggaggaaatctcaaaccatctgaatattcctcaattttaggctaaaacttcattgtcacaggggatatagcacac

SEQ ID NO: 49216 - protein, 59 aa, Zea mays
  misc_feature: Ceres CLONE 1459991-F
MQESNQEVPAWLLRYAARPSYGGGGGGRNRRSGGGSRFGGRDFRNDSSSFGKGGSLVGG

SEQ ID NO: 49217 - DNA, 777 bp, Zea mays
  misc_feature: Ceres CLONE 1459992-F
  misc_feature (326)..(326): n is a, c, t, g, unknown, or other
  misc_feature (497)..(497): n is a, c, t, g, unknown, or other
  misc_feature (543)..(543): n is a, c, t, g, unknown, or other
ctggagctccccgcggtggcggccgctctagaactagtggatcccccgggctgcaggaattcgtctcacccctaatcgaaaactccgccccacgcagctgaggcgttgatcctcaccggcgtcgccatcgtaatcgccttggacagcggcaccagaacctctgcctccgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtnggaaaagcaaaggtgtgcttgacccaatgaaagtagtgagatctccatggcaaactcccgccagaaatatccgaagttggtaaggacggcttatcatcaagaagcctcataagatcactctagatcccgtgcaagagggcacatgacgcccagcaaaaaggacgcacttcngatattggtaacgtagggttacccgggaaggctaggctacccccanggttcttttaataaagagaatctttgtcttagcccccttttccccccaatttctgggcgcaaaaaatttccaagccttttttcctggccttttactaaaaggaaagagaccccctccaaaaaaaaaaggggtttttgggagaatcccccaccccccggtgaaaagcgcaaaagaaacacttttttaccctttttgccccccccccaaaaagaggggcgggagaaaaaaatccgt

SEQ ID NO: 49218 - DNA, 735 bp, Zea mays
  misc_feature: Ceres CLONE 1459994-F
  misc_feature: Encodes the peptide sequence at SEQ ID NO. 49219
  misc_feature (375)..(375): n is a, c, t, g, unknown, or other
  misc_feature (378)..(378): n is a, c, t, g, unknown, or other
  misc_feature (419)..(419): n is a, c, t, g, unknown, or other
aaagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaancanggcgtgcgcgtgaactatgaatgtatgagtccaccccacanctaaactgtttgagtactatgctaagctgaggagctgcattcacatcatgtggtggagcgcgagggaggcttctttatcggacagcctcacttgtcaccgacgcaatcaggcaccccccccaagccgtggactacgctgggtttggctttggcatgagaacgaccgctgtgtttgtcataagtcatatcgtaactagagaaacaagtagctttataatcacaatgtatcaccatcctacagaactatggatgcgtcttgtacataagccgggaaaagcgcttcttaaaaaaaaaaaaaaaccgagccgctcgaggt

SEQ ID NO: 49219 - protein, 73 aa, Zea mays; identical to SEQ ID NO: 46214
  misc_feature: Ceres CLONE 1459994-F

SEQ ID NO: 49220 - DNA, 773 bp, Zea mays
  misc_feature: Ceres CLONE 1459996-F
  misc_feature: Encodes the peptide sequence at SEQ ID NO. 49221
  misc_feature (664)..(664): n is a, c, t, g, unknown, or other
  misc_feature (674)..(674): n is a, c, t, g, unknown, or other
  misc_feature (682)..(682): n is a, c, t, g, unknown, or other
  misc_feature (751)..(751): n is a, c, t, g, unknown, or other
aagctggagctccccgcggtggcggccgctctataactagtggatcccccgggctgcaggaattcgtctcacccctaatcgaaaagaccaaaagattcccacgggctcgccgctcgcatctcgccagcgcgaacgcagcctccgtgcatatcaccagcctcctcgcgcacccggtcccgcttgcctttccccacctactcgccgtcgcggtgccgtgcgccggtgctgttcagtctagggtttcggccctcgcccgccgatccgtccccccgccggccatgtcgaagcaaggagggaaggccaagccgctgaaggcgcccaaggtcgacaagaaggagtacgacgagagtgatcttgcttatttgcggaagaaaaaagatgaggaaaaggcgctgaaggagctgaaggccaaggcacagaagggcgcaattggaggctcgggtctcaagaaaagtggaaagaaatgagcattgcccacccacccatctccaaaacacctaagagaacgataagacagctgcttatctgtgttgcgcttcactatatgatatatgtggctgtgagacaaatgtgcctcttgtattccgtgtttcgcggtgttccagtttgttttgcttgatccgaaagatgttcagcctctcatctgctagctttgatacacgangtatttgctnatatgatnatcatttgaagtggattctcggccaaaaaaaaaaaaaaaaaacgagacgctcgaggtacccaattcgcntatagggaggcgtattacgcgc

SEQ ID NO: 49221 - protein, 62 aa, Zea mays
  misc_feature: Ceres CLONE 1459996-F
  misc_feature (1)..(62): Pfam Name: TMA7 Pfam Description: Translation machinery associated TMA7
MSKQGGKAKPLKAPKVDKKEYDESDLAYLRKKKDEEKALKELKAKAQKGAIGGSGLKKSGKK

SEQ ID NO: 49222 - DNA, 783 bp, Zea mays
  misc_feature: Ceres CLONE 1459998-F
  misc_feature: Encodes the peptide sequence at SEQ ID NO. 49223
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactcccccacccaaactgtttgagtactatgctaagctgaagagctgcattccatcatgtggtggaccccgagggaggcttccttatcggaagccctccttgtcccgaacaattaggcacccccccaagcccggaactacccttggtttggctttggcaaggaacacacacccggggttttgcaaaagccataccggaccagaaaaacaagggtctttttaacccccatgggtccccccccccccaaacattgggggcccttttgaacaaagcgggaaaaagcccttcaaaaaaaaaaaaaaaaaagaaaaccgggggggcccccatcccccccaaaaggggcgtaataacccccccccccggcccggttttaaa

SEQ ID NO: 49223 - protein, 72 aa, Zea mays; identical to SEQ ID NO: 46180
  misc_feature: Ceres CLONE 1459998-F

SEQ ID NO: 49224 - DNA, 817 bp, Zea mays
  misc_feature: Ceres CLONE 1460002-F
  misc_feature (412)..(412): n is a, c, t, g, unknown, or other
  misc_feature (414)..(414): n is a, c, t, g, unknown, or other
  misc_feature (415)..(415): n is a, c, t, g, unknown, or other
  misc_feature (420)..(420): n is a, c, t, g, unknown, or other
  misc_feature (421)..(421): n is a, c, t, g, unknown, or other
  misc_feature (470)..(470): n is a, c, t, g, unknown, or other
atagctggagctccccgcggtggcggccgctctatactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccgggcggcgacgcgggggaaaatggggaagaccccggtgcggatgaaggccggggggaacgcgctggcgcccttccaggaggagggtgatgccggggctgtgggaaggaaatccccaccaattattnannccatnnctccccccaaaaaaaaaaattaagaaaaggaccccctaaacccccgtcnccgggccccaaccaaaaccccttgggggaccaaaaaagagggaaaaagttttcccccaaaaatcaaagggggagggccctcaaaaatgggcggggtgtgggcccacgggaaattttcccatgaggggggaggaaaaactcgcaacaagacgatttctctgccccctatataataaaccacaattatccccctctcacaaaaccataacagagctcctgtcgcggggaaaattttctcggaggcgcgccaaaaaaagaacactctctctcctcttatcgatcaccaaaacaaaaatacttcctcccaataaataaataaaatatcgaccgccgggccgcccccccttg

SEQ ID NO: 49225 - DNA, 788 bp, Zea mays
  misc_feature: Ceres CLONE 1460003-F
  misc_feature: Encodes the peptide sequence at SEQ ID NO. 49226
aagctggagctccccgcggtggcggccgctctagaactagtggatcccccgggctgcaggaattcgtctcacccctaatcgaaaaaacaagtctctcggccaggtctccctctccccggctctccgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacaccgctgggccagaaaagttttcagagtcttggtgttgcattccaccccgggagcagattggtggggtcccagcctatgatggtaattccatgaaatcatttgaaaacctgacaaattgcgagaagaagttctaatttcggctagccacacgaacccgaaaaattcccttttggccggtggggaacaaatttaatttaaagggggcacccccccctggtttttaaaaaaaagcaaaaggtgggtgttcttaaaaggaaaacccccccttttaaaacccccccaaagagaaaacaaatgggaaaaacccctccccggtttctgaaaaacccccttaaaaaaaccccaaaaaaaaatttttgtccacaaacccggggcggggggggggcacaccccccaaaaatttttggttgtttt

SEQ ID NO: 49226 - protein, 107 aa, Zea mays
  misc_feature: Ceres CLONE 1460003-F
  misc_feature (10)..(106): Pfam Name: Ras Pfam Description: Ras family
  misc_feature: SWISSPROT Homolog: EC 2.7.11.1 Non-specific serine/threonine protein kinase
MASRRRTLLKVIILGDSGVGKTSLMNQYVNKKFSNQYKATIGADFLTKEVQFEDRLFTLQIWDTAGPEKFSESWCCIPPREQIGGVPAYDGNSMKSFENLTNCEKKF

SEQ ID NO: 49227 - DNA, 772 bp, Zea mays
  misc_feature: Ceres CLONE 1460004
  misc_feature: Encodes the peptide sequence at SEQ ID NO. 49228
atcgaaaacatacaccgtcacctattacgcctgtcttgcctacaactatacacttttcagccccagtatctgctcctgcaattgcccctgagcttgcatcaggggctgttggtgtgcctccacctgttagtgctgtggtacctgagctgtcagaactggatgttcacaatgaggagaagttgctgagggagctggaggaaatgggttttaggcaggtcgatctcaacaaggaaatcctcaggcagaacaattacaatctggagcagtctgtcgatgacctatgtggcgtcaatgaatgggatcctctccttgcagagctggaagagatgggatttgatgacacagagatgaacaaggagctgcttgcgaagaatgagggaagcatcaagcgagctgtgatggagctcattgccagggagaagaaggacaagtgaagatcgtgtgctatctaagtatatattcgtaaataatgagacggctgtgccactgcggtgcagccctggtgcgtctcagagcttgcttatggtgaactcttcgtgttaggtttcttccttatatctgtcgtgtctgcggtgtcgatgaactatctagtatgtggagcgtgtgcgtctcagcagttaccctgccatgccacgtggactggctgtcgtgcctactgtctgttaccatgtatatatataaaaaatgatgcgtggaccaatgtttgatgctggcgctcttgccctcgtgataatgtattagcggttggtttgttgcttaaaaaaaaaaaaaa

SEQ ID NO: 49228 - protein, 77 aa, Zea mays
  misc_feature: Ceres CLONE 1460004
MGFRQVDLNKEILRQNNYNLEQSVDDLCGVNEWDPLLAELEEMGFDDTEMNKELLAKNEGSIKRAVMELIAREKKDK

SEQ ID NO: 49229 - DNA, 754 bp, Zea mays
  misc_feature: Ceres CLONE 1460008-F
  misc_feature: Encodes the peptide sequence at SEQ ID NO. 49230
  misc_feature (556)..(556): n is a, c, t, g, unknown, or other
atagctggagctccccgcggtggcggccgctctagaactagtggatcccccgggctgcaggaattcgtctcacccctaatcgaaaactggctctccgtccgtttactcacacggtcacaccgcctcaactcgcgctgcccgtcgcccctcggttccgccggcgcgcgaggggattcgagctgggtcttgggtagcctctcaccgtctcacgatgccgccagcacccaagtccggcgacgccctcttcgccagcgtggatcgcgtcaatgcggagctgttcacgctcacgtacggcgccatcgtgcggcagttgctcacggatctggaggaggtcgaggaggtcaacaagcagctcgatcagatgggttacaacattggaacacgattggttgatgagttcttagcaaattcacccccatcaaggtgtgttgacttcaaggagactgccgatgttattgcgaagcttggcttcaaaatgttcttgggcgtgactgcaaccgtgaccaattgggatgctgaaggtacaagttgcagccttgtcctggaaacaaccctncttgttgattcgtcgagctccctgacacttgcccaaggccttcagtattgcaatttgttaagtggagttattaggggggcattggaaatggtgtctatgaaagcggaggtgacatgggtgcccgacatgcttcgcggggacaatgcctatgaaatgcgggtgaaactaacgcaagaagtgccggaggaatccccttca

SEQ ID NO: 49230 - protein, 181 aa, Zea mays
  misc_feature: Ceres CLONE 1460008-F
  misc_feature (22)..(172): Pfam Name: TRAPP_Bet3 Pfam Description: Transport protein particle (TRAPP) component, Bet3
MPPAPKSGDALFASVDRVNAELFTLTYGAIVRQLLTDLEEVEEVNKQLDQMGYNIGTRLVDEFLANSPPSRCVDFKETADVIAKLGFKMFLGVTATVTNWDAEGTSCSLVLETTLLVDSSSSLTLAQGLQYCNLLSGVIRGALEMVSMKAEVTWVPDMLRGDNAYEMRVKLTQEVPEESPS

SEQ ID NO: 49231 - DNA, 752 bp, Zea mays
  misc_feature: Ceres CLONE 1460009-F
  misc_feature: Encodes the peptide sequence at SEQ ID NO. 49232
aagctggagctccccgcggtggcggccgctctagaactagtggatcccccgggctgcaggaattcgtctcacccctaatcgaaaaaaaaaacccaaaaccctgcgaccccaagataccaaagccagcagcagaagccgatgcccatgcagccgcaggcgccatcgatgaccccggccgccggaatcaccacggagcagatccaaaagtatctggatgagaataagcagcttattttggccattttggaaaatcagaacctaggaaaattggcagaatgtgctcagtatcagtcacaacttcagaagaacctcttgtatctcgctgcaatcgcagatgcccaaccagagactgctgtaagccggcctcagatggcgccgcctggtgcatcgcctggagtagggcagtacatgtcacaggtgcctatgttcccgccgaggacacctctaacgccacagcagatgctggagcagcaacttcagcaacagcaagctcaattgctaaacttcagtggccaaatggttgctaggcctggcatggttaacggcatgcttcaggccatgcaagtccaacaagctcagccatcgccggtaatgaacagaccggatgctggtgggatcgcctcggagccctctggcactgagagccacaggactagcactggtggcgataatggcggtggaagcgactagtcccaagagtctttgaggattacgagctagccctggtaggtgcaaatatgcacgtatactgc

SEQ ID NO: 49232 - protein, 183 aa, Zea mays
  misc_feature: Ceres CLONE 1460009-F
  misc_feature (13)..(80): Pfam Name: SSXT Pfam Description: SSXT protein (N-terminal region)
MPMQPQAPSMTPAAGITTEQIQKYLDENKQLILAILENQNLGKLAECAQYQSQLQKNLLYLAAIADAQPETAVSRPQMAPPGASPGVGQYMSQVPMFPPRTPLTPQQMLEQQLQQQQAQLLNFSGQMVARPGMVNGMLQAMQVQQAQPSPVMNRPDAGGIASEPSGTESHRTSTGGDNGGGSD

SEQ ID NO: 49233 - DNA, 734 bp, Zea mays
  misc_feature: Ceres CLONE 1460013-F
  misc_feature: Encodes the peptide sequence at SEQ ID NO. 49234
  misc_feature (401)..(401): n is a, c, t, g, unknown, or other
  misc_feature (402)..(402): n is a, c, t, g, unknown, or other
tggagctccccgcggtggcggccgctctagaactagtggatcccccgggctgcaggaattcgcacgagaccattacctagaacatcctaatcgaaaaattttgtggacctatagcatattcccgtggtctccccccttttgctttgcttgccgagacggcgaccatggcgaagcagcagaatcctatccccatcccgatgccgctgtcgctgtcgctgcccctcgtcctcgtcgcgctgctcctgccggccgcccgcggcgccgcggagacgccgcagtacacgacggtgcacgcggagtcggacttcgaggtgcggctgtacggcgacaccgtctggatgtccgcccccaccccggacatcccttccttccacgtcgccaccaagctcgggctccacagnnatgtccagtacctgatgggcgcaaaccctcactcttcgaggacaggatgaccaccctgtgctccgagtgtggttccaggtgcaggccctctgcgctcctcggctactcgtccgggtgtactgccgggaagttcaagcttcccctcggttcctcccccgacttaaccggttcaaatcggggccaggcccctggcccaagcggagatttccgggccggccgggaaaaaaacgggccaagaaacaaaaccccccttgacccgaaccggccctggggtaccccaaaatcccccaaaggctttccgtgggcaaaaaaacccctccccttgtggggtg

SEQ ID NO: 49234 - protein, 95 aa, Zea mays
  misc_feature: Ceres CLONE 1460013-F
  misc_feature (79)..(79): Xaa is any aa, unknown, or other
  misc_feature (80)..(80): Xaa is any aa, unknown, or other
MAKQQNPIPIPMPLSLSLPLVLVALLLPAARGAAETPQYTTVHAESDFEVRLYGDTVWMSAPTPDIPSFHVATKLGLHXXVQYLMGANPHSSRTG

SEQ ID NO: 49235 - DNA, 726 bp, Zea mays
  misc_feature: Ceres CLONE 1460015-F
  misc_feature: Encodes the peptide sequence at SEQ ID NO. 49236
  misc_feature (453)..(453): n is a, c, t, g, unknown, or other
ctggagctccccgcggtggcggccgctctagaactagtggatcccccgggctgcaggaattcgcacgagaccattacctagaacatcctaatcgaaaaaccaaacaaaccgcgtccgcgtcgagtctctagtctctactctctcggctgtcctgtccggcgcggctctcgcgtctccaacctacccatgctgcagctcctccaactccaaggctcacaccaccccgcgacgggcgacgctaattaagtagagctgcaacacctgggttggaggctagagcttgcaaacaccaccagcgaaaacgtcgtggccagccatcccggtgtcgtcccgcgttctacagcctctgcatcccgcgttctacagccaccgctgttgtcgccgtcctagactcctagatccgtcagcttaacgagctccattccttcgcggccagccatcccggtgtctcancggcggcggcggcggcgtcaagctcttgctttctgtgggaggacgcatggcgatgtctgcggggcgtgggctcttggtcctcttcttctctgccgccgtattggctgaactcgcctcttgcccgaacggtcccttcctgtccggtacaacttctttgccccggggttcctgctggccgtttccctttcgggtttccaacctaaagggcgggtccgtttgcccccccgaaaaaatagggcttcccgtcaaggccggaattaaggggggacttgg

SEQ ID NO: 49236 - protein, 75 aa, Zea mays
  misc_feature: Ceres CLONE 1460015-F
MAMSAGRGLLVLFFSAAVLAELASCPNGPFLSGTTSLPRGSCWPFPFRVSNLKGGSVCPPEKIGLPVKAGIKGGL

SEQ ID NO: 49237 - DNA, 773 bp, Zea mays
  misc_feature: Ceres CLONE 1460024-F
  misc_feature: Encodes the peptide sequence at SEQ ID NO. 49238
ggagctccccgcggtggcggccgctctagaactagtggatcccccgggctgcaggaattcgcacgagaccattacctagaacatcctaatcgaaaaaatccctgaagtgcctgccaccacgccgcgccgcgcccgcgatacaacgacttcctgcagtcctgcgctgcgcccctcctttccgcctccacgctgccgacgtccaccacacagcacggtcgagtcacccgatccctccatggcggcggcggtggcggtcgcggctgccacgacggcggaggacgaggcgcgcctgctgcgtctggaggagcaggcggagcacggcggcggcggcgcctgggactacctcttcctcgcccgccgggtccgcgcccgccgccccgcccacgtcctccgcgtcggcctcgcacacctcaacaacgcctccgctcgctccggtctcgcctcagaacagtggacgctctaccagcaggtggccacggcggccatggattgccagcgtctcgatgtggcaaaggactgtattggagtcctttcgaagcaatttcctggcagcacccggggtggccgggctaaaagctcctccggtttgaagcgaaaagggaacgggctgaaacctgaaagaacttacacgcaaatcctgggaaatcaaaccatttgaccagattggtccacaagaggaaaatttgctaattgcaaaagcccaagggcaataatgtcccctagccaatgggcgtaatctcacaaaagcaatccgggtaattagttcaggggca

SEQ ID NO: 49238 - protein, 140 aa, Zea mays
  misc_feature: Ceres CLONE 1460024-F
MAAAVAVAAATTAEDEARLLRLEEQAEHGGGGAWDYLFLARRVRARRPAHVLRVGLAHLNNASARSGLASEQWTLYQQVATAAMDCQRLDVAKDCIGVLSKQFPGSTRGGRAKSSSGLKRKGNGLKPERTYTQILGNQTI

SEQ ID NO: 49239 - DNA, 727 bp, Zea mays
  misc_feature: Ceres CLONE 1460033-F
  misc_feature: Encodes the peptide sequence at SEQ ID NO. 49240
  misc_feature (490)..(490): n is a, c, t, g, unknown, or other
aaagctggagctccccgcggtggcggccgctctagaactagtggatcccccgggctgcaggaattcgcacgagaccattacctagaacatcctaatcgaaaaacctgaccaacctgagccatcacagagaagcgtccgctgcgcacacccaggtccttttcatctatctgtgagccgtcacaactcgtagtctcgtacagtatacttgcgcgccagccatgtcgtccatggtgtcccgagccgcggccgcggccgcgctgcggtgccacgtccgccgccccggtcccaccttctcccgccccgcctccacgtcggcggccaccgccgagcaccacgcgggccacagtagggccggcggcaggctcccccgcggcgactacgtgccggtgtacgtggcgctgggcctgatcgcgctgtcggtgacgctgggcctgcacacggcgcggcagcagcttgcgtacgcgcccacgtctgggtgggacaaaaaaancgggaaacggtgccggaaggtgccgccccggaacctgggcctgaaccaggccaaccaattcgggaaaggtccctttttcgcaggttccccaagtgggggagaaacggacccctcgcccccggggtccttaaccccctcccaaaaccccaacaaaaaaggggggaccctcaaggacgtgggtgggaaacctcgggattcaaaaggggagggggggcttttcccaaaaattttaaaaaa

SEQ ID NO: 49240 - protein, 169 aa, Zea mays
  misc_feature: Ceres CLONE 1460033-F
  misc_feature (91)..(91): Xaa is any aa, unknown, or other
MSSMVSRAAAAAALRCHVRRPGPTFSRPASTSAATAEHHAGHSRAGGRLPRGDYVPVYVALGLIALSVTLGLHTARQQLAYAPTSGWDKKXGKRCRKVPPRNLGLNQANQFGKGPFFAGSPSGGETDPSPPGSLTPSQNPNKKGGTLKDVGGKPRDSKGEGGLFPKILK

SEQ ID NO: 49241 - DNA, 763 bp, Zea mays
  misc_feature: Ceres CLONE 1460035-F
  misc_feature: Encodes the peptide sequence at SEQ ID NO. 49242
  misc_feature (361)..(361): n is a, c, t, g, unknown, or other
ctggagctccccgcggtggcggccgctctagaactagtggatcccccgggctgcaggaattcgcacgagaccattacctagaacatcctaatcgaaaaaagacgcaagaccacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggnacaggcaactatgccagtgcactgttcctcacagcagctaaatctaatgcattccccccccccgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggctgtcctggcggacaatggcaggctgaaatatattgaacgcattgcggagagatttgttgatttgactatgggaaataagggggagatgaaggttgtggtcaggacagttatttcactccccaggaagaggagaaagacctcaaggaaaccttgcaagatatcccttggggaaacaaatctt

SEQ ID NO: 49242 - protein, 188 aa, Zea mays
  misc_feature: Ceres CLONE 1460035-F
  misc_feature (56)..(188): Pfam Name: OSCP Pfam Description: ATP synthase delta (OSCP) subunit
  misc_feature: SWISSPROT Homolog: EC 3.6.3.14 H(+)-transporting two-sector ATPase
MAAARHLRSGLPLLRAHLASSESAAVAQVSRGFASQAAKPTGKEIKVPKALFGGTGNYASALFLTAAKSNAFPPPESEIKAIVEASKKSPLFSQFIKDLSVPKATRVKAIAEIFADAGFSDVTKNFLAVLADNGRLKYIERIAERFVDLTMGNKGEMKVVVRTVISLPRKRRKTSRKPCKISLGETNL

SEQ ID NO: 49243 - DNA, 715 bp, Zea mays
  misc_feature: Ceres CLONE 1460038-F
  misc_feature: Encodes the peptide sequence at SEQ ID NO. 49244
ctccccgcggtggcggccgctctagaactagtggatcccccgggctgcaggaattcgcacgagaccattacctagaacatcctaatcgaaaaacacagcgacaccgcgtggttcgttaggaaaggaaatcgatccccatctgatctcttcggtgctaaagaaatataggccgccgccgcctcctcattcggtgaaaggtgggcggttagggttgggagatctcttgactcacgacacgagcagcagaatttgtcgagggccgctggttgctgcgagggtccgtaccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaaagatatcagagaccacttcccgtcttcctcccgtggcctgtctgtcatctggctctgaaacgatggcagtcctgcaagttgctgctgctgcccctccccctgtctctgtgattgggttcgagggatttgagaagcgccttgaga

SEQ ID NO: 49244 - protein, 51 aa, Zea mays; identical to SEQ ID NO: 13325
  misc_feature: Ceres CLONE 1460038-F
  misc_feature (1)..(51): Pfam Name: AdoMetDC_leader Pfam Description: S-adenosyl-l-methionine decarboxylase leader peptide

SEQ ID NO: 49245 - DNA, 784 bp, Zea mays
  misc_feature: Ceres CLONE 1460042-F
  misc_feature: Encodes the peptide sequence at SEQ ID NO. 49246
  misc_feature (44)..(44): n is a, c, t, g, unknown, or other
  misc_feature (49)..(49): n is a, c, t, g, unknown, or other
  misc_feature (50)..(50): n is a, c, t, g, unknown, or other
  misc_feature (507)..(507): n is a, c, t, g, unknown, or other
gggggggggcaaccccccggaaacgaaatacacctaacccaacncgacnncaaaaccggcgctccccgcggtggcggccgctctataatagtggatcccccggggtgcaggagttcgcacgagaccattacctagaacatcctaatcgaaaaatgttacagcatcataaattcggaaccgatccgatcgccgcttgcgccgagctccatcaaattccgttctctgccggcgcgcgacggctcacacgaggaggcaggggagcagcatccacaaccacgagccatggcggggaggactaatatgcccactagcgaatccgccctcatcgcaaacatcgcccaggaggacacactcactggcttcttgatggccgcccgctgggaatggggatctgcgcaagagggccaagtacctcctcgtggaaagaagacgacgggtaaacaaaacagggaggcgtccaacccccccactgcaggggaggatattggtgttgtgctcatcatccancatactgacaacatgataagagggctggcggatacctacaacaaacctgcccctgctatggggggggagcccatgccaggggtcatgcatatgggccaccgcacgagttcagtgcggtctcggagggaaggacccctcctccccgggaaacccccgccccctcccacaaggggataaagagggatctcttggttgaggtaagtacccctttcgggcgcgtccccgcccctgaatcattgtaacttgaaaaaataagggggggaaggcctgtcctcaa

SEQ ID NO: 49246 - protein, 133 aa, Zea mays
  misc_feature: Ceres CLONE 1460042-F
  misc_feature: SWISSPROT Homolog: EC 3.6.3.14 H(+)-transporting two-sector ATPase
  misc_feature (75)..(75): Xaa is any aa, unknown, or other
MAGRTNMPTSESALIANIAQEDTLTGFLMAARWEWGSAQEGQVPPRGKKTTGKQNREASNPPTAGEDIGVVLIIXHTDNMIRGLADTYNKPAPAMGGEPMPGVMHMGHRTSSVRSRREGPLLPGKPPPPPTRG

SEQ ID NO: 49247 - DNA, 608 bp, Zea mays
  misc_feature: Ceres CLONE 1460046-F
  misc_feature: Encodes the peptide sequence at SEQ ID NO. 49248
aagctggagctccccgcggtggcggccgctctagaactagtggatcccccgggctgcaggaattcgcacgagaccattacctagaacatcctaatcgaaaaatacccttcccatttctcgtggcgcccacgggccacggccacgccgtagatctcctcctcgtcgcagggctccggcggtctcgccggcgtgagctgaagcgatggagctctggagcaagctgcgaaacctggatgcctacccgaaagtgaacgaggacttctacagccgcaccctctccggcggcctcatcaccatcctctcctccctcgccatcctcctcctcttcttctccgagatccgactttatctatattctgccacggaagtagctcactgttgatactcgagagggaaagacactatcattttgaggtaccgtcccggcccttcctgttctctagtgctgttgaacgatggaggtagtggaaagcacttttgaattaggcctggctaataagaaaagaatggcctcttgggaaggattggaaccgaaaaaccgggattggggcccccaaatttgaaaacctttcagaagctggggggtgggtttgccccccaagggtttt

SEQ ID NO: 49248 - protein, 59 aa, Zea mays
  misc_feature: Ceres CLONE 1460046-F
MELWSKLRNLDAYPKVNEDFYSRTLSGGLITILSSLAILLLFFSEIRLYLYSATEVAHC

SEQ ID NO: 49249 - DNA, 688 bp, Zea mays
  misc_feature: Ceres CLONE 1460053-F
  misc_feature: Encodes the peptide sequence at SEQ ID NO. 49250
gctctgaactagtggatcccccgggctgcaggaattcgcacgagaccattacctagaacatcctaatcggaaaactctgtgctagactgtcatcccttcctccttccccgcgcgtacacactcccgcggcggcagccaccatcccggagctcgagaccagcggcaccaggagggtgacgggccggcgactcagtcgagcaccactcccatggcggacaagatctccacgatcgtcctcaaggttgaccttgaatgcgagagatgctacaggaagatcagaaaagtcctctgcaagatccaagacaagatgaacatcaagacgatctcgttcgacgagaagagcaatgccgtgaccatctccgggccgttcgacgccaacaccccccccaacaagctctgctgcaaggctggccgggccatcaaggcgatggacgtcaagggcaaggacaaggacaaggacaaggacggcggcaaggccaaggagggcggcggcgacaagcccaaggacgccggcaaaccggcggcggccgagaaggacgcatgcaaggccggtaaggacggcggctccaaggcgtagaataaggaggagaaggccgagaaaaagaacgaggagaaaggcctataataaggaaggggggcaagggcgaccaggaggccaaaccggcggaaaagggcaacaaggacagga

SEQ ID NO: 49250 - protein, 122 aa, Zea mays
  misc_feature: Ceres CLONE 1460053-F
MADKISTIVLKVDLECERCYRKIRKVLCKIQDKMNIKTISFDEKSNAVTISGPFDANTPPNKLCCKAGRAIKAMDVKGKDKDKDKDGGKAKEGGGDKPKDAGKPAAAEKDACKAGKDGGSKA

SEQ ID NO: 49251 - DNA, 767 bp, Zea mays
  misc_feature: Ceres CLONE 1460054-F
  misc_feature: Encodes the peptide sequence at SEQ ID NO. 49252
aagctggagctccccgcggtggcggccgctctagaactagtggatcccccgggctgcaggaattcgcacgagaccattacctagaacatcctaatcgaaaaaccgtcaacggcggccgcgcgctcacgtcccggcggccacgggccgtgacagactcgagcccgtccgccgccttcgccgcgccgcctccgcctcctccatcgcacgccgactccgctgcctacatccgcgcacgtccgcctccactgcctccatccgctcgggagccgccgccctccgcgctaggcctcgcctccgtctggtctggattcttcgacatctggccatctgggcgctccgcgtcgccgacttctcgcaggcagagagtgagcatccttgatagacctgatggctatcgcagagagctgtgttgatgcggtggccatggagatggtggcagtctactgcggtggcctctacaccgccaaaccagagcttgctgcccgccgcatcgaggccatcggcttccaagtcgggcaccagctctctgagagatataccatggagcgccctcgatttagtgatcatcttgaagcaatcaagtttatctgcaaagatttttggtcagagctgttcaagaagcagattgacaatctgaaaacaaatcacaggggtacctttgtccttcaagataacccgttttcggtggcttactcgtgtttctctagatccacgtacagagaacacagaattcactgaaaaatgatctgcagcattgggtgatactg

SEQ ID NO: 49252 - protein, 116 aa, Zea mays
  misc_feature: Ceres CLONE 1460054-F
  misc_feature (7)..(112): Pfam Name: TRAPP_Bet3 Pfam Description: Transport protein particle (TRAPP) component, Bet3
MAIAESCVDAVAMEMVAVYCGGLYTAKPELAARRIEAIGFQVGHQLSERYTMERPRFSDHLEAIKFICKDFWSELFKKQIDNLKTNHRGTFVLQDNPFSVAYSCFSRSTYREHRIH

SEQ ID NO: 49253 - DNA, 697 bp, Zea mays
  misc_feature: Ceres CLONE 1460064-F
  misc_feature: Encodes the peptide sequence at SEQ ID NO. 49254
  misc_feature (568)..(568): n is a, c, t, g, unknown, or other
  misc_feature (671)..(671): n is a, c, t, g, unknown, or other
gcggtggcggccgctctataactagtggatcccccgggctgcaggaattcgcacgagaccattacctagaacatcctaatcgaaaagaaaatcgatttgtccatatttcacccggacactaccgtgtcgcccccgcgtcctaaacctctcacctcgccggggtccggtagccccgaacgatgttccgccgcgcgctcctctcctccgtctccccactccacggaacggtacgaatcccgacccccagctattctcctatccaagcccttctcgctcaatggatcaggtacgcctccgtggtctcatcctcggccccgccgccgccgccgccccctccatctccgcctcaaggtccatcgaggtcaagaggtggaggtcccactttgttgtccctgatccctgcagaggtcgccaagttcgcctccctcgcccagacctgatgagattcaagcggaccattcaaacctttgcatgtgatgaatcctacccgactgtcttttatcccctccactctctggagacctttaaggagggatcctaattcctctaagccacttgaagggctctnacttattcatgttcgaagtggcagggggattctgcccgaaccccttccacgtatgcgtgctccggttactgcacttgactcctgcactaataaaatatacagngtcccgctcttcctgcgggctgtggg

SEQ ID NO: 49254 - protein, 73 aa, Zea mays
  misc_feature: Ceres CLONE 1460064-F
  misc_feature: SWISSPROT Homolog: EC 2.1.1.114 Hexaprenyldihydroxybenzoate methyltransferase
  misc_feature (31)..(31): Xaa is any aa, unknown, or other
  misc_feature (65)..(65): Xaa is any aa, unknown, or other
MNPTRLSFIPSTLWRPLRRDPNSSKPLEGLXLIHVRSGRGILPEPLPRMRAPVTALDSCTNKIYXVPLFLRAV

SEQ ID NO: 49255 - DNA, 721 bp, Zea mays
  misc_feature: Ceres CLONE 1460065-F
  misc_feature: SWISSPROT Homolog: EC 2.7.7.7 DNA-directed DNA polymerase
  misc_feature (706)..(706): n is a, c, t, g, unknown, or other
aagctggagctccccgcggtggcggccgctctagaactagtggatcccccgggctgcaggaattcgcacgagaccattacctagaacatcctaatcgaaaatacttggcggctgcttgggttcctatcatttgctggtgcgccgtggaaagaagagagcagagcgccaaacgagaagggagaccgacgccttcgtgatctcatcactcctcccgccatgacgcgcggccgaaaaggtagagtacactatgactgcgttcggcgaggaggcggaggctaagatgaggagtaacctcggcacgcgattccccgcggctcgtatcacaaagataatagcgtgcggatgcaggatgttgcaaagattgcgctatgagttccagttttagtttctaggtctcttgaattgtatttacccgatttacttggtggcaattatcaacttactcttcgaagtggaccagacaccgggaattccttccacctgaaccagtgtgtgaagaggtacaattctattgatttcctacctgaagttgtccgccaggtaccacatattgctcgggctggttcctgtgcacatgaaagacgattacctagacacaggacgtggaacatgcaaacatcacccccagagtacgtgcgacggatccaggcagaggacgaggtctgccaccaaccaagagagaagaggttggttatgtacaatttgnagatgacagcacctt

SEQ ID NO: 49256 - DNA, 733 bp, Zea mays
  misc_feature: Ceres CLONE 1460067-F
  misc_feature: Encodes the peptide sequence at SEQ ID NO. 49257
  misc_feature (699)..(699): n is a, c, t, g, unknown, or other
atagctggagctccccgcggtggcggccgctctagaactagtggatcccccgggctgcaggaattcgcacgagaccattacctagaacatcctaatcgaaaacagagccttgtgtctccctttgcctctttttcttttctgctgtgttaatcccagctcgcagcccttccatgctcttgtcacatacactcgcagtcgcaggccggcctttgagctgagaccgccgagaggcacacagcacaggcaccaccgcaccagcccttgccgcgtataaaacgtctcgtgcgtaggcggcgccgcggcgactaggctgtccccgtggcactatattgggggttgcattatcaggcatccgaccgacggcatgaggaggaaagggagcgactgtacacggatcagcccagccgagatcacgcccatgatctccctgccgtccaggcggtccgcgggccggacggcgtcggcgccggaccgggaccgggaggaggagcgacctcggcaacggcgagtgcgaggcgcgtgcggctctcgcctgctgcggaccgcgcggtggacggccgcgcgcttctacaggcgagcgcgggtaagcatcgccagggcgtttcggcccccgtcgacgacggcggccaagagagcacaagcaggcgccggcgccgcttcgcccgactgcggcacgccggcgaagcggcgtagtagcangcggcagcagcagtcgtccgcgccgacgacggtc

SEQ ID NO: 49257 - protein, 123 aa, Zea mays
  misc_feature: Ceres CLONE 1460067-F
  misc_feature (112)..(112): Xaa is any aa, unknown, or other
MRRKGSDCTRISPAEITPMISLPSRRSAGRTASAPDRDREEERPRQRRVRGACGSRLLRTARWTAARFYRRARVSIARAFRPPSTTAAKRAQAGAGAASPDCGTPAKRRSSXRQQQSSAPTTV

SEQ ID NO: 49258 - DNA, 676 bp, Zea mays
  misc_feature: Ceres CLONE 1460068-F
  misc_feature: Encodes the peptide sequence at SEQ ID NO. 49259
  misc_feature (309)..(309): n is a, c, t, g, unknown, or other
tcgcacgagaccattacctagagcatcctaatcgaaaactcgggcggcgtcccggtctcaccgcgaccgggcggtgagaggtagaacggccaccagacatcaaccgtgaaggggtggcgtcaaggcagcgctgaagcggcggcgacgtcgaggctcgagctcccgtgccgcgctccgagctaacctagatgaacatactcgaaaggatacgtggaggtggcgacagggcggctgccacggagcgccccccgcggccggagtgctgggtggagatttcggagtccgtctcacggctctgcagtttagacnccgccggcagcggtagccgcagcatctctgtaaaagtccccccccgaccctagacctatacatgacaaacttgttgattctgtctcgaacaaatttttcccatcacgttatccatactagggtgaatgagggttacttcacttcaaccaaagtcggggtgctacagcgtttctcgagggctatggctcctgtgctcacaagacaggcctcgctggttgctgcaggctagccaacaacccccggctcatgcaacagccgcctgttcgacccttaaagaaggaatgcagcccgcaggaaaccccattttttaccagcatggctgctatgatgggaggctgaccctcaaagtgggtggatacttgttgac

SEQ ID NO: 49259 - protein, 57 aa, Zea mays
  misc_feature: Ceres CLONE 1460068-F
  misc_feature (41)..(41): Xaa is any aa, unknown, or other
MNILERIRGGGDRAAATERPPRPECWVEISESVSRLCSLDXAGSGSRSISVKVPPRP

SEQ ID NO: 49260 - DNA, 828 bp, Zea mays
  misc_feature: Ceres CLONE 1460070-F
  misc_feature: Translation starting site: 402
  misc_feature (20)..(20): n is a, c, t, g, unknown, or other
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (70)..(70): n is a, c, t, g, unknown, or other
  misc_feature (104)..(104): n is a, c, t, g, unknown, or other
  misc_feature (121)..(121): n is a, c, t, g, unknown, or other
  misc_feature (126)..(126): n is a, c, t, g, unknown, or other
  misc_feature (132)..(132): n is a, c, t, g, unknown, or other
  misc_feature (250)..(250): n is a, c, t, g, unknown, or other
  misc_feature (308)..(308): n is a, c, t, g, unknown, or other
  misc_feature (316)..(316): n is a, c, t, g, unknown, or other
  misc_feature (453)..(453): n is a, c, t, g, unknown, or other
  misc_feature (454)..(454): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (470)..(470): n is a, c, t, g, unknown, or other
  misc_feature (488)..(488): n is a, c, t, g, unknown, or other
  misc_feature (491)..(491): n is a, c, t, g, unknown, or other
  misc_feature (503)..(503): n is a, c, t, g, unknown, or other
  misc_feature (528)..(528): n is a, c, t, g, unknown, or other
  misc_feature (538)..(538): n is a, c, t, g, unknown, or other
  misc_feature (573)..(573): n is a, c, t, g, unknown, or other
cgaggggaacacaaaaaaancncccnncccccacacacaaataactaaacaccacgcggaggcggccgcnccagaacaaaggatcccccgggctgcaagaaacncacaaaaccatacctanaacanccaaancaaaaagccattcctcaaaatcggcgcccaactcgcaacccacaaagcgttgcgctccctctccaaccccaacaaaaccccaagggaaccctcatccccctgtcgtctcccttattgngggccaaacatggaaagcaagcaaagggggaagacgccccaggaggcggtgggcgcangcagcagncgccaagtggatctacatgaagaggatgacctgcaggagttccggctgaccatgggccaccgccccaccgagaacctcgacacggatgggtgtgagtaagcctctgtctacaaccagctcagcgggtggggaaagannccccccccccnnnaanaagatggggtggaaaacnggnaaggggataggnaagaaagaggaagggataataaaancaataaaagntgaaatgagagatggaaaattaggtgttgggaagnaagaggaagaagaattctttaaatttgaagagaatgtggaaagaaaagaatttgaatattgaatttggaggagaatgaggaacatataaaagaaacgggaaaaccgtgaacacaaaatcccgcaatggaagtcaaggaaatacaaaaagaggtcgtttatgcaacctcctgcataagctagaaaaggttggtaaagtggattttggaaggtaattttgcagccgaatatgagacagaaattgtatggaagggtgt

SEQ ID NO: 49261 - DNA, 700 bp, Zea mays
  misc_feature: Ceres CLONE 1460073-F
  misc_feature: Encodes the peptide sequence at SEQ ID NO. 49262
  misc_feature (406)..(406): n is a, c, t, g, unknown, or other
  misc_feature (426)..(426): n is a, c, t, g, unknown, or other
tcaccgcggtggcggccgctctataactagtggatcccccgggctgcaggaattcgcacgagaccattacctagaacatcctaatcgaaaaaaccaagcgcctccaaccaactcgccccggggaacagggaccatcgccacccccagttgcgttcgagattcctcagccgccccgccctttataagccaccgcaaccgcgaaccccggacgcaaccgcagcaaggcgttgggcgagtgagtgagtcagtgaggctgggatagcagcagcagcatcagtgcgccgcactcaacttctcttcttgccgtgcggtgcggcgcggcgcgaggaggcaccgcacggccgcaagcaatgccgcgccggcagaggacgcgcatcagcgaggagctcaaggcggaggacacccnccactcggtgctcaacttcngcggcgaggaggaggatggggaagaggagaagcaggaggccggcggggacggccagccggcggcggagttcaagtccaagaacctgtaggccgagcggaagcggcgcggcaagctcaaccgcaacatcctcgcgctcagggccgtggtgccgaacatcaccaagatgagcaaggagtccaccctctcggacgctatcgacctcatcaagaagctccagaaccaggtccttgagctgcagagccagctcgccgactcgcccggagaggcctggga

SEQ ID NO: 49262 - protein, 54 aa, Zea mays
  misc_feature: Ceres CLONE 1460073-F
  misc_feature (19)..(19): Xaa is any aa, unknown, or other
  misc_feature (26)..(26): Xaa is any aa, unknown, or other
MPRRQRTRISEELKAEDTXHSVLNFXGEEEDGEEEKQEAGGDGQPAAEFKSKNL

SEQ ID NO: 49263 - DNA, 717 bp, Zea mays
  misc_feature: Ceres CLONE 1460074-F
  misc_feature: Encodes the peptide sequence at SEQ ID NO. 49264
ctccccgcggtggcggccgctctagaactagtggatcccccgggctgcaggaattcgcacgagaccattacctagaacatcctaatcgaaaagagtcgcgatctccacctccctcgaccaccactcccgtaacccacttccgggtgggccccacgtcgccgctggcgaccagcacctcccctccttgactccctcgctacccgccgcccgccgagcagcatgaggaagaggaggtgctggtgccgtatggcccgcacctggagttgcccaatggagcgcagccaatggaaggacttcagtgatcttttggtacatcgctgctaatacaaacaacctacccaaactgcttttgtgaagtgaaaccaaaaaaggaggtgtgctactgttcttctgtattgatgtcaatgcaacagcaggtcgctgaaattgaaattgatgtctacaaagtgcttcccatttcattattagattactgatataactatgcctagagagtggagataagtggaggtggcaccaccaattccttgatgtaccaggaatgtttggattgttgtattctgacattgtttggttcaacatattcaagttggagcgtcaggtctccaacaattaaactaaatggaggagtggagcttcatgttgggatgatgcatgcacctttcaagtttcggaatgttgtgctcaaactgcacttgtggccgttgaacccattct

SEQ ID NO: 49264 - protein, 34 aa, Zea mays
  misc_feature: Ceres CLONE 1460074-F
MRKRRCWCRMARTWSCPMERSQWKDFSDLLVHRC

SEQ ID NO: 49265 - DNA, 697 bp, Zea mays
  misc_feature: Ceres CLONE 1460075-F
  misc_feature: Encodes the peptide sequence at SEQ ID NO. 49266
ctccccgcggtggcggccgctctagaactagtggatcccccgggctgcaggaattcgcacgagaccattacctagaacatcctaatcgaaaaaccgtctccgcacgccagaaccccaaaaccccagcggccagcaaaagcagcggcggcgcggccagggaccgacgtacccgccgcgagaagctccggttggcaccccaacggcatggatgctagcagcgtcagcccgtgcgatctagacagggagtttgcgctccaaatcgctcagctcctcgccacgcctcctctccaatcagcccaggaatactatggtgaactcatacggtccaagaagcttgatggcattagagtgagctacagtggcaagcatgggaaaggtgtttatgcaaatagggactttggtgaagacgaccttgttctgaaggaccaaatgttggtcggtgctcaggacagccttaacaagattgactgtgttgtgtgtagttactgcttccacttcattggttctatagagtaccaaattgggcgtagattgtatttgcaaagccttggtggtagtggtgatggcactaccgagagacactgccatgggagtgatgttgggtcaagtactggctgttccggtgcatcaaatggaaatagcaatgctgtgccacaagaggtcctgttgtcacttatggatggtaatacgctgttgc

SEQ ID NO: 49266 - protein, 164 aa, Zea mays
  misc_feature: Ceres CLONE 1460075-F
  misc_feature: SWISSPROT Homolog: EC 2.1.1.43 Histone-lysine N-methyltransferase
MDASSVSPCDLDREFALQIAQLLATPPLQSAQEYYGELIRSKKLDGIRVSYSGKHGKGVYANRDFGEDDLVLKDQMLVGAQDSLNKIDCVVCSYCFHFIGSIEYQIGRRLYLQSLGGSGDGTTERHCHGSDVGSSTGCSGASNGNSNAVPQEVLLSLMDGNTLL

SEQ ID NO: 49267 - DNA, 714 bp, Zea mays
  misc_feature: Ceres CLONE 1460077-F
  misc_feature: Translation starting site: 379
  misc_feature: SWISSPROT Homolog: EC 2.3.1.48 Histone acetyltransferase
ctccccgcggtggcggccgctctagaactagtggatcccccgggctgcaggaattcgcacgagaccattacctagaacatcctaatcgaaaaatgatgtccttgttttggagctcgcgctgcccgacgcccgtcgctgcgcccggagcgcagccatcgattcgccatttctttcccgccgccacactcccgcctcttcaactaccaaaatcccaaaagcctagctcgctaacaacccaaggcagaggcgccgccctcccctcccccatggggctcaagcagaaggacaccgacgcggccgccaccgtcaccggtaccaagaaccgccgccgacgtcttcttctccgacaccgatggtggtgttgaggcaaatgactgtatgaaactgtttctagaatggaatacacgcaaggtgatctctgtagacagcgctgctattcacacatatgagcctacccattttttcttggtgatatggaaaaatatgtggttacgaaactctcagcataaatgtgtggagagctgggaaatctttccatggagaggctgatgtctcatttgacgaaccatgtgatggagggaaaggcatagcagatctgagaccggttcttcaaaacatctcttggagggcacttgctatagaaagaggaaatcatgcatacgttttggacggaatgtgtacattgcataactgcggggaccactggtagtggtt

SEQ ID NO: 49268 - DNA, 827 bp, Zea mays
  misc_feature: Ceres CLONE 1460082-F
  misc_feature: Pfam Name: Chorismate_bind Pfam Description: chorismate binding enzyme
  misc_feature: SWISSPROT Homolog: EC 4.1.3.27 Anthranilate synthase
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (460)..(460): n is a, c, t, g, unknown, or other
  misc_feature (521)..(521): n is a, c, t, g, unknown, or other
  misc_feature (827)..(827): n is a, c, t, g, unknown, or other
acaaaagaaaannnccaaacanacnnnnnnnnccccnnnncaaaatactggagctccacgcggtggcggccgctcttcactagtggatcccccgggctgcaggtaattcgcacgagaccattacctagaacatcctaatcgaaaaatcgttgtccaagctaaagaacacatcttggccggtgacattttccaagttgttttaagccagcgttttgagagacggacattcgccgacccctttgaaatctatcgtgcattgcgcatcgtaaatcctagtccatatatggcctatctacaggcacgaggttgcattctcgtgccatcgagtcctgaaattcttacccgggtacaaaagaggacaataatcaatcgtccgcttgctgggaccataagaagaggcaaaacaaaagcagatgataaaactttagaacaattgcttttgagtgatgaaaatagtcgncccccccacactatgctagtaaatcttggccgaaatgatgttgggaaggtgcccaaaccangttcagtaaaggtagagaaattgatgaatatcgaacgatattctcatgtcatgcacatcagctcaacagtaactggagagctacgcgatgatcttacgtgttgggatgcgctactagcccgcattgccaagtgggaaccgttagtgggctctcccaaggttaccagcaattggattttggttgatccagcctcaaaagtggagtaatgcggtggggccagaataagcgggtggcttttgggaaggggatttcccttctctcggggccactcatgacaatttgcgtatgtcactatcttttccagtn

SEQ ID NO: 49269 - DNA, 892 bp, Zea mays
  misc_feature: Ceres CLONE 1460086-F
  misc_feature: Encodes the peptide sequence at SEQ ID NO. 49270
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (312)..(312): n is a, c, t, g, unknown, or other
  misc_feature (470)..(470): n is a, c, t, g, unknown, or other
  misc_feature (892)..(892): n is a, c, t, g, unknown, or other
aatccttcggccccgggatcnnccacnaaaaaaaacannnnnaaaatagctggagctccccgcggtggcggccgctctagaactagtggatcccccgggctgcaggaattcgcacgagaccattacctagaacatcctaatcgaaaaagatttcgccgcaaggggcaacggcacacccaccaactgacctgacccacgagggatccgcagatgaagatcattccggtcccttgcctggatgacaactatgcctacttaatcgtggacgagagcaccaagaaggcagcggccgttgaccctgtggaaccgganaaggttctcaaggcggccggcgaggtcggcgcctacgtcgactgcgttctcaccacccatcaccactgggatcatgctggtggaaatgagaagatgagggtgcaggtgccaaagataaaggtatttggaggatcccttggataatgtgcccccccccncacctgaacacgggggaaaatggaatggaagttgtcccttggggaacggacatttgagatactaaggccctacatatcgaccttggccgaattgaaagggccctattcagcctaactatggttaacctgagtacgggagggggtgaaagaaacccaggccggtcctcctacgcggaaaattaccttggttacatattgccggggcttgcgatgaaagtttatggcaagggttccctgtttgaacccaaagcgtctccccttctcctaattgggtacctttcgggttacgagttatcataaagcctcacccgtattctgccctgtagggaatggaacaaccatggtgtatataactcccgttccaacttgcgcgtgaacagtcggtggccacgtgtatttggactcacacaacactctaatcn

SEQ ID NO: 49270 - protein, 81 aa, Zea mays
  misc_feature: Ceres CLONE 1460086-F
  misc_feature: SWISSPROT Homolog: EC 3.1.2.6 Hydroxyacylglutathione hydrolase
  misc_feature (34)..(34): Xaa is any aa, unknown, or other
MKIIPVPCLDDNYAYLIVDESTKKAAAVDPVEPXKVLKAAGEVGAYVDCVLTTHHHWDHAGGNEKMRVQVPKIKVFGGSLG

SEQ ID NO: 49271 - DNA, 702 bp, Zea mays
  misc_feature: Ceres CLONE 1460090-F
  misc_feature: Encodes the peptide sequence at SEQ ID NO. 49272
  misc_feature (595)..(595): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaagtctgtctccagccaaagccaaaccaaccaaaagccctcgcgacgcgtcttcccggtagatccaccccctccgtaaataacccggtcgccgtctccacctcatcatccctgcagttgtggatcagttcgtcctccgtctctctccacaagtctcctctaggcgccaagcaatgacaaggtcagcaccgccggcctctcctccggcgccgaagcccgtgctgcgcgggagccagctggagcagctccgcgagatcttccggcgcttcgacatggacggcgacggcagcctgacgcagctggagctgggggcgctgctgcggtcgctgggcctgcgccccacgggggaggaggcccgcgcgctgctggcggccatggactccaacggcaacggcgcggtggagttcggcgagctggcggcccgcatcgcgccgctgctcaccacgcagacgcacctcgtcgaccaggcccagctctggggagtgtcgcgccttcnaacgcgacgcaaacgctacttctccgccgccaagctgcccgctccatgggncgcattggcagcccgttaccttcaaggactcaccccatgatgccgaccccaaccca

SEQ ID NO: 49272 - protein, 137 aa, Zea mays
  misc_feature: Ceres CLONE 1460090-F
  misc_feature (24)..(52): Pfam Name: efhand Pfam Description: EF hand
  misc_feature (108)..(108): Xaa is any aa, unknown, or other
  misc_feature (125)..(125): Xaa is any aa, unknown, or other
MTRSAPPASPPAPKPVLRGSQLEQLREIFRRFDMDGDGSLTQLELGALLRSLGLRPTGEEARALLAAMDSNGNGAVEFGELAARIAPLLTTQTHLVDQAQLWGVSRLXTRRKRYFSAAKLPAPWXALAARYLQGLTP

SEQ ID NO: 49273 - DNA, 698 bp, Zea mays
  misc_feature: Ceres CLONE 1460094-F
  misc_feature: Encodes the peptide sequence at SEQ ID NO. 49274
  misc_feature (428)..(428): n is a, c, t, g, unknown, or other
  misc_feature (478)..(478): n is a, c, t, g, unknown, or other
ggagctccccgcggtggcggccgctctagaactagtggatcccccgggctgcaggaattcgcacgagaccattacctagaacatcctaatcgaaaaactactctctctcgccccaaaaccagatcgccacgacaagggccgagggccccggaggggcgcgtagcaatggcggcaggctaccgggccgaggacgattacgattacctcttcaaggtggtcctgatcggcgactccggcgtcggcaagtccaacttgctctcacgcttcacgcgcaacgagttcagcctcgagtccaagtccaccatcggcgtcgagttcgccactcgctctctccaggtcgacggcaaggtcgtcaaggcccagatttgggacaccgccgggcaggaacgatacccgtgcatcactagtgcgtattacccgagcgctgntggggcgttgcttgaatatgacgtccctcggcactccacctttgaaaacnttaaccgttctgctgaagaacttagggaccccccgacccgaaaaaaggtggtttggctgggttggaaacaaattcgattccccccatcttggaccagttccaacccgacaagggaaaaccttccccaaaaaggggaatcctttactttctgggaaacccctcgccctttgggcccccccccctttggaaaaagttttttggaaaaacccccccccaaaac

SEQ ID NO: 49274 - protein, 177 aa, Zea mays
  misc_feature: Ceres CLONE 1460094-F
  misc_feature (16)..(159): Pfam Name: Ras Pfam Description: Ras family
  misc_feature (88)..(88): Xaa is any aa, unknown, or other
  misc_feature (105)..(105): Xaa is any aa, unknown, or other
MAAGYRAEDDYDYLFKVVLIGDSGVGKSNLLSRFTRNEFSLESKSTIGVEFATRSLQVDGKVVKAQIWDTAGQERYPCITSAYYPSAXGALLEYDVPRHSTFENXNRSAEELRDPPTRKKVVWLGWKQIRFPPSWTSSNPTRENLPQKGESFTFWETPRPLGPPPFGKSFLEKPPPK

SEQ ID NO: 49275 - DNA, 732 bp, Zea mays
  misc_feature: Ceres CLONE 1460095-F
  misc_feature: Encodes the peptide sequence at SEQ ID NO. 49276
atagctggagctccccgcggtggcggccgctctagaactagtggatcccccgggctgcaggaattcgcacgagaccattacctagaacatcctaatcgaaaaaggacatttcttgtatcgcctgcctccaggctccagcatgctcttgcatcagagtagggataaatggggggggggggagagcagtgggcaccaagtaggtcggtaggtatacgtgcacgtctcaccaacgcaacacaccgttgcctgtgaagcagcgcagcgcggagcggaagggtccagcgaccgcgactgatggggaggagcggcggcgagacggcggggaagaggcagcagttcgggagcatggaggagttctggggcttctacctgagccagcactccaagccgggcacgcggcggtggcacttcccccccacgctagcctcgctcgcctgcgcggtgctcgcggccgccactggccgcgccgcggtcctcctcgcgggccccgttctcgggtacggcatggcgtggtacagccacttcttcgtggagggcaaccgccccgccacgttcgtccaccccgtgtggtccttcctctgcgacctccgcatgttcctgctcatcctcaccggccgtatcgacgccgagctcgcacgcctccgcgtccggccgacggccgagtccaccgacgccgcggcggcctctgcgcaccatgactgatccgtatcctccatgctcgtctgtcttgcc

SEQ ID NO: 49276 - protein, 135 aa, Zea mays
  misc_feature: Ceres CLONE 1460095-F
MGRSGGETAGKRQQFGSMEEFWGFYLSQHSKPGTRRWHFPPTLASLACAVLAAATGRAAVLLAGPVLGYGMAWYSHFFVEGNRPATFVHPVWSFLCDLRMFLLILTGRIDAELARLRVRPTAESTDAAAASAHHD

SEQ ID NO: 49277 - DNA, 785 bp, Zea mays
  misc_feature: Ceres CLONE 1460098-F
  misc_feature: Encodes the peptide sequence at SEQ ID NO. 49278
  misc_feature (373)..(373): n is a, c, t, g, unknown, or other
  misc_feature (439)..(439): n is a, c, t, g, unknown, or other
  misc_feature (740)..(740): n is a, c, t, g, unknown, or other
ggagctccccgcggtggcggccgctctagaactagtggatcccccgggctgcaggaattcgcacgagaccattacctagaacatcctaatcgaaaaaccccgcgtcccaccaacttccattccctaccgcccgcccaccccactccactccgctcctcccactcgagccatcatggccctcgcctcccgcgccgccgcagccgccgtggcgtgcgtcctcctggcgctcgccgcctccgccgcgggggcgggctccaactcccctgcaccggcgccgtcggtggactgtatctcccaggccgccagcctgatcgactgcatcgactacgtccagaaggggagcagcgcgcgccgtccgtccgctgcctgctgncgcgaggtcaagaacgcaatggccaggcccgtcatccgtgggctggctctgctccctcgccgggtncaactccagtaacctgggcttcccatcaacatgaaaccggggctggggctccccggccgtgggggggggccaaagccccctttaagaagggaaaaatttccgggctttccccaaacgaaaaaccctgaccctcccccccccggggggaactaaaggggggggggggggggttttctcccggggcccggggggggaattctcccccaaaaaaacaaaccccccttggggggcggggggggccccccgggccccccaaaagggggggccccccttaggggggtttctttgcggggggggcccngggggaaagacaaccttttttttggggagcacacccaaatattgg

SEQ ID NO: 49278 - protein, 92 aa, Zea mays
  misc_feature: Ceres CLONE 1460098-F
  misc_feature (67)..(67): Xaa is any aa, unknown, or other
MALASRAAAAAVACVLLALAASAAGAGSNSPAPAPSVDCISQAASLIDCIDYVQKGSSARRPSAACXREVKNAMARPVIRGLALLPRRVQLQ

SEQ ID NO: 49279 - DNA, 714 bp, Zea mays
  misc_feature: Ceres CLONE 1460104-F
  misc_feature: Encodes the peptide sequence at SEQ ID NO. 49280
  misc_feature (374)..(374): n is a, c, t, g, unknown, or other
  misc_feature (414)..(414): n is a, c, t, g, unknown, or other
ctggagctccccgcggtggcggccgctctagaactagtggatcccccgggctgcaggaattcgcacgagaccattacctagaacatcctaatcgaaaaatctaaaaacgtaaatgcacacaaaactagggtttccaccccacccggcgtcaccctcatgagccagccgccacccccacgtccccacccatccgccagccccaggcttctagcctctgtcccagccggcagcccaccacccgcgaggccgcgaccggcgaccgcccgcccctgacgcggtgactgcgtcctcctccgctctccgtgcgccaccctgaagcggtgaggcggcgacctccaggcacctccctcccccggttcggtgggtccctcaangccttcctccccacgggttcagcagctcccgacccacacnaccaaaggccgattcgcgctcctccagccttcctcggcgtccaacagcaagtgaaaaacttcaacccagcaatggcgatgtcttggacaagagggttaaagcatggtgttgttccgaggcatgcccgtcaattggtagagagcagaagccttgcaattgcaagcaaggcgaaaaagggtggaaaggctgaggctggaaaaactcttggctctcacccaagagcttaaaaagtacaacagtggttcggggcgaaacatccttcaagggaggaggtcttaatcccaaaacccaaccgagacg

SEQ ID NO: 49280 - protein, 51 aa, Zea mays
  misc_feature: Ceres CLONE 1460104-F
MAMSWTRGLKHGVVPRHARQLVESRSLAIASKAKKGGKAEAGKTLGSHPRA

SEQ ID NO: 49281 - DNA, 801 bp, Zea mays
  misc_feature: Ceres CLONE 1460110-F
  misc_feature: Encodes the peptide sequence at SEQ ID NO. 49282
  misc_feature (417)..(417): n is a, c, t, g, unknown, or other
  misc_feature (444)..(444): n is a, c, t, g, unknown, or other
  misc_feature (461)..(461): n is a, c, t, g, unknown, or other
  misc_feature (467)..(467): n is a, c, t, g, unknown, or other
  misc_feature (484)..(484): n is a, c, t, g, unknown, or other
tggagctccccgcggtggcggccgctctagaactagtggatcccccgggctgcaggaattcgcacgagaccattacctagaacatcctaatcgaaaatcgccacatcgcagagccagagcaagggaagacgacgcagatctcgccacgcgaacacagttagatcgagggagtaagtgagagtgagagccatgacggagctgttcgacacggccgtgaccagcctcctccacctgccggaggtgctggaccgcctcgccgccgcagacggcgaccggcggtcggccggccaccacgcggcgcacggccacggccacggccacggccacggacgcgtccacggtctcggcgggcgcggagcgcctgtggacatcgtggagagcccccgcgagtacgccttcgtgctcgacccgcccggnctcctccagtcagacatccaggtgacnctggaggaaggacgggntgctgntgatgaaaggccggcanccgggaagcgaaacccccatgaggaggaggacttggaccggcgaagggggcccatccctcccggttggaaccggggcccggcccccccggtccttttcgggcgcaatttcgggttgcccggaaaatcgggaaaccgggggggggtttggggcccgcttcaaaaaagggggggctcccccccccccgcaaaaaaaatcgcccccccccgaaaaaaaagagcaaaccacggtggggtccccctcccctaaaaaatgggggggggcgccccccggagaaaaacaccccatttaaatttgtcccggccaaataggggccgg

SEQ ID NO: 49282 - protein, 180 aa, Zea mays
  misc_feature: Ceres CLONE 1460110-F
  misc_feature (91)..(91): Xaa is any aa, unknown, or other
  misc_feature (93)..(93): Xaa is any aa, unknown, or other
  misc_feature (99)..(99): Xaa is any aa, unknown, or other
MTELFDTAVTSLLHLPEVLDRLAAADGDRRSAGHHAAHGHGHGHGHGRVHGLGGRGAPVDIVESPREYAFVLDPPGLLQSDIQVTLEEGRXAXDERPAXGKRNPHEEEDLDRRRGPIPPGWNRGPAPPVLFGRNFGLPGKSGNRGGVWGPLQKRGGSPPPAKKIAPPRKKRANHGGVPLP

SEQ ID NO: 49283 - DNA, 764 bp, Zea mays
  misc_feature: Ceres CLONE 1460117-F
  misc_feature: Encodes the peptide sequence at SEQ ID NO. 49284
  misc_feature (58)..(58): n is a, c, t, g, unknown, or other
  misc_feature (466)..(466): n is a, c, t, g, unknown, or other
  misc_feature (512)..(512): n is a, c, t, g, unknown, or other
  misc_feature (517)..(517): n is a, c, t, g, unknown, or other
  misc_feature (616)..(616): n is a, c, t, g, unknown, or other
  misc_feature (617)..(617): n is a, c, t, g, unknown, or other
  misc_feature (648)..(648): n is a, c, t, g, unknown, or other
gctccccgcggtggcggccgctctagaactagtggatcccccgggctgcaggaattcncacgagaccattacctagaacatcctaatcgaaaaactgctagcaacggaacggagcgcaacgcaatcatgtcaggcgcgcaaggagctcagccgaagggcgccttcacggcgaccacctacacgtcggctgcggccaccggtggcggcgcggcccaggggcaggggcaggggcaagaggaccaggagagaaggcagactccgcggacggagctccggtcggccgaggacgagcgcgggctgcctgtcaggaagctggaggacgcggtcgaggatgccgcgggcaagggcgggtcggtgtttggtgccgggagggaggacgggaagcctgatctctgggttattccccccccgggctgatgctagcccggaagggccttcttaaatgtggctgtttagtttaactaancgagtcagaaaggtgaaagtaccagggatggggtccggcacaccgnaccgnaccaaccggttcacccgggttatacgttctttaattgaaagcgttaaaatttgaagagcgcttttaaaaaaagtgcaagaaaaaaaaaagagtatattnnaaacccgctcaaccccccaaagggagagatnggggaacccaaatgccgccctaataaggaagaccctgaaatcctcccgcccctcataagggcccgcccccttttaccacacccactttgaatagagagacaaactcctcccccctc

SEQ ID NO: 49284 - protein, 96 aa, Zea mays
  misc_feature: Ceres CLONE 1460117-F
MSGAQGAQPKGAFTATTYTSAAATGGGAAQGQGQGQEDQERRQTPRTELRSAEDERGLPVRKLEDAVEDAAGKGGSVFGAGREDGKPDLWVIPPPG

SEQ ID NO: 49285 - DNA, 775 bp, Zea mays
  misc_feature: Ceres CLONE 1460121-F
  misc_feature: Encodes the peptide sequence at SEQ ID NO. 49286
aagctggagctccccgcggtggcggccgctctataactagtggatcccccgggctgcaggaattcgcacgagaccattacctagaacatcctaatcgaaaaaagacgcgaccgacccaggcaggcaccactccgctcaacgcaccgggcggcacccaaatcccaaaccctagcacacgcaccatggcggcgcagcagaagatccggtggggggagctggaggaggacgatggcggggacctcgatttcctcctcccgccccgcgtcgtcgtcggacccgacgagaacggcctcaagaaggtcatcgagtaccgcttcgacgacgacggcaacaaggtccgggtcacgaccaccacccgcgtccgcaaactcgctcgggcgcgcctctcccgcagcgccatcgagcgccgccagacccctaagtttggggacgccctcaaggaggacgccggctccaggctcaccatggtctccaccgaggagatcctcctcgagcgcccccgcgccccagggagcaaagctgaagagtcagctgcatctggtgatccgctggctatggcgagcaaaggaggtgctgttctcatgttttgcagaacctgtggggagaaggcgatcactggaccctcaagtgtccgtacaaggacctggcacaccgaactgaaattttcacggacaggcctccacgtccagaggcccctcctgccccaggtggtcctggctaaggagcaaatgttccctcaaccatgaaaaggaggggctgaaaggactgggaaacc

SEQ ID NO: 49286 - protein, 187 aa, Zea mays
  misc_feature: Ceres CLONE 1460121-F
MAAQQKIRWGELEEDDGGDLDFLLPPRVVVGPDENGLKKVIEYRFDDDGNKVRVTTTTRVRKLARARLSRSAIERRQTPKFGDALKEDAGSRLTMVSTEEILLERPRAPGSKAEESAASGDPLAMASKGGAVLMFCRTCGEKAITGPSSVRTRTWHTELKFSRTGLHVQRPLLPQVVLAKEQMFPQP

SEQ ID NO: 49287 - DNA, 715 bp, Zea mays
  misc_feature: Ceres CLONE 1460126-F
  misc_feature: Encodes the peptide sequence at SEQ ID NO. 49288
  misc_feature (60)..(60): n is a, c, t, g, unknown, or other
  misc_feature (370)..(370): n is a, c, t, g, unknown, or other
  misc_feature (492)..(492): n is a, c, t, g, unknown, or other
ggagctccccgcggtggcggccgctctatactagtggatcccccgggctgcatgtattcncacgagaccattacctagaacatcctaatcgaaaaatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtaccgcgggaggaaggtgggggccaggacggaggtgcggtacntgtagggcgacggcgaggtgcatgagctcggccgcctctccgtcgccgagtacaaccggcagctccgagaaggtggcggcggcggcggcaggctcgagttcggcagggtggtggcggcgcancggcaggtggtgtcggggctcaagtactaccctccgcgttctggccgtggaggagggcggcgcgaggaaccggcggcaagcgcgtgttcaacgccgtcgtcgtcgtcaagccctgactcgactcgcgcaccctgctcacgttcgcgccggcggccgccaagtaagcgcggcgctacgcccggttgtaaacgtcaagggtaatatctcgggtctggccttctcg

SEQ ID NO: 49288 - protein, 56 aa, Zea mays
  misc_feature: Ceres CLONE 1460126-F
MARALGACVLLAVLLGALAPAAAARAHDDQGSGAGIRQPSGEYRGRKVGARTEVRY

SEQ ID NO: 49289 - DNA, 758 bp, Zea mays
  misc_feature: Ceres CLONE 1460130-F
  misc_feature: Encodes the peptide sequence at SEQ ID NO. 49290
  misc_feature (363)..(363): n is a, c, t, g, unknown, or other
  misc_feature (436)..(436): n is a, c, t, g, unknown, or other
aagctggagctccccgcggtggcggccgctctataactagtggatcccccgggctgcaggaattcgcacgagaccattacctagaacatcctaatcgaaaaaaaacaaaaaaaatctcaattctcaaagtcgtcgatccagcggtagcagcgcacaaaccgatcgatctaggagagggagacaaccaaccaatttcatcgccgatcaaacaaggaaaaagatcccggccatggccacgcggtcgctggagctgacgctgatctcgggcaaggacctcaaggacgtgaacctgatgtccaggatggaggtctacgccgtggtgtcgctctccggcgacccccggtcgcggcagcgggtccaggncgaccgtaccggcggccgcaacccgacctggaacgccacgctccgcttccccgtcccggccaccggcgccggntccctccacgtcctcctccgcgccgagcgcgccctcggcgaccgcgacgtcggcgaggtccacatcccgctgtccgagctcctctccggcgcccccgacggccccgtccccgcccagttcgtcgcctaccaggtgcgcaagatctcctcgggcaagcccaggaagtcctcacctggtcgtacaggccggggaggtcgcaacggttacgccccttcggctaggccaagctccaacgaacgcgggtaccggctccttcggaaagctgaagccaagccgctcccgcgcgaacccgctccttcgggaaggccaccgtaccccccct

SEQ ID NO: 49290 - protein, 176 aa, Zea mays
  misc_feature: Ceres CLONE 1460130-F
  misc_feature (6)..(90): Pfam Name: C2 Pfam Description: C2 domain
  misc_feature (45)..(45): Xaa is any aa, unknown, or other
MATRSLELTLISGKDLKDVNLMSRMEVYAVVSLSGDPRSRQRVQXDRTGGRNPTWNATLRFPVPATGAGSLHVLLRAERALGDRDVGEVHIPLSELLSGAPDGPVPAQFVAYQVRKISSGKPRKSSPGRTGRGGRNGYAPSARPSSNERGYRLLRKAEAKPLPREPAPSGRPPYPP

SEQ ID NO: 49291 - DNA, 758 bp, Zea mays
  misc_feature: Ceres CLONE 1460134-F
  misc_feature: Encodes the peptide sequence at SEQ ID NO. 49292
  misc_feature (493)..(493): n is a, c, t, g, unknown, or other
  misc_feature (591)..(591): n is a, c, t, g, unknown, or other
  misc_feature (648)..(648): n is a, c, t, g, unknown, or other
ggagctccccgcggtggcggccgctctagaactagtggatcccccgggctgcaggaattcacacgagaccattacctagaacatcctaatcgaaaaattcccttttgctcgcgcacgcgctcgtctctccaagcctcgaaccgcatctccggcggcctagtggaacgcgaagatggcgacggcgctcggcctcggtgcgcgctccggcctccgactcctgtccgcaggcgccgaggccgcctcagcaacgtcttctcgtgcattccattctactggcacaaggaggatgggggcgcacgctcatgatgagccatactacgtccacgccaagcacatgtacaacctgcacaggatgaagcaccagcagcttaaggtgtgcctcgctgtgctggctgcggtgggcactggcattggagtccctgtgtatgctgttgttttccagcagaagaagactgcatctgcataatctgaaacgccgaagcggcacgacatngaaacatgcctgccccgtgaatttctttttccattttccacatagcattttgagaggttcaggctggagcttcagttttgcttggccaattctctctnatatattttttttccctcttgctgcagggttactctgctcattggattttgacatangaataccgatgtctgttaaatatacgatgtcttgaactgacaaaaacatatgctgttattttttctaaaaaaaaaaaaaaaagcttatcggtacggtcgacctcgagggg

SEQ ID NO: 49292 - protein, 97 aa, Zea mays; identical to SEQ ID NO: 32167
  misc_feature: Ceres CLONE 1460134-F

SEQ ID NO: 49293 - DNA, 904 bp, Zea mays
  misc_feature: Ceres CLONE 1460137-F
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (36)..(36): n is a, c, t, g, unknown, or other
  misc_feature (495)..(495): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (800)..(800): n is a, c, t, g, unknown, or other
agggaaggcccccctaacaacacgaannnnnccncncccaaaacccccaaagtggggctccccgcgggggcggccgctctagactagtggatcccccgggctgcaggagttcgcacgagaccattacctagaacatcctaatcgaaaaacatcgattcgcctcctccgctctttactcttcgtcgtactcgtctccccccacccgcaaccgcagggagagaagggggaagcccgccgccgccccggcccccagtaaccagcagatcgggacctctgttctgcgcaatccatccatggcggaggagtcgggccgtcccttgccaaagttttggtgaatgggatgtcaaacgatccgggtttccgcagacggggttacttgtcgtattcaaccaagcccaaatattgagaaggagggggggggaatgggtttaagattaaaaactcaactttcaaagggacccaagatatggagaagggcgagaccccacccccccnaaaaaaacaaaacagagaagaaatggggggttgggtgggggggaacgggccagcccctttggggggtggggggggggggcccacccccccannnaaaaggggaaagagggggcgccgtgaagtttttttgagggaatctatgccgcctagaaagactgggggaaaggcgcccgcgggggggtctcttggggggcgccgcgggggggggggggggcaacaaaacacacccgggggcgccggatggtctagtgtttggtgggggagagggtggaggcgggtagcgagttgtgggggggcgcgggatngctttgtgagtaagatgattgagggcgcccgggcgggtggtttgttttggttaagagagacagaaaggagcgatttttcttcgtcggggcggggcgtgtggggg

SEQ ID NO: 49294 - DNA, 588 bp, Zea mays
  misc_feature: Ceres CLONE 1460140-F
  misc_feature: Encodes the peptide sequence at SEQ ID NO. 49295
  misc_feature (40)..(40): n is a, c, t, g, unknown, or other
  misc_feature (53)..(53): n is a, c, t, g, unknown, or other
aaagctggagctccccgcggtggcggccgctctagaactnagtggatcccccngggctgcaggaattcgcacgagaccattacctagaacatcctaatcgaaaagcagaccgcaccctgtcggcgagctcgctcccgttcccgtccgctgctctccgctcgacgccgccgtcttccgcgcagctagtgtctacactcccggcgacgatggcggaggacttggttttggacacggcgatccgagactgggtcctgatcccgctctccgtgttatggtcctcatcggcgtgctccgctactttgtctccaaggtcatggggttccccggggaacttttccgtttcccgaccccaagtttgttaaggaagggcaggggggccttcgggggaggaaacctggggcccaaccccaattctttcccggggaggggttttcgggggggcggggggtttttttcccccccgcgggaaaaggggtttttttttgttctccaaggaaaaaccccccaaaaggccccggcccccctttttttttttaaaaaaaagggcccttggtttttaaaaaaaaaaaaaccccttttttttgtttc

SEQ ID NO: 49295 - protein, 51 aa, Zea mays
  misc_feature: Ceres CLONE 1460140-F
MAEDLVLDTAIRDWVLIPLSVLWSSSACSATLSPRSWGSPGNFSVSRPQVC

SEQ ID NO: 49296 - DNA, 746 bp, Zea mays
  misc_feature: Ceres CLONE 1460141-F
  misc_feature: Encodes the peptide sequence at SEQ ID NO. 49297
  misc_feature (391)..(391): n is a, c, t, g, unknown, or other
ggagctccccgcggtggcggccgctctagaactagtggatcccccgggctgcaggaattcgcacgagaccattacctagaacatcctaatcgaaaaaaataaataaactcaaaaaccaggaactattacttttcgccgaagaagaagattccctctctaacctacgtcgataaatctacgagggagcttgaccttgagcaacagagagagatgggtttcttctcgtttcttggaagagttctcttcgcttctcttttcatcctctccgcttggcaaatgttcaatgactttggagttgatggtggtcctgcagctacagagctggctccaaagcttcatctggccaagtcacatctatcttctaggttaggtgtaactttgcctagcgtanaggtaaaacaagtcgttgctgctataattgcattaaaaggagttggaggcttactctttgttatcggaaacatcttcggtgcttatcttctggctgtctaccttgcggttttcagtcctattctgtatgatttctacaactacggacctgaggagcgtcatttctctctattgttgactgagttcttgcagagcgtggcactctttggagcatacctctctttattggaatgagaactcacaccccccaagaggatctggagaggaccctaagcccaagctgcttagaacttttttttttaggaactttggtccggacaaatcgctcctaacacttgggttttcttgggtggggg

SEQ ID NO: 49297 - protein, 137 aa, Zea mays
  misc_feature: Ceres CLONE 1460141-F
  misc_feature (1)..(138): Pfam Name: HR_lesion Pfam Description: HR-like lesion-inducing
  misc_feature (61)..(61): Xaa is any aa, unknown, or other
MGFFSFLGRVLFASLFILSAWQMFNDFGVDGGPAATELAPKLHLAKSHLSSRLGVTLPSVXVKQVVAAIIALKGVGGLLFVIGNIFGAYLLAVYLAVFSPILYDFYNYGPEERHFSLLLTEFLQSVALFGAYLSLLE

SEQ ID NO: 49298 - DNA, 706 bp, Zea mays
  misc_feature: Ceres CLONE 1460145-F
  misc_feature: Encodes the peptide sequence at SEQ ID NO. 49299
tggagctccccgcggtggcggccgctctagaactagtggatcccccgggctgcaggaattcgcacgagaccattacctagaacatcctaatcgaaaagtagcgcaccaatcccatcctccacccaatcgaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagttgaatgaagtaccctggaactgtggaagttcgtcttttacttcttaagctgctgatagacttcaaataaaattctggtccaaaaaaactttctggtgagcgtacatgtttgcccccacacctgttgtaatttgaccaaatccctcagattg

SEQ ID NO: 49299 - protein, 104 aa, Zea mays
  misc_feature: Ceres CLONE 1460145-F
MVRKAKVEFDEQPPDNFDPKNPYADPVAMLEYREHLVREKWIQIETAKIIRERLRWCYRIEGINHHQKCRHLVDQYLEATRGVGWGKDARPPELHEPKKTVKAE

SEQ ID NO: 49300 - DNA, 826 bp, Zea mays
  misc_feature: Ceres CLONE 1460148-F
  misc_feature: Encodes the peptide sequence at SEQ ID NO. 49301
  misc_feature (396)..(396): n is a, c, t, g, unknown, or other
  misc_feature (397)..(397): n is a, c, t, g, unknown, or other
  misc_feature (401)..(401): n is a, c, t, g, unknown, or other
  misc_feature (714)..(714): n is a, c, t, g, unknown, or other
  misc_feature (731)..(731): n is a, c, t, g, unknown, or other
  misc_feature (744)..(744): n is a, c, t, g, unknown, or other
  misc_feature (769)..(769): n is a, c, t, g, unknown, or other
  misc_feature (819)..(819): n is a, c, t, g, unknown, or other
acgagctggagctccccgcggtggcggccgctctatactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctgggatgcaggctcttcccatgccggcgtgcttccttccggcgcgccggcagggagcgacctggaacctgctctggctggccccctgggggggggagggcccagnnatanaacaatccgcccccacccccgaaaagaaataggggaaaaatacacagggacccggggaaggaagcgaaggaccccccccgggaaccccaagggacccccccgaaaagaatgcccggggaaaaaaaaaaacaggggccaaagaaaaggcccgccccctggggaaaaaaaaggttcgggttggccaaaaaggggcccaagcacccaaaaaaggtgtgggcgaaaaacacccccaaaacgcgctcccccggtgagaggggctgcgggaaaaaaaatacccctccccgcgcccgcgatgtccgaccaacaaggtggnaaccacacgatatatgnccacaagggcganaaacacgacccccacacgctcgcgnggggtcgcgaacggccccaacctcccccgcgcgggtgggtcggcgcaganttttaaa

SEQ ID NO: 49301 - protein, 74 aa, Zea mays
  misc_feature: Ceres CLONE 1460148-F
  misc_feature (63)..(63): Xaa is any aa, unknown, or other
  misc_feature (65)..(65): Xaa is any aa, unknown, or other
MSRLMAAMLLGGARVAGAAKLTGNGNAAGMQALPMPACFLPARRQGATWNLLWLAPWGGEGPXIXQSAPTPEKK

SEQ ID NO: 49302 - DNA, 714 bp, Zea mays
  misc_feature: Ceres CLONE 1460152-F
  misc_feature (413)..(413): n is a, c, t, g, unknown, or other
aagctggagctccccgcggtggcggccgctctagaactagtggatcccccgggctgcaggaattcgcacgagaccattaccctagaacatcctaatcgaaaacccacccttgcgcttgcttcccctcgtcctcggcggctcctcctttgaccaccaactccggcggcgccgtacgtcgcagccgcacgccacccggaaatacctacatggggcgaccggcgcgctcccgttctccagccacagagccgcctccggcggtcaccggccttcgctcctccaagatctcctttcgctcccgtaagatcgtcaagacagcatccgcgaaacctttggccacgaccgccctggcactagcgccgcaggcgcctccgcctccagtgcttcctgcgctgtcgtcccccggagagcttgcngccgcgctgcgccacctccaagccgcggaccctctcctcaccgcggtcattgccaacactgaggcgcccaccttcaccgccacaccctccctccccgcgttccactccctcgcgcgctccatcctataccagcagctcgcgacctccgctgcggacgccatctacgcacgcttccttgcgctcctcccctctggctcggcggcggccgcagccgtagccgctgacgcggtcacacctgccgccgtccttgccctcgccgccgctgacctgcgtaccatcggcgtatctggcgccaagcatc

SEQ ID NO: 49303 - DNA, 782 bp, Zea mays
  misc_feature: Ceres CLONE 1460153-F
  misc_feature (366)..(366): n is a, c, t, g, unknown, or other
  misc_feature (403)..(403): n is a, c, t, g, unknown, or other
  misc_feature (438)..(438): n is a, c, t, g, unknown, or other
tggagctccccgcggtggcggccgctctagaactagtggatcccccgggctgcaggaattcgcacgagaccattacctagaacatcctaatcgaaaagtaactaacccgcgaggtcgacgcggattttcttctttataccgcgggcaggcggactgggcggctgacggagccgcggagggaaccgagtggccccggcgacgcgaggccgaggcgagctaatctgacggcggcagtgacgactccaacgaccaggcgcggaggctgcactgctccagcgaaggcaccatgtcattcatgtctccattcccggggatggatctaaagtaaatggatcccgggactctgaccctccttgggcagctggntgtgtaatgctgactatgcatttcactgtgcattggntgtcccaacatctcttctattggaaaaaactcaanggagcagaaagcctaacttattaatggggctgaaaggctccctaaaaccctatcccttcctttcggggggtcttcttggaatcccagggaaaccaagacattttttccccattcctaaaagcgtgtaaaaaaagcgctaagggccccggggaatctccaaaattttgggcgcttggggtccccccccttttaaaatttttcttcccaaaaaaaaatttcccctgaaaaaaaacaaaggggggggggcttccccaacctcccccccgggttttctttttctccccccccccagtgtgtgtgtgtgggccaaacaaaaatgaaccccttccgaaagatgggccccc

SEQ ID NO: 49304 - DNA, 788 bp, Zea mays
  misc_feature: Ceres CLONE 1460154-F
  misc_feature: Encodes the peptide sequence at SEQ ID NO. 49305
  misc_feature (426)..(426): n is a, c, t, g, unknown, or other
ggagctcaccgcggtggcggccgctctagaactagtggatcccccgggctgcaggaattcgcacgagaccattacctagaacatcctaatcgaaaaactcacgattggagtttcacctcggcagcccagccagccgggggttcctcggctcggaggaacaggcgaacagcaagagcttctgaagatgaaggcgatccccgtggctctcctgctcctcgtcctggttgctgccgcctcctcgttcaagcatctcgccgaggcaccaaacggcggctcggtgccggacggcgtgtgcgacgggaagtgccgcagccggtgctcgctgaaaaatgccgggcggtgcatgggcctgtgcatgaggtggtgggccacatgccagggctgcttttccctcttgaccctaatcctaaccttcctcctactgcnccttgttaaagcggaccatgacgaccccccaagaaaacccgccgcccccaggtggccccttgggcccctacccgttcttacggggaggggaggaatgaaccccagtgattttcgtctcgccgactcctggcaccggcttcctaagtccttgggacctgctaggtttaaggccgtgccggagcggttgtgaatgggccgggagcgggcccccttcccatggattgggtgggcgcgcggggttattccccccggccgcggccgcttctcctagggtacatcgcaccccaaccgcgcccggcactccggggtgccttcggcctctctcggcacgattgacgcgcggggcaagtgggttgttgggt

SEQ ID NO: 49305 - protein, 143 aa, Zea mays
  misc_feature: Ceres CLONE 1460154-F
  misc_feature (81)..(81): Xaa is any aa, unknown, or other
MKAIPVALLLLVLVAAASSFKHLAEAPNGGSVPDGVCDGKCRSRCSLKNAGRCMGLCMRWWATCQGCFSLLTLILTFLLLXLVKADHDDPPRKPAAPRWPLGPLPVLTGRGGMNPSDFRLADSWHRLPKSLGPARFKAVPERL

SEQ ID NO: 49306 - DNA, 747 bp, Zea mays
  misc_feature: Ceres CLONE 1460155-F
  misc_feature: Encodes the peptide sequence at SEQ ID NO. 49307
tggagctcaccgcggtggcggccgctctagaactagtggatcccccgggctgcaggaattcgcacgagaccattacctagaacatcctaatcgaaaagagttagaaaatcagaacgttgggccaactctcgagatcccatttaaatctctcttctttgattgatctccccctcatcttcaataaactagccgttacatctctctctctctcactctctctaaaccctatttctattttacctccatcacaatggctgcttctgtagaaactccatcacctaatcatactaacaaggaaagtggaagcttgatcatggtttctgaatcttctccatcctctgacaagcgtctctggagcagtcttcgaaacaggatagatgttcttctcgatgaaaagagcaaagaccacaaacccatctctaactccccattgtaactcaaaagagtgttggagagtcagagagagcaaagaggttgaagagtgattcaatgcttttgcttaaagggtttgactctgtttctcatactctctctcagctttccagtaatctcgacaatgctcttcagggagttagagaattagctaagccacctacattgtctgagatactccactccaatctcaaagctgatcaaatacaacatgaacagagagaggaagaagaagaggagagtaaagggaagaagagacacacgaatctgatgctgaagtaaaagaagattcatcggatgaagatggaagagacc

SEQ ID NO: 49307 - protein, 74 aa, Zea mays
  misc_feature: Ceres CLONE 1460155-F
MLLLKGFDSVSHTLSQLSSNLDNALQGVRELAKPPTLSEILHSNLKADQIQHEQREEEEEESKGKKRHTNLMLK

SEQ ID NO: 49308 - DNA, 707 bp, Zea mays
  misc_feature: Ceres CLONE 1460156-F
  misc_feature: Encodes the peptide sequence at SEQ ID NO. 49309
  misc_feature (410)..(410): n is a, c, t, g, unknown, or other
  misc_feature (707)..(707): n is a, c, t, g, unknown, or other
ggagctccccgcggtggcggccgctctagaactagtggatcccccgggctgcaggaattcgcacgagaccattacctagaacatcctaatcgaaaaattccgtccctgctcagtcacacctcgctctcgctcactctcgccgtcgcagccgctcctccctcctcgtctcccactgcctgccctctccctgtcgccggctggtgccccgacgcgccatgtcgtacaacaaggccccgtccatcaccgccgagaccataaatcccagggtcaagatcatcagatacgcgccttgcggggagatcgtcaagcacgcatcgcggctggagcaggagatagaggagaaccctgcttctatccctttccaagagataatatactgcaacctcgggaacccccaggtcctcccccanccgccactaactttctttcgtgaggttctctccctgtgcgacaacccagccctcatggacagagatgaagctcgtgccttattcagcccttgtagcataagaagggccaggaggatcctaaactcgatccccaacaaagacactggtggatatactgattgccggggaatcaaatgcctgcgtcaagtagtagcagatgggattaccgcaagagacggttttccatcgacagcggacgatatctttctgacaaatggagccacctcaccgatcaacttgatgatgcagaaactcatn

SEQ ID NO: 49309 - protein, 163 aa, Zea mays
  misc_feature: Ceres CLONE 1460156-F
  misc_feature: SWISSPROT Homolog: EC 2.6.1.2 Alanine transaminase
  misc_feature (65)..(65): Xaa is any aa, unknown, or other
MSYNKAPSITAETINPRVKIIRYAPCGEIVKHASRLEQEIEENPASIPFQEIIYCNLGNPQVLPXPPLTFFREVLSLCDNPALMDRDEARALFSPCSIRRARRILNSIPNKDTGGYTDCRGIKCLRQVVADGITARDGFPSTADDIFLTNGATSPINLMMQKL

SEQ ID NO: 49310 - DNA, 757 bp, Zea mays
  misc_feature: Ceres CLONE 1460157-F
  misc_feature: Encodes the peptide sequence at SEQ ID NO. 49311
  misc_feature (654)..(654): n is a, c, t, g, unknown, or other
tggagctccccgcggtggcggccgctctagaactagtggatcccccgggctgcaggaattcgacgagaccattacctagaacatcctaatcgaaaaataatccacacgccgccgtctttctaaacttcgccatccatttttcatatcctcactcgccgccgccgccgctcgtccctcgccccatcgcgatggcccggatcaaggtgcacgagctgcgggggaagagcaaggcggatctgcaagcgcagcttaaggagtttaagtcggagctctccctgctacgcgtagccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctcccgctcgacctccgccccaagaagacccgcgccatccgcaggcgcctcaccaagcaccagctctccttgaagaccgagagggaaaagaagcgtgagaagtatttccccatgaggaagtacgctatcaaggcctagatcagtgaaagaacatttatcctgtcaagttttgctcagaagttacttgaatttgagacaaatctatctccatccaagtactatgtagctgatncactgcatgatgaaaaacgagtactttttgcttgtttaaacgtgctttacattttcagtttccactttatcacatggaatgaatagtagtgatcgaaaaaaaa

SEQ ID NO: 49311 - protein, 123 aa, Zea mays
  misc_feature: Ceres CLONE 1460157-F
  misc_feature (6)..(64): Pfam Name: Ribosomal_L29 Pfam Description: Ribosomal L29 protein
MARIKVHELRGKSKADLQAQLKEFKSELSLLRVAKVTGGAPNKLSKIKVVRTSIARVLTVISQKQKSALREAYKKKKLLPLDLRPKKTRAIRRRLTKHQLSLKTEREKKREKYFPMRKYAIKA

SEQ ID NO: 49312 - DNA, 741 bp, Zea mays
  misc_feature: Ceres CLONE 1460162-F
  misc_feature: Translation starting site: 267
  misc_feature (362)..(362): n is a, c, t, g, unknown, or other
  misc_feature (363)..(363): n is a, c, t, g, unknown, or other
  misc_feature (480)..(480): n is a, c, t, g, unknown, or other
ggagctccccgcggtggcggccgctctagaactagtggatcccccgggctgcaggaattcgcacgagaccattacctagaacatcctaatcgaaaaaactcctctctccgctgttgctctcttcccgtcgcgctttctcctcgtgcggctactgggtaaccgccgccgctgccgccctacgccaggttctcaggtcattgtcagtccccttacttcgccggctcattcggcggcgacgagcaccagaaatcctagctgctttgagtatggaggcgctgtttgggtgcaacaaacatggcggggacaaggccgctgattttgcctcgtttataatcgtgcaggctgccttggaggtgccaggnntacttggctccttgccatgattctcataatgaatctttacatccggtggagatcagaatttgattaataggatctgagcaaaaacaaaatggcactgatttcaagaacaggatgatngaaagtctgatgatgttaatgatgagagggaaaccattaggattcttaaaaccaaaaaaattatgtgggttataaggatcctattcctttggtattggggggaaattcccccccccttttatccctccccccccccaacggggaaggggaaatgcccccaatttattttggggggagggtaaaaaggggtgttttcccccccctttttgggggattgggcacctgggaaaaattgggggaaaaaaaagaaaaagtttttct

SEQ ID NO: 49313 - DNA, 761 bp, Zea mays
  misc_feature: Ceres CLONE 1460164-F
  misc_feature (364)..(364): n is a, c, t, g, unknown, or other
  misc_feature (405)..(405): n is a, c, t, g, unknown, or other
atagtggagctccccgcggtggcggccgctctagaactagtggatcccccgggctgcaggaattcgcacgagaccattacctagaacatcctaatcgaaaaatatttcttccgcattgacggtggggcccgacgccggccacaccgccacagagagaaacgttaggacagactgactggttgagaattgagaaccaaaagaagagagaggaagacaggaagagagagagagagcgcgcgcttccaggtttttagctgcaggggaggccgatagttctgttctactggaggaggagcagagagcaagatggggtccggatctttcctcaaggtgctggccaagaacttcgatgtccttgttgggncactcatatcacgggcgggggccgctatatgcttctgttanaatttttacccacccccaatcctgtagatgatcagcagtggctcacttactgggtgttgaactcatttgtcactttgtttgagctaacttttgctccaattatcgagtggcttcccttttggtcatatgcaaaactgttctttaactgctggttggacttaccttggttcaacggcgctgcttatgtttacgaccattttgtgcggccaatgtttgtgaaccgccgaaaagggaacatatggtatgccccaagaaatgagaaaccaggtaaatccgaagatgtgctgtcatgctgcaaagagaatttttggaccacatggccctgaaacatttggaaaggtccatcagcaactcct

SEQ ID NO: 49314 - DNA, 728 bp, Zea mays
  misc_feature: Ceres CLONE 1460165-F
  misc_feature: Encodes the peptide sequence at SEQ ID NO. 49315
  misc_feature (366)..(366): n is a, c, t, g, unknown, or other
  misc_feature (421)..(421): n is a, c, t, g, unknown, or other
  misc_feature (428)..(428): n is a, c, t, g, unknown, or other
  misc_feature (437)..(437): n is a, c, t, g, unknown, or other
acccgcggtggcggccgctctagaactagtggatcccccgggctgcaggaattcgcacgagaccattacctagaacatcctaatcgaaaactatcgactggcgacgactgcgccaccgccgccgctctacgcgagacgcccaggtcttcgccaacgacgagcatccgggttagagaggaagaaattgcaaccgaaacaatggcggcagattccggcgctcgcagacagccaagcttcaccaaggtcgaccagctgcgccctggaacccacggccacaacctcatcctcaaggttgttgactccaagatggtcatccagagaggccgcgagggaggagggccccagggaagacagatgaggattgcngagtgcttggtgggtgatgaaaccggcatcatttgtctcactggcagaaacgatncagtggnatgtattangccctggaaccactggtgaacttgagaaacgcaagatcgacctggttcagggttcaatgcggcttgcaatggacaaggtggggaattgtcaaacctgctgaaggctcaacctgatggacaggcaaggaggacaacacctgttctttattgatttgaacctggggacgggaaccgaatgaaaaccccctgcctaaaaaattggggggtttccggggggggaaaccaatccctctccccaaccaaaaggccccggggttgagtttccccccccaaaattcgatatggggcccc

SEQ ID NO: 49315 - protein, 85 aa, Zea mays
  misc_feature: Ceres CLONE 1460165-F
  misc_feature (75)..(75): Xaa is any aa, unknown, or other
  misc_feature (77)..(77): Xaa is any aa, unknown, or other
  misc_feature (80)..(80): Xaa is any aa, unknown, or other
MAADSGARRQPSFTKVDQLRPGTHGHNLILKVVDSKMVIQRGREGGGPQGRQMRIAECLVGDETGIICLTGRNDXVXCIXPWNHW

SEQ ID NO: 49316 - DNA, 702 bp, Zea mays
  misc_feature: Ceres CLONE 1460169-F
  misc_feature: Encodes the peptide sequence at SEQ ID NO. 49317
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
ggagctccccgcggtggcggccgctctagaactagtggatccaccgggctgcaggaattcgcacgagaccattacctagaacatcctaatcgaaaaagtcttgcaggctacagcccctgcggcaccagagggagcggccgcggcagggcgtcctcgtcgccgcggcagggcgctagggcaggcaggcatgcgctgatggaattcacggcccaggagggggaggagcccgtctcggaggagatgggcgcgagctccgcgccgccgccctgcctcggccccggccgcggcccggggaaccagaaccacgccgccgaggcgacgtaccacgagtgtctgcgcaaccacgcggcggcgctgggcggacacgtcgtcgatggctgcggcgagttcatgcccgaggacgcccaccccctcaagtgcgcagcctgcggctgccacccactcaccgaagggaccggggcccacagtctgtgccccggctgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 49317 - protein, 97 aa, Zea mays
  misc_feature: Ceres CLONE 1460169-F
  misc_feature (38)..(86): Pfam Name: ZF-HD_dimer Pfam Description: ZF-HD protein dimerisation region
MEFTAQEGEEPVSEEMGASSAPPPCLGPGRGPGNQNHAAEATYHECLRNHAAALGGHVVDGCGEFMPEDAHPLKCAACGCHPLTEGTGAHSLCPGCS

SEQ ID NO: 49318 - DNA, 803 bp, Zea mays
  misc_feature: Ceres CLONE 1460178-F
  misc_feature: Encodes the peptide sequence at SEQ ID NO. 49319
  misc_feature (328)..(328): n is a, c, t, g, unknown, or other
  misc_feature (337)..(337): n is a, c, t, g, unknown, or other
  misc_feature (372)..(372): n is a, c, t, g, unknown, or other
ctccccgcggtggcggccgctctagaactagtggatcccccgggctgcaggaattcgcacgagaccattacctagaacatcctaatcgaaaaatccagtctccgtgtccagtcgagtctcagcaaggaagatgtgggggagaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttncaggacggncagactctccccacccgcaaaggtatatcactccnattagatcagtggaagatatttgaggggacacatcaagcccataatgaggcccatcgaggaaatacatgatggggagccgccaagcagtcacgtgacgggcgagcttttgcttccttccctgttgaaggcctgattttccgaaataattttttgttggccctttggggcgcgggttgctttttggcccttttacacccctcctttttaaagtgggcccccatggccaaaggtttttgttttccccccgggtctaaaaaaaaattaaacgcgcggaggggggaaaaaatttctccctttttttttgttgcacaaaaacgttttgtgtgtgggcgcaaaaaattattttggaaaagaggccctttttttctttcttctttaaaaaaaaaaaaaattttttttcccccccccccggggggggcggggctctctc

SEQ ID NO: 49319 - protein, 103 aa, Zea mays
  misc_feature: Ceres CLONE 1460178-F
  misc_feature (10)..(99): Pfam Name: PC4 Pfam Description: Transcriptional Coactivator p15 (PC4)
  misc_feature (66)..(66): Xaa is any aa, unknown, or other
  misc_feature (81)..(81): Xaa is any aa, unknown, or other
MWGRGKKRFGGGGSGEPAAKRQAARDDGPSESAEDGTVVAEISKNKKVSVRSWKGRVFVDLREFYXQDGQTLPTRKGISLXLDQWKIFEGTHQAHNEAHRGNT

SEQ ID NO: 49320 - DNA, 866 bp, Zea mays
  misc_feature: Ceres CLONE 1460180-F
  misc_feature: Encodes the peptide sequence at SEQ ID NO. 49321
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (381)..(381): n is a, c, t, g, unknown, or other
  misc_feature (469)..(469): n is a, c, t, g, unknown, or other
  misc_feature (476)..(476): n is a, c, t, g, unknown, or other
  misc_feature (489)..(489): n is a, c, t, g, unknown, or other
attctttttccccttccccaaaaacnnnnngnncaaaaaaaacaaaataaaggagctccccgcggtggcggccgctctaaaataatgtatcccccgggctggaggagttcgcacgagaccattacctataacatcctaatcgaaaaatcaggtcgttctaggctaaccataggcacacacacgcctaaacgctcgcgatgtgctcctcctccttgttcttcttccacgccgatgcggtctgagactacgagactagcctgctgtccactatgaaggcgtgcgcgctctgggcagagcaggtgggacgtgactgcgacctcttcctgtccccaggggacacgcccttctgcttcaaggagtgccccggcgagaacatgcgantcaacgccgctcgcgctaggatgtcgggttgttcgcctcaaggagaccaagtgagattagttagttattataatggaccctcccccanacccaanaaacaaatgcagnaaccactgcccccgtgactcccgagccggacaccagcagggggacccttatcccccaaagttttcttaactctacgaaacttccaatggaaacggggttggctgagtgggatattccaattttctggggttgcttgtatgcccccgcctggagaacttagcccaaaagtttgttggtcgaccttgtctttcgggggatagacgtacctccaagaaccaagagggcacatctacaccgtgagcaataaagatatccccaggacatctcaaaaaccccttttgcctgttgaccctttggacaaaacgagtgaaggaaattctcccccattatttcccttcggcactaccggtttgtatgaggagtagtaacactctgtt

SEQ ID NO: 49321 - protein, 78 aa, Zea mays
  misc_feature: Ceres CLONE 1460180-F
  misc_feature (38)..(38): Xaa is any aa, unknown, or other
  misc_feature (67)..(67): Xaa is any aa, unknown, or other
  misc_feature (69)..(69): Xaa is any aa, unknown, or other
  misc_feature (74)..(74): Xaa is any aa, unknown, or other
MKACALWAEQVGRDCDLFLSPGDTPFCFKECPGENMRXNAARARMSGCSPQGDQVRLVSYYNGPSPXPXKQMQXPLPP

SEQ ID NO: 49322 - DNA, 829 bp, Zea mays
  misc_feature: Ceres CLONE 1460187-F
  misc_feature: Encodes the peptide sequence at SEQ ID NO. 49323
  misc_feature (347)..(347): n is a, c, t, g, unknown, or other
  misc_feature (357)..(357): n is a, c, t, g, unknown, or other
  misc_feature (553)..(553): n is a, c, t, g, unknown, or other
aagctggagctccccgcggtggcggccgctctagaactagtggatcccccgggctgcaggaattcgcacgagaccattacctagaacatcctaatcgaaagaactccgaaacaaagcaatcacccgagcaaagcagtgcggagagacgatccagcggcatttcgcattcgacgaacgaagcgccgccatctgatccgacacgcagcgcaatggcggcgggactgaagaggccgtcgttcgggacgcgggcgtggcggctgctgcggctggcggtgctgtgggcgcggaagggcggcgcggcgcacagcctgcgcctggcgctggctcgcacgctccgcccgcacggncacgggctcnccggcctgggcggcgcgccgcgcaaccggctccgctgcggcgagcgcgagtaccccatcgacgagacgccggcggtcccggttccggcccccgtccggggggggtttccgcttattccctggatcgggccgggcgggccggaaaccccgggccttttagggagaaaactgtttattttttagcccccccccccccntggggaaaaagggaagggcccccggggcttctctccgcccccctcccttttttggggggggagagccaaaaaagcccacatctcctccccaaaaagaaaaaattcctttgaagcgcggggggggagagagcctccccccaaaaatttccgggaagggggggggggagaaaacaaaaacaaaaaacacccggggtgggaaaaaggggaaaaaaaatttctcccgttctccctcacaacaaaaaaaagccgcgcccctatttgtgggtggtaaaaaaa

SEQ ID NO: 49323 - protein, 109 aa, Zea mays
  misc_feature: Ceres CLONE 1460187-F
  misc_feature (50)..(50): Xaa is any aa, unknown, or other
MAAGLKRPSFGTRAWRLLRLAVLWARKGGAAHSLRLALARTLRPHGHGLXGLGGAPRNRLRCGEREYPIDETPAVPVPAPVRGGFPLIPWIGPGGPETPGLLGRKLFIF

SEQ ID NO: 49324 - DNA, 791 bp, Zea mays
  misc_feature: Ceres CLONE 1460188-F
  misc_feature (294)..(294): n is a, c, t, g, unknown, or other
aaagctggagctccccgcggtggcggccgctctagaactagtggatcccccgggctgcaggaattcgcacgagaccattacctagaacatcctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcngcggcggtgagctgcggcgaggtgacgtcgtcggtggcgccgtgccctcggtacgcgatgggcagcgcggcgtcgccctcccgcgcgtgctgcagcggggtgcgctcgctcaacaccgcgcgtcgtcaacggcggacggggagccacctgcaactgcctaaaaacttgacggccgggtcgggggggggtcaaaatggcaaagcccccaaaatcccggggaagggggggttccccgcggggggcccataccccccccgtgaaggggccaataaattttttttgtggccccggggggagggcccccccccccccccccctgggagagggaggggggcccaaaaaaggggggccgccccccgcccccaaaaaaaaacaacacaggggggggccccacaagggggggtggggaaaaaaaaaaaaaaaaaaccccccccttttttttttttttccccccctcctttgtgggggccccccccccccctcctgggaagagagga

SEQ ID NO: 49325 - DNA, 765 bp, Zea mays
  misc_feature: Ceres CLONE 1460202-F
  misc_feature: Encodes the peptide sequence at SEQ ID NO. 49326
  misc_feature (398)..(398): n is a, c, t, g, unknown, or other
aagctggagctccccgcggtggcggccgctctagaactagtggatcccccgggctgcaggaattcgcacgagaccattacctagaacatcctaatcgaaaagaggccatcatccttcgcgcgaattagccgctcagcgaccgggattcaagcttactggctgcagggttgcgatcagatgaggggcgcaacaaggcgtctggtgcagagcgcaaccaaaaccaggcaaatcaatcctgtcaatggactagcaaggatgccggcgatcactactcctcagaggcatgggaacgagaatacttccagtgaatctgtcgtcacgaaagacgaaaacgttgagcccccttgtcgccttcagcaggccacctcctttgccccgctgtctgggtccgctcgccntgctctcggtttcccacattcgtccggtggcggcaacaaaaacccccaatgaggcaccaatgggcccccagggaaattacttttggggtggcggtaaagttgcccgttcaacccttgggaattaggttccccagagggggtgattttccctgagccgccccaatttggccttgggaaactccacaccacaaaaaaagggtcggggtactttacaaaaggggggtgttggaaaaaaaaaaaaaaaaacttttttctaccccccccccccggggggggccgcggccccaatttccccataaggggccaaatataccccgccccggcgcgccgtttttaaaccgcggggggggaaaccccgtgtctaccc

SEQ ID NO: 49326 - protein, 90 aa, Zea mays
  misc_feature: Ceres CLONE 1460202-F
  misc_feature (74)..(74): Xaa is any aa, unknown, or other
MRGATRRLVQSATKTRQINPVNGLARMPAITTPQRHGNENTSSESVVTKDENVEPPCRLQQATSFAPLSGSARXALGFPHSSGGGNKNPQ

SEQ ID NO: 49327 - DNA, 769 bp, Zea mays
  misc_feature: Ceres CLONE 1460208-F
  misc_feature: Encodes the peptide sequence at SEQ ID NO. 49328
  misc_feature (425)..(425): n is a, c, t, g, unknown, or other
  misc_feature (427)..(427): n is a, c, t, g, unknown, or other
  misc_feature (436)..(436): n is a, c, t, g, unknown, or other
  misc_feature (444)..(444): n is a, c, t, g, unknown, or other
ctggagctccccgcggtggcggccgctctagaactagtggatcccccgggctgcaggaattcgcacgagaccattacctagaacatcctaatcgaaaaactagatcaccaactggaaaaaataacacgcacgcaagaggagaaaacaatccgcaaatcggcgctcggcttccgtcctttccgtgcctccgccgatccgccgcaaccgcgtcgtccgtccccccgttcggtcgccgccctctttcccgcctcccttctcggcctccgtcctcctccgcgtccgcggcctcctcctcgtgcttcatgtctgcgctcttcaacttccactcgtttgtgacggtggtgctgctgctgatctgcacttgcacgtacctcaagatgcacttccccctccctcctcatccgccggacaggggtccgtggttncnttttggaanggtgctangaataggtgaacgccttaccccctggtaacccttggggggctctggggaggggcatatcatttttatttttggtgaaatggaaaatttgattggccttctttggttacaattccccccttaaaaaagcctccaaattttggcgtgtccggccggaattctcaaagggccccagggttgaaacctgtgacccggggggaaattagggggcaagggtaccctttttgaaattgggcccccccctggttttgggttttttttgggtgggccccggccacaaaaaggggggtgggggaaaaaaaaaaaaaaaaatctccgcgcccgccc

SEQ ID NO: 49328 - protein, 56 aa, Zea mays
  misc_feature: Ceres CLONE 1460208-F
  misc_feature (2)..(56): Pfam Name: DUF1242 Pfam Description: Protein of unknown function (DUF1242)
  misc_feature (41)..(41): Xaa is any aa, unknown, or other
  misc_feature (42)..(42): Xaa is any aa, unknown, or other
  misc_feature (45)..(45): Xaa is any aa, unknown, or other
  misc_feature (48)..(48): Xaa is any aa, unknown, or other
MSALFNFHSFVTVVLLLICTCTYLKMHFPLPPHPPDRGPWXXFGXVLXIGERLTPW

SEQ ID NO: 49329 - DNA, 753 bp, Zea mays
  misc_feature: Ceres CLONE 1460209-F
  misc_feature: Encodes the peptide sequence at SEQ ID NO. 49330
ggagctccccgcggtggcggccgctctagaactagtggatcccccgggctgcaggaattcgcacgagaccattacctagaacatcctaatcgaaaactttatgtacctcttgcacacaatacagatgacccaaaggcaaagctacagagcacagttttcacaaatgcgtcctgttgcaatggaaccttcagtaggtcctcacatgcccatgtatccacctagagttcttaggatacgtcagcatctgttttatggacagccacctccagagcttcatcaaccctcatgctgaatttgcttaccagaaacctatgatgactgttatgaagactggcggtccaatgccgaactttatgatgcctatggttcatgaaggacagcaaccccaacgtcctgctcgtacgcgtgctgcgcccccaccaatgcaacaacccatgccaatgggtactcagcaacaggaatgctgtatcattcttggcatttttcatttttgatctgcgaactgcgcctagaaatttctgaatggctgtatatattccctataggaggccgtggataccgatatgctactggacgtggagtgcctgatcctcgcaagcatcatgtaggtgctgtgatgccctctccttatgagatcgtagggatggcaatgagacatgctggggtatcacaacctgttccaattgaagaactagccactgcttttgctaactcctcaccagatcatcaaagactgatgcctgcatgagacgt

SEQ ID NO: 49330 - protein, 95 aa, Zea mays
  misc_feature: Ceres CLONE 1460209-F
MLYHSWHFSFLICELRLEISEWLYIFPIGGRGYRYATGRGVPDPRKHHVGAVMPSPYEIVGMAMRHAGVSQPVPIEELATAFANSSPDHQRLMPA

SEQ ID NO: 49331 - DNA, 813 bp, Zea mays
  misc_feature: Ceres CLONE 1460211-F
  misc_feature: Encodes the peptide sequence at SEQ ID NO. 49332
  misc_feature (476)..(476): n is a, c, t, g, unknown, or other
aaagctggagctccccgcggtggcggccgctctataactagtggatcccccgggctgcaggaattcgcacgagaccattacctagaacatcctaatcgaaaactttatcagtagtagtcatcactgagtagactgcagagcaggaggagatgttcacttacgtgctcgcggccgccgccgtgcttatcgtgttcctctacgccgtcgaagcagcaacagcaagctccctccgtcgcccccgtcgctgccgctgatcggccacctccaacgcggtggtcactcgcgcggccaccaggggccgccggggcaacagcaggatgtgctgccggacgcggcgctgatggtgggcttccaaccgcaggatgtgctgccggacgcgccagcgaggtttgtgagatgggcgacgggccctgataagaagctcgccgacatggccgaggcgtgggacaggttgctgtccgagatggtggccgcgnacaaggaagggaccggggcgcccgccaccccaggggaagaagatgaggaattcttggaacctgctgctgccgctttaggaaaaataggcccgatggggctccaagccccaaaccaacgcctcaaagggttcctcaaagaacttataaggcgtgggggctaaaaacacccctccaacccttgaaagggcccggggttccttggaaaaactttatacccccccggggggggagggccatccctaaggaaaaaatcccgggggggggcccccccaataccccccccctctcgaaagggagttccgggggaggtggttccccaaaaagcaccaggtttttt

SEQ ID NO: 49332 - protein, 98 aa, Zea mays
  misc_feature: Ceres CLONE 1460211-F
  misc_feature (46)..(46): Xaa is any aa, unknown, or other
MVGFQPQDVLPDAPARFVRWATGPDKKLADMAEAWDRLLSEMVAAXKEGTGAPATPGEEDEEFLEPAAAALGKIGPMGLQAPNQRLKGFLKELIRRGG

SEQ ID NO: 49333 - DNA, 747 bp, Zea mays
  misc_feature: Ceres CLONE 1460212-F
  misc_feature: Translation starting site: 286
aaagctggagctccccgcggtggcggccgctctataactagtggatcccccgggctgcaggaattcgcacgagaccattacctagaacatcctaatcgaaaaatggtctaggtttttgattcccagcagcagcggcattcccatccacaccccggtcggctagtcccaaggctgctgccgccgcctgccgctaggggatcgcttgctttcctcggaccactctgccgaccacatctacaccgcatcaacggtccttccaagtgagctccaatcccctgtctgtagatggagagggtgctaaaggatgacgccgtcgaggagaagggcgagcgcgccaggatggcatcgtttgttggggccatggcaatctcggaattggtgaagaccacattgggcccaaaggaatggacaagatcctgcaatcaactggcaaaggaacgaatgtgactgttacaaatgatggggctaccattttgaagtcacttccaatgaacatcctgctgcaaaggttcctggttaaatccccaaaaattcaaatgacaaatttgggaaggaacaactccgttgttgttccaccgggaaacttttaagagggccgaaaatttatttaacggaaaatctccccaaaaaattattgcgggttacaaaaggccccccagggccccaaaaatttttttttaaaaacccgggcccaaaaaaaaaccccaaaattcccccccctcccccaaaatgtttaaaaccccctct

SEQ ID NO: 49334 - DNA, 750 bp, Zea mays
  misc_feature: Ceres CLONE 1460215-F
  misc_feature: Encodes the peptide sequence at SEQ ID NO. 49335
aaagctggagctccaccgcggtggcggccgctctagaactagtggatcccccgggctgcaggaattcgcacgagaccattacctagaacatcctaatcgaaaaaccaagtcaaacgtccccagcctcctaaaatttcccctttccccaactaacacgacaccccccttcccttcctccgatccccccgcctcccccaaaatccgacgcgtaatcgccgccatggccgccgccggcaagctcctcctcctggccgccgccatcctggcggcttccttcgtcgccgacgcgcgcccgtgcggccacgcgcagacgctcctcgtctccttctcctccgtcctcaggccgaacccggaccccaccaacccgacgccgctcaccaccacaggcggcaccgtcctccgcgtccggcgcctcggcccgcaccagatccgccgccccgtggcgctcccctccgtcgagtcggaggtcgccgcctcgtccgcccaggaccgcgccaaggacatcctcgtcgtcgtctccggcctcctcttcggcttcggctgcggcgccctcaccgcggcggccatgtacctcggtggggtagctcctcgccctcagctgggctctctggataccacaacgaagtccaccgcgacaacgaagaccggtggtccgaatccgaggcccccaggaaaggggggtatctcatcctccacgaacgctgacgggtccggtgccgcgtatcaataggggctgggatccgtcctcgg

SEQ ID NO: 49335 - protein, 169 aa, Zea mays
  misc_feature: Ceres CLONE 1460215-F
MAAAGKLLLLAAAILAASFVADARPCGHAQTLLVSFSSVLRPNPDPTNPTPLTTTGGTVLRVRRLGPHQIRRPVALPSVESEVAASSAQDRAKDILVVVSGLLFGFGCGALTAAAMYLGGVAPRPQLGSLDTTTKSTATTKTGGPNPRPPGKGGISSSTNADGSGAAYQ

SEQ ID NO: 49336 - DNA, 765 bp, Zea mays
  misc_feature: Ceres CLONE 1460223-F
  misc_feature: Encodes the peptide sequence at SEQ ID NO. 49337
  misc_feature (484)..(484): n is a, c, t, g, unknown, or other
  misc_feature (520)..(520): n is a, c, t, g, unknown, or other
aaagctggagctccccgcggtggcggccgctctagaactagtggatcccccgggctgcaggaattcgcacgagaccattacctagaacatcctaatcgaaaaatttatagtggctgagagacgggcggacattctcgtaccacgttcaaaacggcaagtcgatcgatctgaaaccacagatcgatcgacgaccagcagaagacgacgtacgtgaaaccgcgagacagtgcgaggacgactggggtgtggcggtgcgatccatcgacaaggccatgggacaacggcgctttgaggacgaacgcgcagctctggcgactgtggcaagcttgctgctcatcctaacgacagcccaagctgctgctgctgctgcttctggacgccatctgtctttgcccacgcagaaagcggcggcggcgcgcatgaacgacacccgtagtagtgacatggaggtcatcaaacccgcgccgttcgttatttgaacggngctcaaaggggcccgaacggtgcttcggggaagaantggcggggtacaaaaggaggcccaaccttttgccagggggatccggcctaaccgggggaataataaattttggagggggggggaccctttaaaattcccgtttccggggggaatttcctccccgagagggggccccccccaaaattccgggggggggtttaaaaaagggtgttaggaggggggggggcccccacacaaaaaaaccccctcttaaaaaaccaatttttgagcaccccggggggggc

SEQ ID NO: 49337 - protein, 68 aa, Zea mays
  misc_feature: Ceres CLONE 1460223-F
MGQRRFEDERAALATVASLLLILTTAQAAAAAASGRHLSLPTQKAAAARMNDTRSSDMEVIKPAPFVI

SEQ ID NO: 49338 - DNA, 800 bp, Zea mays
  misc_feature: Ceres CLONE 1460224-F
  misc_feature: Encodes the peptide sequence at SEQ ID NO. 49339
  misc_feature (350)..(350): n is a, c, t, g, unknown, or other
aagctggagctccccgcggtggcggccgctctagaactagtggatcccccgggctgcaggaattcgcacgagaccattacctagaacatcctaattgaaaaacacattttcaatttcgtactgggcgactgggcgtagggcgagctgagctcccaagtcgacgtggcggggatggctgcgacggccggcgtcggcggtggtggaggggctaacgcggcggtggcagagcagatagcacaggcagtgcggtccacctcctatctcctccagctcatggagcagtcctcccccgctcaggttcacttggcaaaactacccaagaacctgttggaaaaagcatcttttgcaangaacacggagcatgtactggcccacctacctcaagaattttcctcctgggaagcttaatgggacaccaccttgcaagggcatcctcaaataagctggccccacgcttttgggcaaactgggaaaaacacacctgaagccccgtggccttcccccccaaggagggaaatccaaaaaagtcccaccccttaaaaacccgggtttatttcccccccccacacttggggagagaaaacttttcccccttcttttcaaaaaaaaccaaaaaaggggtgtggggggaagggcctaaaaatctctcccgcgaaaaagcccccccccccccctttttgcccccttttttatatttggtgggggaggttttttttttaaaaaaccctcttttttttttggggggggccccccaaaaaaaaaaaaaaaaaatatttttttctccccaccccggggggggg

SEQ ID NO: 49339 - protein, 78 aa, Zea mays
  misc_feature: Ceres CLONE 1460224-F
  misc_feature (60)..(60): Xaa is any aa, unknown, or other
MAATAGVGGGGGANAAVAEQIAQAVRSTSYLLQLMEQSSPAQVHLAKLPKNLLEKASFAXNTEHVLAHLPQEFSSWEA

SEQ ID NO: 49340 - DNA, 762 bp, Zea mays
  misc_feature: Ceres CLONE 1460227-F
  misc_feature: Encodes the peptide sequence at SEQ ID NO. 49341
  misc_feature (746)..(746): n is a, c, t, g, unknown, or other
aaagctggagctccccgcggtggcggccgctctagaactagtggatcccccgggctgcaggaattcgcacgagaccattacctagaacatcctaatcgaaaatatcgttaaaactgaaagaaatgtatcagatgatcactctcggaggtgatgcagagctcgagcttgtagactcgctggaccctttctcagaaggtgtggttttcagtgtaagacctccaaagaagagctggaagaacattgcaaacttgtccggtggtgaaaagacactgagctcactcgcactagtctttgcactccatcactacaagcctacaccgctttacgtcatggacgaaatcgacgccgctctcgatttcaagaacgtatctatcgttggacactacgtgaaggaccgtactaaagatgctcagttcattatcatcagtctgaggaacaacatgtttgagctagcagatagattggtgggaatctacaaaacagataactgcacaaagagcattactatcaaccctggaagctttgcagtttctcagaaaacgcctgcctaagtctaccaaatgaacaacatcactacatgaaccacttttgttgatttttggtgtctgcatgtatgaacaggctcattgtattgtaatggttttctactgtttagtgactttcgcttgcatcttttttttttctttttgaatgatgggattaacattatccatgttattatataatctaaaggatgtgtatatcangcctacttgtagacca

SEQ ID NO: 49341 - protein, 142 aa, Zea mays
  misc_feature: Ceres CLONE 1460227-F
  misc_feature (4)..(126): Pfam Name: SMC_N Pfam Description: RecF/RecN/SMC N terminal domain
MYQMITLGGDAELELVDSLDPFSEGVVFSVRPPKKSWKNIANLSGGEKTLSSLALVFALHHYKPTPLYVMDEIDAALDFKNVSIVGHYVKDRTKDAQFIIISLRNNMFELADRLVGIYKTDNCTKSITINPGSFAVSQKTPA

SEQ ID NO: 49342 - DNA, 687 bp, Zea mays
  misc_feature: Ceres CLONE 1460231-F
  misc_feature (250)..(250): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (373)..(373): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
aaagctggagctccccgcggtggcggccgctctagaactagtggatcccccgggctgcaggaattcgcacgagaccattacctagaacatcctaatcgaaaaaatcagagcgcgcgttgcacgtcatccgggtaccaggccagacgccggccagacgcaaagccggaagccagcgtatatacatgtgaataacgcgggtcaggcggaccgtacggcgtacacggatctcgctcggccatcgggactgtancaggacgagagggagaaagagacagcggatttcatccaccgccaggcgtcagggtcagagtgtgttaagaccaagattggtggcaaatgccgacccacctgctaaaaggaatggggnnngcancttgcaccctggccaaggtttaggaccccacaccgggcttcctgccttgcgaaaggggggcccaccccaatgcccccttttttacccccaaagggtgtcggggcccaaaattgttccccaaaccccttttttaattaaaaatttggggctcccccggtgttgcccctttccccccttgttttgggaaaaaacnnnccnnncnnncccgcgccccccccccccaaagtggggtggctccctccccccaaaaaaaggggcccccccaggagaggcccctttaaccccctttttgggggggagagagaaataaaaaa

SEQ ID NO: 49343 - DNA, 757 bp, Zea mays
  misc_feature: Ceres CLONE 1460234-F
  misc_feature: Encodes the peptide sequence at SEQ ID NO. 49344
ctggagctccccgcggtggcggccgctctagaactagtggatcccccgggctgcaggaattcgcacgagaccattacctagaacatcctaatcgaaaaaacaataaaataataagtctcgtgcaggcgaaggacgtacgacgacgcggacgcaccgtcaaagtctacaggctgcgcaatccctttctccctcttatccccaaggcgaggagctgagggggggggggggcccttctgctgctgttcttgtttccccgctctccaagatgtcgtccccgagcaagcgccgcgagatggaccttatgaagctgatgatgagcgactacaaggtcgagatggtgaacgatgggatgcaggaattcttcgtcaaattcaaggggccggccgaaagtatctaccaaggcggcgcccggaaggttagggtagaactgcctgatgcatatccttacaaatccccgtccatcggcttcatcaacaagatttatcacccaaatgtcaatgagatgtctggctctgtatgtttagatgtcataaaccaaacatggagcccagtgtttgatctagtaaatgtttttgaagtattcctcccacagctgttactatatccaaatccttctgatccattaaatggggaggctgcaccactgatgatgcctgatcgtcctgtttatgaacagaaagtgaaagaatattgtgagaggttgcccaaccagaggacgctggtatcactccggaagaaagtccagtgatgaagactt

SEQ ID NO: 49344 - protein, 160 aa, Zea mays
  misc_feature: Ceres CLONE 1460234-F
  misc_feature (7)..(143): Pfam Name: UQ_con Pfam Description: Ubiquitin-conjugating enzyme
  misc_feature: SWISSPROT Homolog: EC 6.3.2.19 Ubiquitin--protein ligase
MSSPSKRREMDLMKLMMSDYKVEMVNDGMQEFFVKFKGPAESIYQGGARKVRVELPDAYPYKSPSIGFINKIYHPNVNEMSGSVCLDVINQTWSPVFDLVNVFEVFLPQLLLYPNPSDPLNGEAAPLMMPDRPVYEQKVKEYCERLPNQRTLVSLRKKVQ

SEQ ID NO: 49345 - DNA, 751 bp, Zea mays
  misc_feature: Ceres CLONE 1460236-F
  misc_feature: Encodes the peptide sequence at SEQ ID NO. 49346
  misc_feature (620)..(620): n is a, c, t, g, unknown, or other
  misc_feature (666)..(666): n is a, c, t, g, unknown, or other
tggagctccccgcggtggcggccgctctagaactagtggatcccccgggctgcaggaattcgcacgagaccattacctagaacatcctaatcgaaaaaaagcttggacgagtgaagggagatgccgccgccagctccgcgccgaataatcctgctggccgcggcgctgctgctgtggccggccgcctgcgtcacggccgacgacggcagcacggcattcttgccgccgccaccaccaccggggcccgcgtcgccgttcccgttctgcccggtgcggccgcctggggtgtcgtcggggccgttcccctggtcgccgccgccgccgtcggtggcgaggttccctcaggacccggggttcttgccgtccggggcgtgccccgtcggcggcgcggcggcggtggcgtggctgctgctgccgctgctcgctgtgctctctgctttcttgccgctttcgcagtgactctcgcggttgctgccctggatggatgtgatgtgtccgtagtcgtgttcagttcgatcggagatcaagatttacttttttttttgaacgaagctaggaaagaggcatcctttcttgtttgcctttctttctttctttgttttcgaggcataggcacttangtcggtctgtttctttcttctcgagagaagggatatcttcgtgtancaccgtgtggctccattcatgcaatccaggactcggcagatccagcttttgagtaaaaaaaaaaaaaaaagcttatcgatcccgc

SEQ ID NO: 49346 - protein, 112 aa, Zea mays
  misc_feature: Ceres CLONE 1460236-F
MPPPAPRRIILLAAALLLWPAACVTADDGSTAFLPPPPPPGPASPFPFCPVRPPGVSSGPFPWSPPPPSVARFPQDPGFLPSGACPVGGAAAVAWLLLPLLAVLSAFLPLSQ

SEQ ID NO: 49347 - DNA, 765 bp, Zea mays
  misc_feature: Ceres CLONE 1460238-F
  misc_feature: Encodes the peptide sequence at SEQ ID NO. 49348
tggagctccccgcggtggcggccgctctatactagtggatcccccgggctgcaggaattcgcacgagaccattacctacaacatcctaatcgaaaactcccccaaacttgcgcgcgcctccgctgctgcgacggcgagcccaagaaaaaatttcctctacgagcgcatggaggtgtccgctgggctccggccgccgcccgtcgctgcggcagcgtcgctccttggctgtcggtccgcgtcggtgccgccgcgcgtggcggcttcccattcggtgcggtccgtgtcccgcgcggttaagatcagagcagctgcaattaacggcctccaaagaaacagaagtaatttcgaatcattattccgctacgacaaatctgtccccgagcaggacattggagaaccatctggcccacctctggaaaagaagaatgtcggggacaagcctccctgctcaagctgtgaagctaaaggtgccttgctgtgtgcaacgtgcgctggttcaggcttgtacgtcgactcgatactagagagccagggaatcatcgtgaaagtcagatgcttaggttgcggtggaactgggaacatcatgtgctccaatgtggaggccgtgggcatacatgaacgcaaaagcttgcaccttgcagatcaaaggagttgactctatggagaattttctgtgttacatgttacggggtgctgagctagctgctgtagctacatcgagacatgcttttatttggtcccctcattccggggctaaaagatgag

SEQ ID NO: 49348 - protein, 162 aa, Zea mays
  misc_feature: Ceres CLONE 1460238-F
MEVSAGLRPPPVAAAASLLGCRSASVPPRVAASHSVRSVSRAVKIRAAAINGLQRNRSNFESLFRYDKSVPEQDIGEPSGPPLEKKNVGDKPPCSSCEAKGALLCATCAGSGLYVDSILESQGIIVKVRCLGCGGTGNIMCSNVEAVGIHERKSLHLADQRS

SEQ ID NO: 49349 - DNA, 758 bp, Zea mays
  misc_feature: Ceres CLONE 1460240-F
  misc_feature: Translation starting site: 242
  misc_feature (713)..(713): n is a, c, t, g, unknown, or other
aagctggagctccccgcggtggcggccgctctagaactagtggatcccccgggctgcaggaattcgcacgagaccattacctagaacatcctaatcgataaataggcattcaatcattcaagcgaagcagccaccactctctccactgtgactccgtgacctgcctgccctgctgcacaagcacagcacacacaccccgcacaccgcaccagctcagcgcagctcaccaagacaatcaatcatggctcacccgcgcagtgtcgctgccgctgcccccctcctcctgctgctcgccgccgccgccgccgccgcagcggggctcgtgtccgccgcgtcgccggcagccagcgacttcgtccgcaagtcgtgccgcacgacgcagtacccgtcggtgtgcgagcagagcctgccctcttacggcgggtcgccgccgccgcggagcccgcgggagctggcgcgcgccgcgctgtcggtgagcgcggaccgcgcgcgcgccgcgtcggcgtacgtgggccgcctgtgcggcgccagcaacggcaaaggcgcgaagaaggggtcgggatcggcgtcggcgtcggcgtcggcaggtcccgtgcgagactgcctggacaatctggcggacagcgtgtgcccacctccgcaaccccgcccaagaaatgggccgcgcccggatgggcccacgcggggacgccggcgttcaagtggaacctcancaacgtgcaaacttggtggaaccccgccctcaacgacaaagaaac

SEQ ID NO: 49350 - DNA, 759 bp, Zea mays
  misc_feature: Ceres CLONE 1460242-F
  misc_feature: Encodes the peptide sequence at SEQ ID NO. 49351
  misc_feature (409)..(409): n is a, c, t, g, unknown, or other
ctggagctccccgcggtggcggccgctctagaactagtggatcccccgggctgcaggaattcgcacgagaccattacctagaacatcctaatcgaaaacacagtccacactccccactccattttctaccatcacactgacacgttcatagctagctagtcttcagctagtaacgtacgacggactaatctcgatctgggagcgaggaggaggacgacgataatgaagatgagctccgtgcccgcggcagcggcggtgatggtggtggtggtgctgctctctgcggcggcggcgactgtgacggggcaggcgcttgtgccgggcgtgatgatcttcggcgactcggtggttgacgcaggcaacaacaaccggctagcgacgctggtgcgcgccgacttcccgccctacngccgcgacttcccggcgacgcacgcgcccacggggcgcttctgcaacggcaagctcgcccacgactacaccgtggagagcctggggctgagctcgtacccgccggcgtacctgaccgaggaggcccaaagcaaacaacaagagcctcctccacgggccaaatttccggtcggggccccccggttacttaacccaccgccgcctttaaggggccttggcctaaaccggaaggcgggtactttccgagaacccatcccggtgggggcctttggccgccaaaacgcccccggaaattaaaccgggtccctttggggggagcccggcccccgcaacttggggaaatcttcgtga

SEQ ID NO: 49351 - protein, 160 aa, Zea mays
  misc_feature: Ceres CLONE 1460242-F
  misc_feature: SWISSPROT Homolog: EC 3.2.1.51 Alpha-L-fucosidase
  misc_feature (63)..(63): Xaa is any aa, unknown, or other
MKMSSVPAAAAVMVVVVLLSAAAATVTGQALVPGVMIFGDSVVDAGNNNRLATLVRADFPPYXRDFPATHAPTGRFCNGKLAHDYTVESLGLSSYPPAYLTEEAQSKQQEPPPRAKFPVGAPRLLNPPPPLRGLGLNRKAGTFREPIPVGAFGRQNAPGN

SEQ ID NO: 49352 - DNA, 732 bp, Zea mays
  misc_feature: Ceres CLONE 1460244-F
  misc_feature: Encodes the peptide sequence at SEQ ID NO. 49353
  misc_feature (484)..(484): n is a, c, t, g, unknown, or other
  misc_feature (637)..(637): n is a, c, t, g, unknown, or other
  misc_feature (653)..(653): n is a, c, t, g, unknown, or other
tggagctccccgcggtggcggccgctctagaactagtggatcccccgggctgcaggaattcgcacgagaccatacctagaacatcctaatcgaaaacagcatatcgacgcagagtcgcagtcgcagcacacactgaattctctttagctagctaagagagggtagccacaccaagacaggatgcagacagcgaaggtgaaggcgaaggacatggtgagctcggcgaaggagaaggtgaaggaggggtcggcaaagatgcagggcaagacgggcgaggcgacggcggccacgcacggcgagaaggagatggccaaggaggcggcccgcgccaagaaggaccaggccaacgccgacaagcaccaggagaaggccgaccaccgagcggacgccgccactggccaccacggcacgcgcgtgcccctcaccggcccgcacggccaccacggcgctggcgcggccgtcgaccccgcgtacccgtcctccnggcacacgtacccggcgtcgggcaagtacatctaggtgactgcgtcggatgagcgaagccagggtcgtggtcgcacttgcgtttttgtgtacgtagcgaccgagaagatcgatcctggctgtacgcctgcagtaccggtaccgactgggttanttgtaaagggtatgcngtggcgcacgtgcacgtgtccccccaatcctcttgaaaaaaaatgctctaagttggccggaagggttgcttaaaaaaaa

SEQ ID NO: 49353 - protein, 112 aa, Zea mays
  misc_feature: Ceres CLONE 1460244-F
  misc_feature (1)..(73): Pfam Name: LEA_1 Pfam Description: Late embryogenesis abundant (LEA) group 1
  misc_feature (102)..(102): Xaa is any aa, unknown, or other
MQTAKVKAKDMVSSAKEKVKEGSAKMQGKTGEATAATHGEKEMAKEAARAKKDQANADKHQEKADHRADAATGHHGTRVPLTGPHGHHGAGAAVDPAYPSSXHTYPASGKYI

SEQ ID NO: 49354 - DNA, 754 bp, Zea mays
  misc_feature: Ceres CLONE 1460245-F
  misc_feature: Encodes the peptide sequence at SEQ ID NO. 49355
ggagctccccgcggtggcggccgctctagaactagtggatcccccgggctgcaggaattcgcacgagaccattacctagaacatcctaatcgaaaaccgtctccgtcggttcgtcgggcgcaatagaaaaactaccgaacgcgccgccgctcctgccccgtatctataccaccgaaggcgaggaaggggggccaaggacgagcgctttttcgtgcccgctggccattgccgctgctcacgagcctcccgccccgcgctgccctgccctctgcggctctgccccaacgagccccaggagagccaggtaaaggagccgtcaaaagcccccgccgaggagagcacgcaaggtcagacatggcgtcaaccgttaccttcagcctaattagcacccaagctgggttgatccataagccaaggaaccttggagccacaagctacgctggcttaaaggtgccgagctttggctctgaatcatcattcttgggtaggaacgcatcccttcgggcggctgttactacaaggattgtgcccaaggcaaagtctggatctcagatatcgccacatgcatcttacaaggtggcgctgctcggtgctgctggtggcatcggtcaacccttgggcctattgattaagatgtctcccctggtgtccgagctgcatctgtatgatattgctaatgtcaagggagtcgctgcagatctcagccactggcacacgcccgctcaggtacttgacttcactgggccctcagagt

SEQ ID NO: 49355 - protein, 133 aa, Zea mays
  misc_feature: Ceres CLONE 1460245-F
  misc_feature: SWISSPROT Homolog: EC 1.1.1.37 Malate dehydrogenase
MASTVTFSLISTQAGLIHKPRNLGATSYAGLKVPSFGSESSFLGRNASLRAAVTTRIVPKAKSGSQISPHASYKVALLGAAGGIGQPLGLLIKMSPLVSELHLYDIANVKGVAADLSHWHTPAQVLDFTGPSE

SEQ ID NO: 49356 - DNA, 778 bp, Zea mays
  misc_feature: Ceres CLONE 1460246-F
  misc_feature: Encodes the peptide sequence at SEQ ID NO. 49357
  misc_feature (195)..(195): n is a, c, t, g, unknown, or other
  misc_feature (538)..(538): n is a, c, t, g, unknown, or other
  misc_feature (551)..(551): n is a, c, t, g, unknown, or other
  misc_feature (635)..(635): n is a, c, t, g, unknown, or other
  misc_feature (652)..(652): n is a, c, t, g, unknown, or other
  misc_feature (696)..(696): n is a, c, t, g, unknown, or other
  misc_feature (697)..(697): n is a, c, t, g, unknown, or other
  misc_feature (703)..(703): n is a, c, t, g, unknown, or other
  misc_feature (707)..(707): n is a, c, t, g, unknown, or other
  misc_feature (709)..(709): n is a, c, t, g, unknown, or other
  misc_feature (763)..(763): n is a, c, t, g, unknown, or other
aacctggagctcaccgcggtggcggccgctctagaactagtggatcccccgggctgcaggaattcgcacgagaccattacctagaacatcctaatcgaaaaaagtaactaaccatattggccgtgcgtccgtggctttgcatctgcaaccccgcccgatcaatcttcctcgttccgccgctccctcgcctccggnagcgaggtgaggccaccgatcggaccttccctagcggcggcgcctaccaacctcaaggagcgatggctctgtctgcgacgctacggatttctcttagcgtcgcgttctttggggttctggcgttcgtgcttggtgtcatcgccgaaaacaaaaagcctgcttccgggactcctatcctaggaaaggatgacgtcatctgcacgtttcaaagtgataccaccctctcttccttaagcctgttcattgtggcacttgtggaagctgccatcgcaagccaaggtgccatcttctttccatactccggcaaagcagttcctcgtggagcggtgtttcaaagacccancttgaccgcgctncttggttgtaccagaacttgtctcaaccctggcccttgcaatgtccctgggggcaactgcccccaaaagaacttcacccacgcnacgaacaccccaccccnaagggaacaccaatgggcccaactgccaagaaaccgcatggctnngccgancccncnatcacctacccttagagcgccgcccccctttcgggatggtgggcagaattcctncaccctcaatagaga

SEQ ID NO: 49357 - protein, 173 aa, Zea mays
  misc_feature: Ceres CLONE 1460246-F
  misc_feature (94)..(94): Xaa is any aa, unknown, or other
  misc_feature (132)..(132): Xaa is any aa, unknown, or other
  misc_feature (147)..(147): Xaa is any aa, unknown, or other
  misc_feature (149)..(149): Xaa is any aa, unknown, or other
  misc_feature (151)..(151): Xaa is any aa, unknown, or other
  misc_feature (169)..(169): Xaa is any aa, unknown, or other
MALSATLRISLSVAFFGVLAFVLGVIAENKKPASGTPILGKDDVICTFQSDTTLSSLSLFIVALVEAAIASQGAIFFPYSGKAVPRGAVFQRPXLTALLGCTRTCLNPGPCNVPGGNCPQKNFTHATNTPPXREHQWAQLPRNRMAXPXPXSPTLRAPPPFRDGGQNSXTLNR

SEQ ID NO: 49358 - DNA, 764 bp, Zea mays
  misc_feature: Ceres CLONE 1460247-F
  misc_feature: Encodes the peptide sequence at SEQ ID NO. 49359
  misc_feature (761)..(761): n is a, c, t, g, unknown, or other
  misc_feature (764)..(764): n is a, c, t, g, unknown, or other
tggagctccccgcggtggcggccgctctagaactagtggatcccccgggctgcaggaattcgcacgagaccattacctagaacatcctaatcgaaaactaaaagtgtcgaaatgaaagaatcaccaaagactgttcatgttgatactgtgtctggtgctagtacaatattatatacttttacagttgaccgcggagtttcttgggagttagcaaattcaatacttgaagaaaggctgaaagataaagcaggttcttctagtgatggattctatgagtccagaaaagaatgggcggggagaagacactttctgctagctttcgaaggttcagctgaaggattgtacatagtaattcggccagctgttggggaggcttcgagggaaatgtctttggttgagcttaaaaccaagtacaggaaggtctcatctgttgacaaaattagtaaaggctggcaagaagagtacgactcttcatccaagcagtgtatgcacgggccaaaatgcaaactcggaagcaattgcacagtgggtagaaggttgcaggagattaatatattgggtggtctaatacttcctgtatggggtgcagtagcaaaggcactggctaagcaggcacggcagaatcacaggagaatacgtgtggtccgcttggagaccacgactgagaacaaacgtttgttgggctatcattcaaaatctgcagtgaagtctgtactcgaaggtttgcaatgggtcaagaatatgacgaaatgattggcagnacn

SEQ ID NO: 49359 - protein, 213 aa, Zea mays
  misc_feature: Ceres CLONE 1460247-F
MKESPKTVHVDTVSGASTILYTFTVDRGVSWELANSILEERLKDKAGSSSDGFYESRKEWAGRRHFLLAFEGSAEGLYIVIRPAVGEASREMSLVELKTKYRKVSSVDKISKGWQEEYDSSSKQCMHGPKCKLGSNCTVGRRLQEINILGGLILPVWGAVAKALAKQARQNHRRIRVVRLETTTENKRLLGYHSKSAVKSVLEGLQWVKNMTK

SEQ ID NO: 49360 - DNA, 772 bp, Zea mays
  misc_feature: Ceres CLONE 1460251-F
  misc_feature (584)..(584): n is a, c, t, g, unknown, or other
  misc_feature (609)..(609): n is a, c, t, g, unknown, or other
  misc_feature (620)..(620): n is a, c, t, g, unknown, or other
  misc_feature (621)..(621): n is a, c, t, g, unknown, or other
ggagctccccgcggtggcggccgctctagaactagtggatcccccgggctgcaggaattcgcacgagaccattacctagaacatcctaatccaaaagtgtaggaggctagttggaacacttgtgagcatattggagcctttcctctccctctctctcactcatattggttgggattgcattctagtgagattgagagccatctagtgcattgcatcaagttgttgatctttgaggcactagggagatcatcaagtgaggtcgttggcttgttactcttggaggttgccgcctcctagacggcttggtggtggttccccgtgagctcttcaaaggagattgtgaagaggccgcggtggtgattgtgagaggcgttgtgcttgcctcgccggagcggtgaaaagcaactctagtggaatcgaggtttgagggttcattgaccaatccggctcaagagatcaagtggagacttgatagaggagcggttgggagctttgaatctacctcaacgtggactaggggtgaccggcaagtcatcgacaccacgggaaaaaattcattgtgccacgtgtcatcatcttcccgntgggtttgcaactttcctcactagnctggtattacnntgtcatatacttatgctagtgagtattgggtgctcgtgtatgctcttgtatatttagccatatctataataaaatagttgctcacttgttgttagctggtgtagctaatctggtttaaaaaaaaaaaaaaaagcctatcgataccgtcgac

SEQ ID NO: 49361 - DNA, 781 bp, Zea mays
  misc_feature: Ceres CLONE 1460256-F
  misc_feature (410)..(410): n is a, c, t, g, unknown, or other
  misc_feature (448)..(448): n is a, c, t, g, unknown, or other
tccccgcggtggcggccgctctataactagtggatcccccgggctgcaggaattctaacgaaaccattacctagaacatcctaatcgaaaagagaaccggctcggacagtcggactcgatcatcatttaagcgaacctcgccgcgatcgtatcacccatggcgaccgccacgcacgagggcgtgacccagcgcgtcgctgccaatgacagcaaggacgacggcgccagcggcggcatcgcagcggtcccggggcccacaagaaaccaggcggcgacaggaggaggcgcgacctttggtccgacggcagccccggggttcaggcccaggagacatcggggtgtggggtggtgggtgggggcgtttttaggggggggtgggtgacaatatgtgggtgtgccaaacatgctcnagaaatgggggggtggggggggggtgtgggggtgaaancctcaccgcccctcacaagagataggatgtcgccctgtaatgtgggatatgtgttgaggattggaggtggcgcttgcgggagaatcttgcatcttcggcgaaccggtagatggagagagggtatgtggagatgctggggggaagcaaacaggaggcaatagggattgggtgtattcacctatcgctcttctaagatttggagcgatctctcgcaaagttattaagaaggggcgttactatcattcccctagggtatattgcgagtctttctaataatccacgcggcacagacagaccgccaaaacacaaccagagaacggccaacgcgccacc

SEQ ID NO: 49362 - DNA, 824 bp, Zea mays
  misc_feature: Ceres CLONE 1460259-F
  misc_feature: Pfam Name: Ribosomal_L28 Pfam Description: Ribosomal L28 family
  misc_feature (418)..(418): n is a, c, t, g, unknown, or other
aagctggagctccccgcggtggcggccgctcttcactagtggatcccccgggctgcaggatttcgcacgagaccattacctaaaacatcctaagcgaaaaagccatgcgccttggttaccgccaggctactgagctcctccttcgccatgcccgccgccgcccgaagggcctcctccccttcctccgcctcattgagcttcgccaagtcgcagctcgccggcctctccctctccgccggcgttgcaactccaaccgccgtcgccctcctccccaagaggcagcagctccagcccattgtcgcgcggcgtgtgtgcctgttcacggacaagaagacgaaccggggcgaacaaggtgtcgttttccaatcacaaaacaaaaaaccagccgttcgtgaacctgaagtaaagaaagctaccnccggaagggccggaaaacgcttcggcaaagcttcgcccttcccccaagggcccccaaaaacaataaaaaaacacgggccccaaacccccccccccccaaagggcgaagggggaaagaaaaataaaagattttcaccccggggaccgggcttctttccgccccggaaggggaaaagaataatggggccctctccccgcgggttttgcgccctcccgggatttcctctcacaaaaaaaaagaggggcacctttcacgggggggagctcccagaaaccccacatctcccgcgcgcaaccccaaaaaaacctcgcgcgcaaccgagggagggattgtggaaaaacaggctgggtggcccccccgctgtcttttgtctttttaaagaaaaacttctcccccctcttctctg

SEQ ID NO: 49363 - DNA, 543 bp, Zea mays
  misc_feature: Ceres CLONE 1460265-F
  misc_feature (266)..(266): n is a, c, t, g, unknown, or other
  misc_feature (429)..(429): n is a, c, t, g, unknown, or other
  misc_feature (487)..(487): n is a, c, t, g, unknown, or other
  misc_feature (494)..(494): n is a, c, t, g, unknown, or other
tggagctccccgcggtggcggccgctctagaactagtggatcccccgggctgcaggaattcgcacgagaccattacctagaacatcctaatcgaaaatcaagttcggcgaggccgacgaggacggcatggtgaagaccgcgaagaagatccccacaaagaaattcaccgacctcgcgggcaatatcttcaggggcgacgagacccccccctgggacgggcggaaaagcacctgtaccccagcgaaacttgagggagatgaccggcnaccaaaattttttcggggaaggggaaggccccctccggggaaatacctcggggggggatcccccaaaaacccccccctggggggggaaaaaaaaaactcccccttggttttaacaccccccccccccgtgtggggtatttttccccccccccccaaacccttntttttttttttttttttttccccccccccggcccggccccccaaagaggaggaaaaantttgggncccccccttttttttcccccccccggggaggagaaaaaaaaaaaaaata

SEQ ID NO: 49364 - DNA, 758 bp, Zea mays
  misc_feature: Ceres CLONE 1460267-F
  misc_feature: Encodes the peptide sequence at SEQ ID NO. 49365
  misc_feature (744)..(744): n is a, c, t, g, unknown, or other
  misc_feature (758)..(758): n is a, c, t, g, unknown, or other
aagctggagctccccgcggtggcggccgctctagaatagtggatcccccgggctgcaggaattctcacgagaccattacctagaacatcctaatcgaaaaggggccctcccccaatctccagcgacgccgtcccccccaactcgccacccatggccatgtcgttccacttccacccgctggccgcctcgcgcgtccacttctccccactcccgttcgccgccgccgcgggggcgccctccccctcctcctccgtcgccatcgcggcgcaccaccagcacggtcgccgccgcttctccgccatcgtggccacggcggccgccgcgtcggcggcgaccacggagttcgacttcaaggcgtacatgggggagcgcgcggtcgcggtgaaccgggccctggacgcggccgtccccgccggggagccccccgcggcgctgcacgacgcgatgcgttacgcgctgctggcgggcgggaagcgcgtgcgccccgcgctgtgcctggccgcgtgcgccgtggtgggcgggccggagccctgggccatgccggccgcggcggccgtcgagatggtgcacaccatgtcgctcgtccacgacgacctcccctgcatggacgacgacgacctccgccgcggcaagcccacctgccacgtcgtctacggcgagcccatcgccgtcctcgccggggacgcgctgctctcgctctccttcaccacatggccagcgtcgggtcctaccctccggacgtgnacccggagaagcan

SEQ ID NO: 49365 - protein, 202 aa, Zea mays
  misc_feature: Ceres CLONE 1460267-F
  misc_feature (95)..(202): Pfam Name: polyprenyl_synt Pfam Description: Polyprenyl synthetase
  misc_feature: SWISSPROT Homolog: EC 2.5.1.29 Farnesyltranstransferase
  misc_feature (198)..(198): Xaa is any aa, unknown, or other
MAMSFHFHPLAASRVHFSPLPFAAAAGAPSPSSSVAIAAHHQHGRRRFSAIVATAAAASAATTEFDFKAYMGERAVAVNRALDAAVPAGEPPAALHDAMRYALLAGGKRVRPALCLAACAVVGGPEPWAMPAAAAVEMVHTMSLVHDDLPCMDDDDLRRGKPTCHVVYGEPIAVLAGDALLSLSFTTWPASGPTLRTXTRRS

SEQ ID NO: 49366 - DNA, 768 bp, Zea mays
  misc_feature: Ceres CLONE 1460271-F
  misc_feature: Translation starting site: 150
  misc_feature: SWISSPROT Homolog: EC 2.7.2.3 Phosphoglycerate kinase
  misc_feature (383)..(383): n is a, c, t, g, unknown, or other
aaagctggagctccccgcggtggcggccgctctagaactagtggatcccccgggctgcaggaattcgcacgagaccattacctacaacatcctaatcgaaaacccaaagtttgctcataagcttgcctccgtatgacatctttacgttaatgactcttcttggaacaacccacagggcacatggatcgactgaagaagttccacagttcttgaagccttctgttgcatggttccttttgcagaaggagcttgactaccttgtcagagctgtttcaagccctacacgcccattttcctgccatcgtgggtggttcaaaggtgtcatccaagatctgggttattgaatccttgttggagaactgtgatatcattctcttggatgncaatatgatcctcacattttaccatgcacaaagcctttctgtccttgcttcattgtgtgaggaagacaaactcgatcttgcaacatctctacttgccaaggctaaggaaaagggagtctcccttatgttgccaaccaatgtcgccatcgcttataaagtttcgtcctgaggtaaaaggacagattgttccaacttctgcaattcccgatgattggaagcggcttggagaatgacccaaaaacccattgctgcatttaagccaacccttgaaaaaccccaaaacgtcatcctgaaaccgggccctgggttgttttttaaatataagaatttccgctatcgggacctgagggctggggaacaaaaatttgcgcaaacctttacccca

SEQ ID NO: 49367 - DNA, 732 bp, Zea mays
  misc_feature: Ceres CLONE 1460279-F
  misc_feature: Encodes the peptide sequence at SEQ ID NO. 49368
  misc_feature (604)..(604): n is a, c, t, g, unknown, or other
tggagctccccgcggtggcggccgctctagaactagtggatcccccgggctgcaggaattcgcacgagaccattacctagaacatcctaatcgaaaaatcgaacccccgccaccaccagtccagcagcaccaggccagacaggcacacctcgaagaacaagagctggtcctcctggtaataagcgagagagagagagaggccaatggcagccaagtggtggctcgtcgcctccctgctgctctgcctcgccgccgcatcggcggcggcaagagcaacgccccgcgactgcgacactactgccgccttcgcggcgggcgacggcagtgccggcgccgtggacgaggacgacgagcaggccaagaccgccgacgtgttcggtgggcggaccggcggcggcggcctcttcggcggcgtccacggcccgctgggcggcggcgtcgctgggttcggcccgttcggcggggccgtcgccggcgcgggcccgttcggcgggttcggaggcggcggcggcctccgtggcgggaaggagaggaggaggaggaacaggtggcgcccgcgtcccgtgagtcttgacaacgctgtgcatggttttggatgcatgcntgcgtgcgcgtgtaataaggcgtgtctgtactctgtactggacgtacgtgccgcggggcttgaccgccctggtgatgaagattggggctacctttgtccgtatgtgccaaaaaaaaaacaaaaatctt

SEQ ID NO: 49368 - protein, 176 aa, Zea mays
  misc_feature: Ceres CLONE 1460279-F
  misc_feature (134)..(134): Xaa is any aa, unknown, or other
MAAKWWLVASLLLCLAAASAAARATPRDCDTTAAFAAGDGSAGAVDEDDEQAKTADVFGGRTGGGGLFGGVHGPLGGGVAGFGPFGGAVAGAGPFGGFGGGGGLRGGKERRRRNRWRPRPVSLDNAVHGFGCMXACACNKACLYSVLDVRAAGLDRPGDEDWGYLCPYVPKKKQKS

SEQ ID NO: 49369 - DNA, 751 bp, Zea mays
  misc_feature: Ceres CLONE 1460282-F
  misc_feature: Translation starting site: 201
  misc_feature (453)..(453): n is a, c, t, g, unknown, or other
  misc_feature (476)..(476): n is a, c, t, g, unknown, or other
  misc_feature (487)..(487): n is a, c, t, g, unknown, or other
  misc_feature (507)..(507): n is a, c, t, g, unknown, or other
  misc_feature (595)..(595): n is a, c, t, g, unknown, or other
  misc_feature (671)..(671): n is a, c, t, g, unknown, or other
ggagctccccgcggtggcggccgctctagaactagtggatcccccgggctgcaggaattcgcacgagaccattacctagaacatcctaatcgaaaatctttttttcttttttcgttacttttctcgttccccccgttggggttttgagctccgacgaaccctaataatcgccggggaccggcggacgatcgcccgccggcatgcaccatcagcagcggatgaagcaggcggcggcggccgcggccgcggcgcagcagcagcagctgatgcagcaggcactgctcctgcagcagcagcagcagtcgcaggcgcagccgcccttgttccccgggcaccacccgcaccctggcctcctcgccgcaccacagatagagcccatagtcagtggaaacctgcctcctgggtttgattcaagtacatgccgcagcgtgtatgttggcaatatccatcttncagtgacggacacagtactgcangaagtcttccnaagcattggtccagtagaangggtgcagctcatcagaaaagaaagtcatcctttggtttcattgactactatgaccgcagatatgctgcactggcaattttatctctncatggcagacaactgtatggtcagccgattaaaagtcattgggcatatacaagtactccgagggaggacacatcangtcatttttatattttttgttggggatctttgccccgaagtcactgatgctacttttgttgcatttttctctggatactc

SEQ ID NO: 49370 - DNA, 753 bp, Zea mays
  misc_feature: Ceres CLONE 1460285-F
  misc_feature: Encodes the peptide sequence at SEQ ID NO. 49371
  misc_feature (416)..(416): n is a, c, t, g, unknown, or other
  misc_feature (424)..(424): n is a, c, t, g, unknown, or other
  misc_feature (427)..(427): n is a, c, t, g, unknown, or other
  misc_feature (430)..(430): n is a, c, t, g, unknown, or other
ctccccgcggtggcggccgctctagaactagtggatcccccgggctgcaggaattcgcacgagaccattacctagaacatcctaatcgaaaaacagtcaaaagctccccattcctcttccccttctcacccggcactcgaactctgcggccctgcaaaccctagctttcgctccatggccgacggcgatccggagccggcgccagcgccggcaccggcactggctaacgagaagctccatgtccgggcggcggcctacgtggatgagacgcgcccgccgccaccgctggagccctccgggggtccggacgaagagaagcgcccgcccgatgaggtagaagcggaggtggagatgcacccgccgctgtgaaccaaccggggagccgcccgttgatcgcccgggggtggaagtggtgncggaaatnaangcnaaccaagtggaaaaggaaaggggggatccggcaaaggaaagcgggaaaaaggataaaggggaagggaaaggaggaaaaaaaaaaggggaccaaaaagccaaggggaaagggcctcgcggtataaaggggatgggaaccaaaaaggaggtaaacccaacccgggggcattgggggccccccgagaaacccccctcctaggggggcccggtggggggcggcctttttttccccgccccccgggggttgggggccttttttcaaagccccaccaaaaccttgtggggtggtacaaaaaggggaaaaatgtcttggggccccccccc

SEQ ID NO: 49371 - protein, 64 aa, Zea mays
  misc_feature: Ceres CLONE 1460285-F
MADGDPEPAPAPAPALANEKLHVRAAAYVDETRPPPPLEPSGGPDEEKRPPDEVEAEVEMHPPL

SEQ ID NO: 49372 - DNA, 757 bp, Zea mays
  misc_feature: Ceres CLONE 1460286-F
  misc_feature: Encodes the peptide sequence at SEQ ID NO. 49373
  misc_feature (307)..(307): n is a, c, t, g, unknown, or other
  misc_feature (399)..(399): n is a, c, t, g, unknown, or other
ctggagctccccgcggtggcggccgctctagaactagtggatcccccgggctgcaggaattcgcacgagaccattacctagaacatcctaatcgaaaaagaagacttcacaagaatctactcgtcgagtcaccaaagataaggctctatcggactcggagtctcggacagcacagcaaagcaagagccgctactcaagtatagtctgacaccggccgaccctgccccaacccaagccatggcggacaacaacaaccggcggaaccacgggcagaccttgctcgccggcgcgggcctgggcctgctcngcgtgaactcgggccctcgcatctaccgcgcgaggggcgacacggcgccgtcctcttcgtcggggggtctggcgcaccctgttcctctcttngcctggcctcgcccctaaaagcggcgggcccggggtcccggcccggaaccgggccggggccccggtgggccctccacactttgtccctttctttcccggaaggggggggggaattgctttcccgccggggcccctttttagggggcggggcggggcccacccccgggggtttttgggccttttttggaaaaaagaaaaaacttggggggggaggaaaaaaaaaaaattttaaaatttcccccctggggaaaaaaagggggccgccccccccgaaaaaaaaaaaaaggtggccccctttttttttttgggcgtcccccccgcgggggtaaaaaaaaaaaagaggggtgtgtttgtttct

SEQ ID NO: 49373 - protein, 59 aa, Zea mays
  misc_feature: Ceres CLONE 1460286-F
  misc_feature (24)..(24): Xaa is any aa, unknown, or other
  misc_feature (54)..(54): Xaa is any aa, unknown, or other
MADNNNRRNHGQTLLAGAGLGLLXVNSGPRIYRARGDTAPSSSSGGLAHPVPLXAWPRP

SEQ ID NO: 49374 - DNA, 789 bp, Zea mays
  misc_feature: Ceres CLONE 1460288-F
  misc_feature: Encodes the peptide sequence at SEQ ID NO. 49375
aagctggagctccccgcggtggcggccgctctagaactagtggatcccccgggctgcaggaattcgcacgagaccattacctagaacatcctaatcgaaaaatcagaagctagaagcctagagcagccaagaaaagcacatacccgagtcgccgaaacaacaacaatcccaatcccccctcgtcactcaaaactcgagctcgagcaacaatgtcgctgattcgccgtggaagcgcattcgaccccttctccctcgacctctgggaccccttccagggcttatttcccttcggctctggaagcagcagcagcagcagcctgttcccctcgttcggaggcaccaccaccagctcggagacggggcgcttcgccggcgctcgcgtcgactggaaggagaccgccgaagcgccacctgtcaagaccgacctgccggggctgaagaaagaaggagtggagggtggacctggaggacggcaacggggttccaaaaaagcggcaaacccttcaagggccggaagaaaaaacggacccctggcccccggggagcccacacagggaaattcccggcccgggttccccccgaggggaaacccccgggggggaaaaaaattgggccccagggaaaaagggggggctcccccccccccgcccccagggggggacaaaaaaaggccccacaaatttcctcccatccccgggggaggtgccgccacccacccccccgggggggggcccccctctccttttgtgggaaaaagggggtggtttttctaccgggggggggaaaaac

SEQ ID NO: 49375 - protein, 193 aa, Zea mays
  misc_feature: Ceres CLONE 1460288-F
MSLIRRGSAFDPFSLDLWDPFQGLFPFGSGSSSSSSLFPSFGGTTTSSETGRFAGARVDWKETAEAPPVKTDLPGLKKEGVEGGPGGRQRGSKKAANPSRAGRKNGPLAPGEPTQGNSRPGFPPRGNPRGGKKLGPREKGGAPPPPPPGGDKKRPHKFPPIPGGGAATHPPGGGPPSPFVGKRGWFFYRGGEK

SEQ ID NO: 49376 - DNA, 826 bp, Zea mays
  misc_feature: Ceres CLONE 1460289-F
  misc_feature (232)..(232): n is a, c, t, g, unknown, or other
  misc_feature (364)..(364): n is a, c, t, g, unknown, or other
cttgaactagtggatcccccgggctgcaggaattcccaccagaccattacctagaacatcctaatcgaaaaatctcatatcattcgtctgttctgtccttgatgtgctaaacgcgtgcatgcaggcgcgatctgcgggccggggagcctggtgaacgcgatgatggacctgcaggagggggcgctaatgctgctgggccccacgatgaacgccaaggtggcgttcgagctgncccaccggctgccacacctgcccctgccgaggcaggagcactcgccccgcgccctggctttcgccaagcggattcaggggcctggacctgggtgttgtttttcccgggtgggccccccgggccgcacccccnccaacactatcttaatatgcgcccccccgtgcatcccccccccgacaccagccctctcccggggggctggcgggccccacaaccaatgcgtgacgtctattatggaccccccagccggtggccctctcctcccctctccccctagggggtgagccctagttagtttcccagggcggggcctccctcgcccccgcccccgtttacactcacggtggcccacgcagctctctctgccaccctctcgctcgtgccgcccccacccgggatggctgcggggggggccgtcccccttcattcttcttctgggtcgcccggtccttgttgcccgtctccggtgtcatgtctcgcgtgcggacacctcgcgtgcgcccctcctcgcgcggcgcggccgcgcaccctccgctctgttctgaggtgcacgcctctcacccacccgccgctgtgtaacgctcctcactccgc

SEQ ID NO: 49377 - DNA, 854 bp, Zea mays
  misc_feature: Ceres CLONE 1460292-F
  misc_feature: Encodes the peptide sequence at SEQ ID NO. 49378
  misc_feature (491)..(491): n is a, c, t, g, unknown, or other
aaagctggagctccccgcggtggcggccgctctagaactagtggatcccccgggctgcaggaattcgcacgagaccattacctaaaacatcctaatcgaaaagaaaaaaaaacgtgctgtcttcccgtctcttcccaatgcggcgtctcgctctcctcttcctcctgcctctcctcctcgccaccggcgtcaccacggcgtcagcggagcccgcgacccctcccgcctctcctcctcctcctccaccaccatgttcaaagggtgaactggacaagtttgcttattatcatggaggcagctgtagtaatgttttccaacgcgaccacgttatttaccaaaagaacggacattgcaactgttgggaagatgaacaaaccctgacaagcgggcgaactatgaatgtaagaggtggtccacaacctaagctgcagagagcaattaaggtcaacctgcaggacacagcaaaacaacaacacaaacaaagaacaaanaagggaagggatgcttgcctgctaaaatgattcgtatggtaacagaacactaatttttggtgcctaagtcaagggagtgggaagaaaacaagaggttccgcctaagggcattggataactagcccgcaaatgtaagtcccttaacacactaacggaggacacccctcctctagtagggtgttagaaagtaccccataataataacaatattaaccaaaacccatcgtgagggccgtgttgaaatagtgatgattgggagaagcaccgtgtgccgtcttaatagtatggggatatcgtgtccccctctaagtaaaccagaatacatacacgtacaatatagtctaataatatacccctctctcc

SEQ ID NO: 49378 - protein, 127 aa, Zea mays
  misc_feature: Ceres CLONE 1460292-F
  misc_feature (118)..(118): Xaa is any aa, unknown, or other
MRRLALLFLLPLLLATGVTTASAEPATPPASPPPPPPPCSKGELDKFAYYHGGSCSNVFQRDHVIYQKNGHCNCWEDEQTLTSGRTMNVRGGPQPKLQRAIKVNLQDTAKQQHKQRTXKGRDACLLK

SEQ ID NO: 49379 - DNA, 755 bp, Zea mays
  misc_feature: Ceres CLONE 1460299-F
  misc_feature: Encodes the peptide sequence at SEQ ID NO. 49380
  misc_feature (413)..(413): n is a, c, t, g, unknown, or other
aaagctggagctccccgcggtggcggccgctctagaactagtggatcccccgggctgcaggaattcgcacgagaccattacctagaacatcctaatcgaaaagtagttgagttcttgtatttgcttgaatctggaaaaaaaaactagagacaaaaggaggacgggaaacggagagaaggatcatggactacagcatgcagggatccaaggactcctcctcgccgcaagttcacaaccacttgtacccggacgctcagcctgggctgtatcctcctcctccgccggcgccgccgccggcgatggcgaacccgccgcaggggggctacggctacggctaccaataccagggctacctcggcgaagcggcgaaccctcctcctccttattactacactggcagctggcccgagcancccccaactctgtccgacggcgccccctttcgctaccgctacctgcaggaccaggacgatgccaactgcatcaccttcctcagaggatgtcttgctggtaagtgctgctgctgcttactggagcgatgctgcatctaaagaggatggcgtgcagtgctgctgcctggagcacgcatgtatgcagcagtgtggtggtgacataataataataataataataagctgctgcggcagcagagatgacggttcctgcgttgacggcgccttccatgtaaaaccaaggagcagctggccatcctcatgtctctcgtcgtccttggtcttcaaaaaaaaaaaaaaaaa

SEQ ID NO: 49380 - protein, 122 aa, Zea mays
  misc_feature: Ceres CLONE 1460299-F
  misc_feature (77)..(77): Xaa is any aa, unknown, or other
MDYSMQGSKDSSSPQVHNHLYPDAQPGLYPPPPPAPPPAMANPPQGGYGYGYQYQGYLGEAANPPPPYYYTGSWPEXPPTLSDGAPFRYRYLQDQDDANCITFLRGCLAGKCCCCLLERCCI

SEQ ID NO: 49381 - DNA, 754 bp, Zea mays
  misc_feature: Ceres CLONE 1460300-F
  misc_feature: Encodes the peptide sequence at SEQ ID NO. 49382
  misc_feature (754)..(754): n is a, c, t, g, unknown, or other
atagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctcaccgcctccgtggtggggctggccgtggccacgccggtgttcctgatcttcagccccgtgctcgtccccgccgcgctgctcatcgggacggccgtcatggggttcctcacgtcgggcaggctggggctcgggggcctgtcctcgctcacgtgcctcgccaacacggcgcggcaggcgttccagcgcaccccggactacgtggaggaggcgcaccgcaggatggcggaggccgcggcgcacgcgggccacaagaccgcgcagggcggccatgcccatccagggcagggcgcaggaagcccggcccgggggaggtgcaagtgcccggccctggcggccgcggan

SEQ ID NO: 49382 - protein, 182 aa, Zea mays
  misc_feature: Ceres CLONE 1460300-F
  misc_feature (44)..(161): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGFLTSGRLGLGGLSSLTCLANTARQAFQRTPDYVEEAHRRMAEAAAHAGHKTAQGGHAHPGQGAGSPARGRCKCPALAAA

SEQ ID NO: 49383 - DNA, 914 bp, Zea mays
  misc_feature: Ceres CLONE 1460310-F
  misc_feature: Encodes the peptide sequence at SEQ ID NO. 49384
  misc_feature (9)..(9): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (418)..(418): n is a, c, t, g, unknown, or other
  misc_feature (527)..(527): n is a, c, t, g, unknown, or other
gggggttgncaacaaaacnnncccccnnnncccccnnnttcaatactggagctccaccgcggtggcggccgctcttacctagtggatcccccgggctgcaggaattcgcacgagaccattacctagaacatcctaatcgaaaaaattccccactcgcccaccaaccttcccgtccccgatggcgatcatggcggccaccgccactgccggggcttccccctccagctccacctcgccagggcccctccaccccagcccccgcttcctctctcccgtctccacgcccgctcggtgccgtctcctccccaagccgcggcggtggtgcgcgcgcctccacatcaagcgtcggatggacgtcggtatcgacgggtcctcgttccaagacttgtttaccaaggaggttgttgttggacccccnaccaaatagcgcttggtttaaaagtgaaaaaaaattcgttccaaacccccaaaaaaaaaaaacggacaagaaacccacctcttcaccgcaaggcagacacaaaagaaanaacaatttaagtatgcgaaggggcgaagccgtgtatatgagctaatcgtcgccgattgatggccttaggtgcttgtggtctggagctgggcctcggcccgtcactaatgtcgggttccggtctgcgccaccccccgtagccgtagaggaatacaatatcctaaatatccccccctagtcggaatcactgaggtctttggggcccgactaagtactcgttgttctttcttttcgcccgtatactgtcgcgattagcgatagactattagggttggggcggccctctccagctacacgcttcagagtaggcgctgctgggcctactcatcgtggctcggtgcacgttgtgcatctcgccgcgtcttggattaggtaacaccacgtcgtc

SEQ ID NO: 49384 - protein, 82 aa, Zea mays
  misc_feature: Ceres CLONE 1460310-F
MAIMAATATAGASPSSSTSPGPLHPSPRFLSPVSTPARCRLLPKPRRWCARLHIKRRMDVGIDGSSFQDLFTKEVVVGPPTK

SEQ ID NO: 49385 - DNA, 823 bp, Zea mays
  misc_feature: Ceres CLONE 1460311-F
  misc_feature: Encodes the peptide sequence at SEQ ID NO. 49386
  misc_feature (16)..(16): n is a, c, t, g, unknown, or other
  misc_feature (17)..(17): n is a, c, t, g, unknown, or other
  misc_feature (28)..(28): n is a, c, t, g, unknown, or other
  misc_feature (40)..(40): n is a, c, t, g, unknown, or other
  misc_feature (41)..(41): n is a, c, t, g, unknown, or other
aactcttttggcacgnnttattttcgcngggggcccaaannatcatagctggggctccccgcggtggcggccgctctttaactagtggatcccccgggctgcaggaattcgcacgagaccattacctagaacatcctaatcgaaaaaattttcgaagaaacaacgaatcccgcctcaagaccacgcgagtgcgcaaggggaagcaggaatacatccgttcccggcctccgcgagtgcgcaaggggaagcaggaatacatccgttcccggcctccgctcagccgtcgatcgatcgttcgtctggtccaggggcgtctcaattggccggggcgatggaggaggacccgctcatccagctggtgcacgtctggagcaacgccacctgcgacaacgccgccgcctcatcctccgtgtgtgtgggccattccccggcgcccgcgagcgcccgcgagggaaaaccccacaaagaaaacctccggcccgagccctactttgaggccgagatcggccacactcaaggcggaaatcctgcgcttggcctcccgcctccaccacttccgcacctcccagcagcttgcaccccccctatgtgcggcagaggtcgcacccggcgccccgaaacaaaagcgtggggcagtgcgcccgcggccctcgagggtcccaacctggagacccctcaacatcgtcctctggcgtcaaccccaatctgctccccactgacaaattttattccgcctcggccccgcgtcaggggttgaaaccgatctaaggtagggccccggcgggcgagccgagggaagggagctttcacctggcgcactcgg

SEQ ID NO: 49386 - protein, 141 aa, Zea mays
  misc_feature: Ceres CLONE 1460311-F
MEEDPLIQLVHVWSNATCDNAAASSSVCVGHSPAPASAREGKPHKENLRPEPYFEAEIGHTQGGNPALGLPPPPLPHLPAACTPPMCGRGRTRRPETKAWGSAPAALEGPNLETPQHRPLASTPICSPLTNFIPPRPRVRG

SEQ ID NO: 49387 - DNA, 829 bp, Zea mays
  misc_feature: Ceres CLONE 1460314-F
aaaactggagctccccgcggtggcggccgctctatactagtggatcccccgggctgcaggaattcgcacgagaccattacctacaacatcctaatcgaaaaataatagttgcggtgcctttttctaccggggaggaggcaggcggcgcgatctggcaccggccatcacgttccctcccgccgcttccccctccctgccctcccgttccccagatccgaggccattataaccatcggatctcacctcggggcgcgtccgcgacatctgggcaagcgagaggtacacccaccatccatgagatggcatgcatcggtaccctcccgaaggcgctgtgcctgagagccgcgccttctgccggtaaggatccggggaacccaagatccttgtggtggccccaaggcgaatgcacacctttcccccccccggtgtgcaaacactggttggggagggtttcccggggcggcccactggaagaaaaaaacctgggacaccttcgaaactttgccaacacatgtcctccccccccgtgataggcgggccaaggggaatttcccgagggcccaaagggggggggggcccaccctcccctgagggaccaaaccggagaatttcccccacaccccatattgaaaaaaaaaaaaagggcacccctggggttttggaacaccaaagtttttggaggggaggggaggcccccacgggaaatatctttttgcagaagaaagcctctcgcaaaatttgggggcactctctgttcgcgcggttgaggggtttttcccccgggcctggggggaacccccccggggcgggagatttatagcaaaatctt

SEQ ID NO: 49388 - DNA, 738 bp, Zea mays
  misc_feature: Ceres CLONE 1460320-F
  misc_feature (377)..(377): n is a, c, t, g, unknown, or other
atagctggagctccccgcggtggcggccgctctagaactagtggatcccccgggctgcaggaattcgcacgagaccattacctagaacatcctaatcgaaaaattattttaactgctctccgtcggactcccaggcgggatagcgcaatgcttctactgttgggtgaggtggatttcctgcgcttccgaacgatggatattttgtataggacccgcgcctggctccaatgggttggggatcgctgggagcttcctcagacgggtcctagatggcaagggcgtctccccgaggagggccgtgcacgactcgtcataccacaagaacccggaggagcaggtgcgcctcggcgttcgtgccggacgatgtgatcgagacnaacccccatcccccaaagtactggagaccggggcccccaccggcgagtacctcccgggggtggtggacaccaacctggtgggagtggtcaatgactctacccccccgaatgcggctaccctctgagttaaggagctggacctaaatgaggggttccccccgatcatctacgtcgagaaggtgcactccgtcccctgaaccgagctcacggacagaaacgtcattgctgcttgctcacactgatcatacgagatgcgtggccatcaagggagattcctggcacatggatgctcttgactgttataaaaaaaatgtggagatggctgttcctgtcaaagagctgctgttcttggtcaaagata

SEQ ID NO: 49389 - DNA, 887 bp, Zea mays
  misc_feature: Ceres CLONE 1460329-F
  misc_feature: Encodes the peptide sequence at SEQ ID NO. 49390
  misc_feature (12)..(12): n is a, c, t, g, unknown, or other
  misc_feature (27)..(27): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
atcgtcccccanacacccaccctacanccccacnnnnnccaaaanatataactggagctccccgcggtggcggccgctctataatagtggatcccccgggctgcaggaattcgcacgagaccattacctagaacatcctaatcgaaaactcttttccgccctccacccctcgcgagctctccacccctccacacgaccctcctcggcggcggcggcggcgatgcagatggcggcgaccaccaccgagtcccaggcgggcgtgccgcctcaacaccctcacgcccacccccacgcgcccccgcggcatgctcacccgcaccaccacatgccgcagccacagggggtcggcatacaataacagcctccaccgcccatggtggccgacgccaccaaccgccgacgagaattttggtaagggagacaccccccatagatcgcccccggacccccccagagatggtttttggggccccgtcaaacacaaacaacccgaacaataattccggaaattccggccgcgcataacgggccgcgaaatgaagaaaaaaatgccccttttccggctctaggtgtacccttcctagatctcctgggaatggaaagaaaaatagtggacttacacatataaccgcgttatttggggcccaaagaaggctgagagcggggtcatccaatgataaaacctcttcccagtccaagcgttataacccgttatcacaccctcccgtggcgtgtaaggcatcacgtgttgtaaaggtgtattgggtgatgtggatccccgcacgcgataaaacgcctctttcacaaaatactttgttgcggccgtttaagctgagcacacacacagtttcgcgggccccatgtatagatgtacccctgtgtccggg

SEQ ID NO: 49390 - protein, 45 aa, Zea mays
  misc_feature: Ceres CLONE 1460329-F
MQMAATTTESQAGVPPQHPHAHPHAPPRHAHPHHHMPQPQGVGIQ

SEQ ID NO: 49391 - DNA, 768 bp, Zea mays
  misc_feature: Ceres CLONE 1460332-F
  misc_feature: Encodes the peptide sequence at SEQ ID NO. 49392
  misc_feature (620)..(620): n is a, c, t, g, unknown, or other
  misc_feature (768)..(768): n is a, c, t, g, unknown, or other
aaagctggagctccccgcggtggcggccgctctagaactagtggatcccccgggctgcaggaattcgcacgagaccattacctagaacatcctaatcgaaaactctcccgcgacccgtaccccgcctcccggttcaaccaaatccctcgcttcatccccaccagcgcaaagccgccctatcgtcctgtcgtgagaagcaatggcgggccgtggcaaggcgattggcgctggtgccgcgaagaaggcgacgtcaaggagctccaaggctgggctgcagttcccagtcggcaggatcgcccgtttcctcaaggccggcaagtacgccgagcgcgtgggcgccggcgcccctgtctacctcgccgctgtcctcgagtacctcgccgctgaggtcctggagcttgctgggaacgcaccgagggataacaagaagacccgcatcgtgccgcgtcacatccagctcgccgtgcgcaacgacgaggagctgaccaagctgcttggtggtgccaccatcgcgagcggcggcgttatgcccaacatccaccagcacctcctccccaagaaggctggctcgtccaaggcttccaccgtcgatgacgatgacaactgaagctgcccactgnagaaagcattcgctaccgtcttgtttcctacgtttagcacgcagttagtcggcatgtctttgagagagctcgatgtgtttggaaatgaccataattcctttccttgttccctaagttcgttgaatcagatgtgaataccgctaaggtn

SEQ ID NO: 49392 - protein, 135 aa, Zea mays
  misc_feature: Ceres CLONE 1460332-F
  misc_feature (19)..(92): Pfam Name: Histone Pfam Description: Core histone H2A/H2B/H3/H4
MAGRGKAIGAGAAKKATSRSSKAGLQFPVGRIARFLKAGKYAERVGAGAPVYLAAVLEYLAAEVLELAGNAPRDNKKTRIVPRHIQLAVRNDEELTKLLGGATIASGGVMPNIHQHLLPKKAGSSKASTVDDDDN

SEQ ID NO: 49393 - DNA, 755 bp, Zea mays
  misc_feature: Ceres CLONE 1460335-F
  misc_feature: Encodes the peptide sequence at SEQ ID NO. 49394
aagctggagctccccgcggtggcggccgctctagaactagtggatcccccgggctgcaggaattcgcacgagaccattacctagaacatcctaatcgtaaaatcgcactcgcgtctctttcctattcgcgccgccgccgctgctgcaagcgccagctcgccgtcgtccgaatagtacactctaacgccgccatggggcgtatgcacagccgcgggaagggtatctcgtcgtcggcgctgccgtacaagaggacgcctcctacctggctgaagaccgccgcctccgacgtggaggagatgatcacaaaggcagcgaagaagggacagatgccgtcgcagatcggcgtcctgctccgtgaccagcacggtatcccccttgtcaagagtgtcaccggcagcaaaatcctccgcatcctcaaggcccatgggctggcacccgaaatcccggaggacctgtacttcctcatcaagaaggcggtggcgataaggaagcaccttgagaggaacaggaaggacaaagactctaaattcaggctcattcttgtcgagagcaggatccaccgcctttgccgctactacaagcgcacaaagaagcttccccccacgtggaagtacgagtcacccactgcaagcactctggtggcctaagcgaggagctcagcgtaccggcgcttgaaagccgagggcattgttggaaaacatttttatgtaccgtttttagagttgggaaggaactaaagatggtgaatgtccctc

SEQ ID NO: 49394 - protein, 151 aa, Zea mays
  misc_feature: Ceres CLONE 1460335-F
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
MGRMHSRGKGISSSALPYKRTPPTWLKTAASDVEEMITKAAKKGQMPSQIGVLLRDQHGIPLVKSVTGSKILRILKAHGLAPEIPEDLYFLIKKAVAIRKHLERNRKDKDSKFRLILVESRIHRLCRYYKRTKKLPPTWKYESPTASTLVA

SEQ ID NO: 49395 - DNA, 716 bp, Zea mays
  misc_feature: Ceres CLONE 1460337-F
  misc_feature: Encodes the peptide sequence at SEQ ID NO. 49396
  misc_feature (461)..(461): n is a, c, t, g, unknown, or other
ggatcccccgggctgcaggaattcgcacgagaccattacctagaacatcctaatcgaaaaagggcgagctcaagcctcaagctgggattggcccgtcggcagaacaagtgcacgcgggaccgggcaacatttcccgctgcagccaacaagcagagggggcgacgatatatagccacgggcggccgttgctggatccggcatcttcctcgatcggcaagacgataggatggggttccacctgctggcgttcgtggcggcgaggggcctcatgcaggcgttcaacctgtcggcgccgctcagcctccggctgccgctcgcgcgccacctgccggaggccctcgccgtcctgtacggcgtgctcgccgcgcaagccgcgtggctcaacggcgccctggcgcgcggcgccgcctggagccacagcgggagccggggcggcgtcgacgagtacgtccgccacgccntgctcagcgtctacgactgagaccaccggcggaaggtcgacggacagcaggcgccacgcgagggcgcttctagctgctgtccctgcccccgtctgctcgtgggggaaagggacgccgcggcggaggcggcgccgccctctgctagctagctgcgactagcaccgaagatctttgtaattcattggtcgctcgcccgttgggcgtatcttcctgttccgaacaggatttttgaaaacacccaaaagtttgggaggt

SEQ ID NO: 49396 - protein, 84 aa, Zea mays
  misc_feature: Ceres CLONE 1460337-F
  misc_feature (79)..(79): Xaa is any aa, unknown, or other
MGFHLLAFVAARGLMQAFNLSAPLSLRLPLARHLPEALAVLYGVLAAQAAWLNGALARGAAWSHSGSRGGVDEYVRHAXLSVYD

SEQ ID NO: 49397 - DNA, 748 bp, Zea mays
  misc_feature: Ceres CLONE 1460338-F
  misc_feature: Encodes the peptide sequence at SEQ ID NO. 49398
  misc_feature (345)..(345): n is a, c, t, g, unknown, or other
  misc_feature (346)..(346): n is a, c, t, g, unknown, or other
  misc_feature (349)..(349): n is a, c, t, g, unknown, or other
  misc_feature (420)..(420): n is a, c, t, g, unknown, or other
  misc_feature (439)..(439): n is a, c, t, g, unknown, or other
  misc_feature (508)..(508): n is a, c, t, g, unknown, or other
gctctagaactagtggatcccccgggctgcaggaattcgcacgagaccattacctagaacatcctaatcgaaaaaaattgtaaccgtgttgcaacttgcaaccggcctatctccttgcccgcgaagccatggcggatgcccccgcgatggcctcatcaccaccggcgtccgctgacgacggcggtccatcctcgccttccgtagccgtccctcgtgtacttccctccagattgctcctagacaccccgcctccttccagcggtagggcgcggggcccgcggggcggcagtgcggctgcggcttcggggcgcggcggcagtgcggctgcggtgttgaggggttttnnccnacgcggaggcactgaggagggaatcttttttgacggctgcgggcttcaaacgccacccgaaccaggaggcncgaacggggactggctcgnccaaggcggttatgatgatcggggcggccagtctagggacgggaactggaatccgccgaccttcttcanttggttatggggaagggccctatgttcctcgtgcctgaactactggcccctaggaggggtacccccagggaagatcttcccaactgaacccccgggggctttccctcggccgccgctagggggaaaacccgttctgggctccctggggggctctgcaaacgctagtgctctctctaccggggcagcgtgggttcacaaagcactcaccacctccacgcccttccgccctctctccccaag

SEQ ID NO: 49398 - protein, 206 aa, Zea mays
  misc_feature: Ceres CLONE 1460338-F
  misc_feature (73)..(73): Xaa is any aa, unknown, or other
  misc_feature (74)..(74): Xaa is any aa, unknown, or other
  misc_feature (98)..(98): Xaa is any aa, unknown, or other
  misc_feature (104)..(104): Xaa is any aa, unknown, or other
  misc_feature (127)..(127): Xaa is any aa, unknown, or other
MADAPAMASSPPASADDGGPSSPSVAVPRVLPSRLLLDTPPPSSGRARGPRGGSAAAASGRGGSAAAVLRGFXXRGGTEEGIFFDGCGLQTPPEPGGXNGDWLXQGGYDDRGGQSRDGNWNPPTFFXWLWGRALCSSCLNYWPLGGVPPGKIFPTEPPGAFPRPPLGGKPVLGSLGGSANASALSTGAAWVHKALTTSTPFRPLSP

SEQ ID NO: 49399 - DNA, 776 bp, Zea mays
  misc_feature: Ceres CLONE 1460339-F
  misc_feature: Encodes the peptide sequence at SEQ ID NO. 49400
  misc_feature (621)..(621): n is a, c, t, g, unknown, or other
  misc_feature (629)..(629): n is a, c, t, g, unknown, or other
  misc_feature (694)..(694): n is a, c, t, g, unknown, or other
  misc_feature (697)..(697): n is a, c, t, g, unknown, or other
  misc_feature (698)..(698): n is a, c, t, g, unknown, or other
aaactggagctccccgcggtggcggccgctctagaactagtggatcccccgggctgcaggaattcgcacgagaccattacctagaacatcctaatcgaaaagttgtcctcaaggttgctatgtcatgcgagggttgcgcgggggcggtcagaagagtgctctccaagatggaaggttgagttgaaaccttcgacatagacctcaaggagcagaaggtgacagtcaaaggcaatgtcaagcctgaagaagtcttccagaacggtttccaagtcggggaagaggacctcctactgggagggcgaagccacggccccggaagctgccggcggcttctggaaccgaagcacctcccggcaccgcggcagaagcgcctcctgcctgctgctccggcggcgccagaaatcaccccagccaaagctgacccctgatccgtcacgcctattattccctccacatgtgatgctgcggctgccgactcctaaaccttaaatcctagaaatagctggggattgggtttgcattgcatccgtgttccttgccggtctagcaagtgactataagaataatggaataaacgatgacccagtgtgtgtatgatttccgttctgaaaacaacacatnccttgcangattgttgttcagtagattctacttgtaccgcgggctttggagttccgcaaaagactttacttgntcnnaaaaaaaaaaagaaaaaaaaaaaaaaaagcttatcgataccgtcgacctccgaggggggcccggtacccattttcccc

SEQ ID NO: 49400 - protein, 58 aa, Zea mays
  misc_feature: Ceres CLONE 1460339-F
TGAPRGGGRSRTSGSPGLQEFARDHYLEHPNRKVVLKVAMSCEGCAGAVRRVLSKMEG

SEQ ID NO: 49401 - DNA, 761 bp, Zea mays
  misc_feature: Ceres CLONE 1460340-F
  misc_feature: Encodes the peptide sequence at SEQ ID NO. 49402
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (715)..(715): n is a, c, t, g, unknown, or other
  misc_feature (748)..(748): n is a, c, t, g, unknown, or other
aaactggagctccccgcggtggcggccgctcctagaactagtggatcccccgggctgcaggaattcgcacgagaccattacctagaacatcctaatcggaaacttgggctcgcagtcgcagcaacgatggggaggtcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaaatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggaccctgtcaccccccnnnnnnnnnnnnagaaagaaggaggagccatgcttgctgaggccggtgaaacgggaagaggccgggctctgcttcagctgcagcctggggctccccaagagcgcnggactgcaagtgcagcaacttccctcggctcangaacgcccatgtt

SEQ ID NO: 49402 - protein, 211 aa, Zea mays
  misc_feature: Ceres CLONE 1460340-F
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature (162)..(162): Xaa is any aa, unknown, or other
  misc_feature (163)..(163): Xaa is any aa, unknown, or other
  misc_feature (164)..(164): Xaa is any aa, unknown, or other
  misc_feature (165)..(165): Xaa is any aa, unknown, or other
  misc_feature (166)..(166): Xaa is any aa, unknown, or other
  misc_feature (197)..(197): Xaa is any aa, unknown, or other
  misc_feature (208)..(208): Xaa is any aa, unknown, or other
MGRSPCCEKAHTNKGAWTKEEDDRLVAYIKAHGEGCWRSLPKAAGLVRCGKSCRLRWINYLRPDLKRGNFTEEEDELIIKLHSLLGNKWSLIAGRLPGRTDNEIKNYWNTHIRRKLLSRGIDPVTHRPINEHTSNITISFEDWGQGKALKCPDLNLDPVTPXXXXXKEGGAMLAEAGETGRGRALLQLQPGAPQERXTASAATSLGSXTPM

SEQ ID NO: 49403 - DNA, 740 bp, Zea mays
  misc_feature: Ceres CLONE 1460342-F
  misc_feature: Encodes the peptide sequence at SEQ ID NO. 49404
aaagctggagctccccgcggtggcggccgctctagaactagtggatcccccgggctgcaggaattcgcacgagaccattacctagaacatcctaatcgaaaaaccaccaccgagcttatctcctcccgtctaggcgacgacgacgactaatcagcgggaggagcataagcgccgccgatcccgagcatacgagcgagttctccactcatcctccgcctcgtgccggagatccctacgtaggccgcccgccggccatggcccgctcctcctcgcagtcgcagtcctccgttggcgctggcgccggcgccggcgcgcgcccggccaccgtaggggctcacgggaagatcaggatcagcacagggatgttccgcctcagcttcatcgattctggtggtggaacggatcctccccgcgccgcggtggcccctgcccgggtatggactccgtgggcgccggcccgtgttagagcatgcctgttgggcgaatgtggccaggttttagtttggccgcacccccgggcttccgggggaggaacgttcgggggggggcggccctgggcgttccgacctttcggagacttttggaccaactttgggagcccaaggggttacacccccggggtctcgccccggggtttaagttgggggggggaaacccccccctgggggtgtccgagtgttggggggccctttttttaagggaaaaaacccgggggccgggtcccaggggggctcattgga

SEQ ID NO: 49404 - protein, 147 aa, Zea mays
  misc_feature: Ceres CLONE 1460342-F
MARSSSQSQSSVGAGAGAGARPATVGAHGKIRISTGMFRLSFIDSGGGTDPPRAAVAPARVWTPWAPARVRACLLGECGQVLVWPHPRASGGGTFGGGRPWAFRPFGDFWTNFGSPRGYTPGVSPRGLSWGGETPPWGCPSVGGPFF

SEQ ID NO: 49405 - DNA, 771 bp, Zea mays
  misc_feature: Ceres CLONE 1460344-F
  misc_feature: Translation starting site: 232
aaagctggagctccccgcggtggcggccgctctagaactagtggatcccccgggctgcaggaattcgcacgagaccattacctagaacatcctaatcgaaaagactgaaatcaattcactcaccttgacgaaccacctaagatccggaatggctctccaggcctgctactggatgatagcactgaaaatcctatacttcctcatcatcctacccccaaatagctcctcactatggactacttggcacaactggcagtattgtactggaagttgacccctgactgctacgagcatgattcccacctaccccagattacacatgaaaggggttactattacctgtatatgcttgatctgtgtcccgacaaactctgcacctactacgacaacctgaagaactttttcacactaacacattcccacggacgaagagattccctactgcctaccaggaactggctactttgatgctatgcacaaggatgaccgctggatccgaatctggatgacacccggcgatctcattgtccttcctgccggaatctaccaccggttcacgctcgacaccagcaactacatcaagctcatgatcctgtttgtggtataaccggtttgtacaccatactacctgtcgcaggaagaacacccggttacgaaggaccatataacgagctcaccccacaagtttggagaaagcatgaagctcattagaggcatacactgtggcgcacttcgatggattcgctacccagttgggctcggaagatatta

SEQ ID NO: 49406 - DNA, 765 bp, Zea mays
  misc_feature: Ceres CLONE 1460345-F
  misc_feature: Translation starting site: 232
  misc_feature: SWISSPROT Homolog: EC 3.4.25.1 Proteasome endopeptidase complex
aagctggagctccccgcggtggcggccgctctagaactagtggatcccccgggctgcaggaattcgcacgagaccattacctagaacatcctaatcgaaaaactttttggtcgggacgcggtcaaagtctcgaccctcgacgctcttgtctcgtctccggagtgtacgtcaaatcaggtgcggtgcgtccccctcggttaacgtgccaggatcatacttctgtcaggaaggatgaaggcctccttggatatcccgtccaaggcctggctcaccttcgacctgagccgcaggaacaccttgctgaataataaccggttcaacgtcccggcattcaagagtaccggcagaaccgtcggcggcctcatctttctagagtgggttgctcttggctgacacgcaatggccactgaagtccccctcgttgctgatgctagttgtgaccaactccactttatggcatctaatatatattgctgtggagcgtgaactgatgtggaacttgccggcgtctagaatatggtgagctctttgctacatcttctccgttaagcatcaggccgcgaattcagagttgtatctgctcttacactacctgaatcacactttctcaagtgtcaaaggtatgctctgcgctgcgcttgttgttggtggactgcattgtcctggtccacatttaatgactgtgtatgcacacaggcctactgatgctcttccttgtagcacaagagatctagctcacttgctgcaatgaacctgattggatgc

SEQ ID NO: 49407 - DNA, 771 bp, Zea mays
  misc_feature: Ceres CLONE 1460345-R
  misc_feature: SWISSPROT Homolog: EC 3.4.25.1 Proteasome endopeptidase complex
ggaattattacgttctcaggatttaatcttcggtaatggatagcaattgctttgtgccaaacatttgaaacacatttggcatcagatccctggttttggtccagctagtacggctgagatctccaaattttcttttttcttggtctagctgatccactaagcaaagtgtactcagattcagaatatgctcgcatgaatgcctgatgcaagatcattcctcgatagcatcacctccctcggggacatctaccgtcggctttagaactgcgaccttggtagacgttacctcagtctgcccctgggtgaaactgtatccctttgaactagcataagtcctgggattcggcaactggtggtctctcgaatattcttgtcttcgccttggttatcacgcagacgtccacgttgctcccactacccaagtcattgaaaataccagcacagattgcttcgcacacaatctgtattccctcctccctagtaaggccttctttgtacttcgattcaaacactgacattgcagcaagagaaccagagcccatggtggcaaaaggaagagtatcagtggacccgtgtggataaacagtgtgtaaatgtggcccagtacaatccactccaccaagttcaaagggcagcactggacatggccctggatacttggaagaggtggtgactttcaggtaggtgtaaagagcagtttacaaactctttggattcgccgggcccgttttcaattaccgggtaaaaactggtaaccctgggggagcctca

SEQ ID NO: 49408 - DNA, 760 bp, Zea mays
  misc_feature: Ceres CLONE 1460347-F
  misc_feature: Encodes the peptide sequence at SEQ ID NO. 49409
  misc_feature (285)..(285): n is a, c, t, g, unknown, or other
  misc_feature (286)..(286): n is a, c, t, g, unknown, or other
  misc_feature (339)..(339): n is a, c, t, g, unknown, or other
  misc_feature (359)..(359): n is a, c, t, g, unknown, or other
  misc_feature (494)..(494): n is a, c, t, g, unknown, or other
aaagctggagctccccgcggtggcggccgctctagaactagtggatcccccgggctgcaggaattcgcacgagaccattacctagaacatcctaatcgaaaactcgtctcgtccaccagctgagctgcgcccgttttagcgagcgagacaggtccgcgcgcgtgcgccggcgaggattggattggaaccgtcgcccgtcggtcgtcgatggggatccacctggtggcgttcgtggcggcgaggggcttcctgcaggtgttccaggtgtcggcgccgctgctgtgnnccgctcaaactctgggatgcgctcgcgcgccacgtgcccgaggcctgcgccgncttctacgacgccctcgtcntcgacgccgccagctggcgcgcaccgtctggcgtcgccgacgcgacagcggggacgccctcgagaagtacctcgcagcgcatcgtgcttaccctctccgactgaaactcctgaactagggggggcccactggcantgcaagaaaagtccttaccggaaggtgggtggaccggccggccgccccggccgcctttatttttaaaaccctaccagggaacgggtaacccgtgggtttgtggggtttcctggggccccctttttttggggttttcgcgggggggttattttgtttttccaaaaacctgggttggggggctccaagaggtaggtggggaacccccgggggtgttttttttggcccccccggggggcgccatataaaaaaaaatttttttttaaaaa

SEQ ID NO: 49409 - protein, 89 aa, Zea mays
  misc_feature: Ceres CLONE 1460347-F
  misc_feature (26)..(26): Xaa is any aa, unknown, or other
  misc_feature (27)..(27): Xaa is any aa, unknown, or other
  misc_feature (51)..(51): Xaa is any aa, unknown, or other
MGIHLVAFVAARGFLQVFQVSAPLLXXAQTLGCARAPRARGLRRLLRRPRXRRRQLARTVWRRRRDSGDALEKYLAAHRAYPLRLKLLN

SEQ ID NO: 49410 - DNA, 824 bp, Zea mays
  misc_feature: Ceres CLONE 1460350-F
  misc_feature: Encodes the peptide sequence at SEQ ID NO. 49411
  misc_feature (22)..(22): n is a, c, t, g, unknown, or other
  misc_feature (28)..(28): n is a, c, t, g, unknown, or other
  misc_feature (30)..(30): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (497)..(497): n is a, c, t, g, unknown, or other
  misc_feature (522)..(522): n is a, c, t, g, unknown, or other
  misc_feature (647)..(647): n is a, c, t, g, unknown, or other
  misc_feature (648)..(648): n is a, c, t, g, unknown, or other
  misc_feature (706)..(706): n is a, c, t, g, unknown, or other
ggataattagatataattaagnaacggngnggcttgaannncaaagtggaactccccgcggtggcggccgcttttttctaatggatcccccgggctgcaggatttcccacgagaccattacctagaacatcctaatcgaaaaagcttggcgtttgccatctcttatattgattgcgactattggcgattgtgtatgtgtagtgagcctctcgaggaacgagagcctccagaccagatcgtcttcagatctggaggaggagagggttggactgactaccaccgagacccaggtgggcgagctgccggaggtgtgcctggcgcaggccatctcgcggacctccccgcgcgacgcctgccgctgcgccgccgtgtcctctgccttccgcgtggccgccgactccgaccagttctggagtgccttcctccccgagcagttctaggtgatcgatgaccacttggacagccgccgcgtgtctccgccgtcgcaggcggctcanccatcggcgaccgtgcgctgtctcngcaagagggaagcctacctcagcctctgctacgttgccggttcggtgaccggacactgacaactggtgcaaggtgtggcctggaaagggccacccgctctccagtgctaaatgcttttctgttcnnttgctcaaccagtcctgggcactacgggccagttctcctgggaggttataaggaaaanccatctttcaatttttttagaattttgcgggaatttgtgggaactggaattggcctggaaaatcaatagtgagcccggaccactgggcctggtcttaactcttagataaggcttctaa

SEQ ID NO: 49411 - protein, 60 aa, Zea mays
  misc_feature: Ceres CLONE 1460350-F
  misc_feature (6)..(6): Xaa is any aa, unknown, or other
  misc_feature (25)..(25): Xaa is any aa, unknown, or other
MLFCSXAQPVLGTTGQFSWEVIRKXHLSIFLEFCGNLWELELAWKINSEPGPLGLVLTLR

SEQ ID NO: 49412 - DNA, 767 bp, Zea mays
  misc_feature: Ceres CLONE 1460352-F
  misc_feature: Encodes the peptide sequence at SEQ ID NO. 49413
  misc_feature (346)..(346): n is a, c, t, g, unknown, or other
  misc_feature (387)..(387): n is a, c, t, g, unknown, or other
  misc_feature (434)..(434): n is a, c, t, g, unknown, or other
tccccgcggtggcggccgctctagaactagtggatcccccgggctgcaggaattcgcacgagaccattacctagaacatcctaatcgaaaaaccgcgcggcctcgatttccccttaacacaacacagaggaagcaggcggcggcgatcgggcgatggcatggcgggcgagcctgtctcggagcctaaaggagatccgcgtcctcttctgtcagtcctccccggccagcgccgccgcccgtgagttcgtgaagaagaactatggtgacatcaaggctcgcaacccctccctccccttccttgtccgcgagtgctccggtgtccagccccagctctgggcgcgctacnatatgggtgtggagagatgcgtgaacttggatgccctgacnggagcccagattgataaaaagctggaggagcttgccaaggcccggcnagtcctctaaaaccaaatagtttttgaaactcttccctggcattgtttaccttccccaaataaaggatgccctatgggtgagacattggtaaccccaaccgtttccgggaagtgtggccgggaaataaaccttaaatggggttaacttttgggaaaaaaccacaccccttttttttggcccgggcaaaaaaaaaaaaaaaaaattttttcctccccccccaccccggggggggggcgcgggaccccattttcccccaaataggggcaatataaacccgcccctccgggggcctttttttaaagggcggtggagagaaaaccccggggctcccc

SEQ ID NO: 49413 - protein, 96 aa, Zea mays
  misc_feature: Ceres CLONE 1460352-F
  misc_feature (20)..(93): Pfam Name: L51_S25_CI-B8 Pfam Description: Mitochondrial ribosomal protein L51 / S25 / CI-B8 domain
  misc_feature (65)..(65): Xaa is any aa, unknown, or other
  misc_feature (94)..(94): Xaa is any aa, unknown, or other
MAWRASLSRSLKEIRVLFCQSSPASAAAREFVKKNYGDIKARNPSLPFLVRECSGVQPQLWARYXMGVERCVNLDALTGAQIDKKLEELAKARXVL

SEQ ID NO: 49414 - DNA, 765 bp, Zea mays
  misc_feature: Ceres CLONE 1460355-F
  misc_feature: Encodes the peptide sequence at SEQ ID NO. 49415
aaaagtggagctccccgcggtggcggccgctctagaactagtggatcccccgggctgcaggaattcgcgcgagaccattacctagaacttcctaatcgaataagctggcaagggttgcgtctcagttccgggttgagttggtgtaagctcccaggtttcttctcttcgcgtgaactacctacactaaactgttatctcgaggaaaaacgatgtcatgctgcatatgaaactgcggttgcggcagcggatgcaagtgctgaagctgttgctgaggatgcaaaatgtacccggacatggctgagcatgtgaccaccaccaccaccatcatgggtgttgcaccatccaaggacgggttcgaggcggccgccggatctgagaacagcggatgcaattgcggctcccccagctgcacctgctacccctgcacctgcaagtgaggatgaccggatgcagcatgcaagccgtgacgatggatgaagtagatcggaatgacacccttcaatatctctagctaaatcacgctctgacagtatgttgtatcagcgtcatctgtgtttgccgccatgcgtagctagactactagtggtggtaaacgaatgattgtcctgttactcttgctccacgacccctggcactgttccgtcctagtggccatccagctgcatgctcatcatcagacatgcccgctgctatgtaagagctctagactatagcatccaaactctgtttgttagctctagacctcgacccagttcgagactatgc

SEQ ID NO: 49415 - protein, 51 aa, Zea mays
  misc_feature: Ceres CLONE 1460355-F
  misc_feature (1)..(50): Pfam Name: Metallothio_2 Pfam Description: Metallothionein
MYPDMAEHVTTTTTIMGVAPSKDGFEAAAGSENSGCNCGSPSCTCYPCTCK

SEQ ID NO: 49416 - DNA, 778 bp, Zea mays
  misc_feature: Ceres CLONE 1460356-F
  misc_feature: Encodes the peptide sequence at SEQ ID NO. 49417
  misc_feature (487)..(487): n is a, c, t, g, unknown, or other
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaactataggactccgctcctttgagctcccctcccctcgcatcgcatcgcatcgatcctcccatctgcgcacccgcaagcctattcgccgcacctcctcaggtgaccgggaagatgatgccgttgaaccaaaccgacttctcgccgtcccagttcacctcctcccagaatgccgccgccgactccaccaccgccttccaagatgcccggcgcgtccagcaccatgccgctcaccgtgaagcaggtcgtccacccgcagcagtcctggcccgggcgaaaagggcgctcccttcatccgtccaatggcgtccagatggctaacattccacttgtggggatggtcaatgccaaggtggaacggacgaccgatgtgaccttcccgctccgnacatggcaccggccgcctcgatttcatcagatgggtgaatgatgcttcaaattccttttgaaactgctgctattcagaatggtatgtacattgcggtcattggaaccctcaagggactgcaagagaggaagcgtgctactgctttctcaatcaggcctataaccgatttccatgangttacgctgcatttcattcagtgtgttcggatgcatatagagacactgaattaaaggctggcagtcctgcacgaatccatccttctatgggagtgtcatcctcaaatggatccac

SEQ ID NO: 49417 - protein, 63 aa, Zea mays
  misc_feature: Ceres CLONE 1460356-F
  misc_feature (46)..(46): Xaa is any aa, unknown, or other
MMLQIPFETAAIQNGMYIAVIGTLKGLQERKRATAFSIRPITDFHXVTLHFIQCVRMHIETLN

SEQ ID NO: 49418 - DNA, 758 bp, Zea mays
  misc_feature: Ceres CLONE 1460357-F
  misc_feature: Encodes the peptide sequence at SEQ ID NO. 49419
ggagctccccgcggtggcggccgctctagaactagtggatcccccgggctgcaggaattcgcacgagaccattacctagaacatcctaatcgaaaaataaagcctcgccagcttatcccccttcctccctcacccgatctctcctcgacggctaacccggattgccgtctcaggctcgggatccgagcgctcgcgtcgatggacggaggcggcagcgctggctcgcgcgcagggggagctcacggcgcatgacacagcactctacaacctccagatccgcgtcgggggcgttgatgcccaaaatagactaactaaggcgcacgtgcttgtgtgtggcatgaacggacccaccatcgagttctgcaggactattgttctagctggagttggaagtttatccttgatggatgatactgtatcctcagaggaggatctgaatgcaaatttcctagttcctcctgatgagagcatatatggtggtagatctcgagcccgagtttgctgcgagtctttgatagatttcaatcctatggttcgagtttctgttgattagggtgatccatcattaattgatggagaattccttgacaattttgagattgttgaacttagccgtgcatctcttatcacggagttgttgattagtgatgactgtcgaatcataagcacactcttgcatgctatactatagattgcaaggatgcatgcggtgaactatatgttgacttactgaggcataactatgttcatgataagcg

SEQ ID NO: 49419 - protein, 71 aa, Zea mays
  misc_feature: Ceres CLONE 1460357-F
MNGPTIEFCRTIVLAGVGSLSLMDDTVSSEEDLNANFLVPPDESIYGGRSRARVCCESLIDFNPMVRVSVD

SEQ ID NO: 49420 - DNA, 771 bp, Zea mays
  misc_feature: Ceres CLONE 1460361-F
  misc_feature: Encodes the peptide sequence at SEQ ID NO. 49421
gctctagaactagtggatcccccgggctgcaggaattcgcacgagaccattacctagaacatcctaatcgaaaaaatatcataaccatcccacttcctcccgaggtacgaaaccaagaccatggctggaacggccaaaacccccgtcctcggcttcgtccttgctcttgctcttgtcgccacctcgacgccggctgcagctaccaccctgacgctccacagccctgcgtccgtaccccgtgtggccgctggcgagcccgaatccgaggtccccgccgtctccgataacacggcgtgactctatggtcgaggacgacggctggtctccttacgcttcacggacatatgctggccaggccgtgtgaagcctggaaggggaatccactacggacaccaccgctgctaagacggggaactcatcgcccggtgactgtggctggacttgggggggggacctaaagccccagaacttgggcccttacataaaagacggggggaaggtttcaagtggccccccattttcacccccccgcccgggggggttgggaaattcccgcgccctggggagagggtttgagcttaacgccggggtcccccccccctacctctgggccggggcgcgggaaattcttttttttttataagggacccccgggcgcccacctaaaaaatttgttcccgagagagcgctcccaccccccccaggctataaaccgcggggatgtgggtgttttccccaaagaaaaataaatttttgttttttcaaaacaaa

SEQ ID NO: 49421 - protein, 58 aa, Zea mays
  misc_feature: Ceres CLONE 1460361-F
MAGTAKTPVLGFVLALALVATSTPAAATTLTLHSPASVPRVAAGEPESEVPAVSDNTA

SEQ ID NO: 49422 - DNA, 794 bp, Zea mays
  misc_feature: Ceres CLONE 1460362-F
  misc_feature: Encodes the peptide sequence at SEQ ID NO. 49423
  misc_feature (759)..(759): n is a, c, t, g, unknown, or other
aagctggagctcaccgcggtggcggccgctctataactagtggatcccccgggctgcaggaattcgcacgagaccattacctagaacatcctaatcgaaaaatccccaatctccaacccaacaataaaaatggccaccgccaccactgaagccgaagtccgtgagtccctcggcacgaagttcggtcgcctcacggaacaggcgaaagacatggcctccaggcaccccgtcgctggagccgcggccgtcatctctgtcagcgccgtgggcgcctacttcttgtggcctgtgcgagccccggccgtggccatgatgaatgcccctgaatccggcggagtggtcatctcccaggcggcgtctctcgcaaagaatgggctggacttcaagctgctagaaaactggggaagttgcgccccaccccccccacattaagctgcactgtacatgtgggaaatgtaccttgctgaatcgggcaacaatcgattggcccaacctttccaggtggaattttaacagggagggtgccaaaattttaccttttcctttgggggaaacccccgacctccgaattgggaattaaggggaaaaaccacttttgtttcccgagaagaggaaaataccccccgccccccctttctttttaacaaaaaggaaaagagttggtctctctccccccacaaaagagaagggcttttctcttttctccaccccctgggggggggggcacagaaaacaattttgctcttatagagagggagnaaaatctcccccctttttggagcgccgaaaaaaaa

SEQ ID NO: 49423 - protein, 100 aa, Zea mays
  misc_feature: Ceres CLONE 1460362-F
MATATTEAEVRESLGTKFGRLTEQAKDMASRHPVAGAAAVISVSAVGAYFLWPVRAPAVAMMNAPESGGVVISQAASLAKNGLDFKLLENWGSCAPPPPH

SEQ ID NO: 49424 - DNA, 756 bp, Zea mays
  misc_feature: Ceres CLONE 1460363-F
  misc_feature: Encodes the peptide sequence at SEQ ID NO. 49425
aagctggagctccccgcggtggcggccgctctagaactagtggatcccccgggctgcaggaattcgcacgagaccattacctagaacatcctaatcgaaaaggatctggatccggactcgactcgaagccaaaaccaactcgctctctctcgctctcgcacacggtagacggtacgtcccgctcccgcgcgcggccggccacgcgactggtcaggcgcgaggcgagcgttcacgccgccccgcgcctgctggttgcggacggaggggatatccacgatcagagcggggccagccagcgcgggcgctgcggtcgacgacggtctcctgtgcgcgcgcgatggtggccgcggcgagggtggtgtcgggggtgaaggcggagggtctgctgcggggcgcgtgcgcggcgctggccgcggcggccgcgctgctggtggggctcagcacgcagacggagacggtgctgctcgtccggaagaaaggccaccgtcaaggacgtccaggcgctctgggtgctggcgatggcggccgcgtcggcggcgggctaccacctgctgcagctgctcaagtgcctctacctcggccgccgccgcagcggcagggctctggcctggacgtgcctcctgctcgacaggcgtgcgcgaccctcgaaaaaaaaaagggggggggggggggggaaaaaaaaaggggtggggggggggcccttggaacgccccccccccctctgcagggaacccatcttctgcaacatcctacacc

SEQ ID NO: 49425 - protein, 139 aa, Zea mays
  misc_feature: Ceres CLONE 1460363-F
MVAAARVVSGVKAEGLLRGACAALAAAAALLVGLSTQTETVLLVRKKGHRQGRPGALGAGDGGRVGGGLPPAAAAQVPLPRPPPQRQGSGLDVPPARQACATLEKKKGGGGGEKKRGGGGALGTPPPPLQGTHLLQHPT

SEQ ID NO: 49426 - DNA, 767 bp, Zea mays
  misc_feature: Ceres CLONE 1460364-F
  misc_feature: Encodes the peptide sequence at SEQ ID NO. 49427
aaactggagctccccgcggtggcggccgctctataactagtggatcccccgggctgcaggaattcgcacgagaccattacctagaacatcctaatcgaaaaaaattaatttttccgattagtccacaagtcaatggctaatttgtcttcttccattcttcttctcctttccttcactctctggcttcccgatctcttctctctctctctcgtctctcacatctccagcccttcgccctcttctcggcccgacctcgacggtgttccaccatctcctaccctcttcttttcccgcccgcgccatccctttctccgctgtagccactgcaagccccgcgcgacgcacacggcagtggtccacgtcgaccaaatcgtccacagcatcgcgttctcctcggcgagggtctgtagcctgccggcgaggagctcgcagcgaagatccgtgcaagccaccctccagatcgtcacagtagcagccagacaacaaccatgagtctcgcttgtcttgtatgccatggcatgagcagcccctcgcactctcttagaagctactcggtgtcaagctcagaggaggaaagccggtgtggagctgttgttgcctgcttagctcgaagagtaacaccagctggaacctctactagcgttgggacatcgaaagtgacccccttccccaccgtggtgagtgatcaagttggtacagagggcgctcctcgactttcacgcagccgtgctgtgtccagggaccttgttagagactggaacttcgag

SEQ ID NO: 49427 - protein, 93 aa, Zea mays
  misc_feature: Ceres CLONE 1460364-F
MSLACLVCHGMSSPSHSLRSYSVSSSEEESRCGAVVACLARRVTPAGTSTSVGTSKVTPFPTVVSDQVGTEGAPRLSRSRAVSRDLVRDWNFE

SEQ ID NO: 49428 - DNA, 734 bp, Zea mays
  misc_feature: Ceres CLONE 1460371-F
  misc_feature: Encodes the peptide sequence at SEQ ID NO. 49429
ggagctccccgcggtggcggccgctctagaactagtggatcccccgggctgcaggaattcgcacgagaccattacctagaacatcctaatcgaaaaacacaaagaagctccataattaattattgccctttcagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgttcgcatcttcgtcgacaccgtcgcggaggcaccccacatcggctgagaatcaaatctataaaatgaataactcggacatgtcatgcgtgcatgtccgtcgccgaataatggatgtgtgtgcttcgttccaataaattgctagtaaaaataatggcatcgtcggtatgcatgaataaaatgtatcagaatgttcatcctttcacgattggatatatgaaaatgtgctcagttgtttggtttccaacttgttttctataaggtcgatgaactggaacgcaggctcaaataatgatggaatctgcacaatatagataggttaacgacttagagcatgtacatcttattaattaaatataaaaaaaaaaaaaaaagcttatcgataccgtcgacctcgagggggggcccggtac

SEQ ID NO: 49429 - protein, 70 aa, Zea mays
  misc_feature: Ceres CLONE 1460371-F
  misc_feature (11)..(70): Pfam Name: potato_inhibit Pfam Description: Potato inhibitor I family
MSSTGGDDGAKKSWPEVVGLSLEEAKRVILCDKPDADIVVLPVGTPVTMDFRPNRVRIFVDTVAEAPHIG

SEQ ID NO: 49430 - DNA, 750 bp, Zea mays
  misc_feature: Ceres CLONE 1460379-F
  misc_feature: Encodes the peptide sequence at SEQ ID NO. 49431
ccgcggtggcggccgctctagaactagtggatcccccgggctgcaggaattcgcacgagaccattacatagaacatcctaatcgaaaaatatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaggcggcgggaagacgtcgcagatctacgccattcgccaggccgtcgccaaggggctcgtcgcctactaccagaagtacgtcgacgaggccgccaagaaggaggtcaaggacatcttcacccggtacgaccgcacccttctcgtcgccgaccccaggcgctgcaagccaaaaaaattcggtggtcgcggcgcccgcgccaggttccaaaagtcctaccgttgagcgctcggctgcccccgccttgcgtaccgaagcctgggttggcccaacttgccagtccaaagcctgtacccgtgctttaattttcatccccgaaactacttatgtgggtccataaacaagaggctgt

SEQ ID NO: 49431 - protein, 149 aa, Zea mays
  misc_feature: Ceres CLONE 1460379-F
  misc_feature (17)..(149): Pfam Name: Ribosomal_S9 Pfam Description: Ribosomal protein S9/S16
MSTVLQRPTPGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFTRYDRTLLVADPRRCKPKKFGGRGARARFQKSYR

SEQ ID NO: 49432 - DNA, 751 bp, Zea mays
  misc_feature: Ceres CLONE 1460380-F
  misc_feature: Encodes the peptide sequence at SEQ ID NO. 49433
  misc_feature (681)..(681): n is a, c, t, g, unknown, or other
ggagctccccgcggtggcggccgctctagaactagtggatcccccgggctgcaggaattcgcacgagaccattacctagaacatcctaatcgaaaaaaaaattagaaaccctagcgatgctgcagatccgcctgagcaagattggctcgtcggactccggcgctgccgccaccggctcggcagccgccgccggtgccgccgccgctgtggggtcggctgcggcgctgggcggcggcatcccggaatcggtcaccgtggcatgccccgaccacctggtgatcgcggacctacccgtcgcgaagagcctcggtgccgtcacgacctccgctgccgccgccacgcgcgccatcggccgtcgctcccgtcgcccgctcggggagcgcgtccacatctgctcccgctgcgagttccccatcgccatctacggccgcctcgtacgaacttgctaagcccttttctttatgcggctatcaaaccacgaacttgttccgcttgtgttgctgctaaggaaactaggggtttaattaaccgcgtgtgttgtggagccacttaccgccacaaactctattattcctctggtgatatcgtaagtgaaaatggagcagcggatgtgcatcatctttgttttatgcttctgtttagaggggtaggcttatgagagtgggagaaaaacgaatagantaatttgtagaagatctgggggaagggctatttgcctcgtggtctagccgatccctggaaggagagccag

SEQ ID NO: 49433 - protein, 110 aa, Zea mays; identical to SEQ ID NO: 7299
  misc_feature: Ceres CLONE 1460380-F

SEQ ID NO: 49434 - DNA, 750 bp, Zea mays
  misc_feature: Ceres CLONE 1460382-F
  misc_feature: Encodes the peptide sequence at SEQ ID NO. 49435
acccgcggtggcggccgctctagaactagtggatcccccgggctgcaggaattcgcacgagaccattacctagaacatcctaatcgaaaagctttttaaaacccccaccgatgtcctgagattggaaagagggaagccgcaggcagcatctgcatctctcgcccacctccgctccgcctgctgctgctggtggtagggaggcggagaaggaggcccttgcgcccgcccgccggtcggatcagagccgtagcaaccaccacccatggcggacgtgcacgaacctttggtgcgccgtaagaggaagaaggttttggtggactagttggtgaagttccgatggatcctcgtgatcttcgtggtccttcctatttcaactctgatctacttcaacatcttcctgggcgacatgtggtccgccttgaagtcggagaagaagcgccaaaagcagcacgacgagaacgtgcaaaaggtcgtgaagcggctcaagcagaggaacccgaagaaagacggtcttgtttgcacggccaggaagccctggatcgctgttggcatgcgcaacgtggactacaagcgtgcgaggcatttcgaggtcgacctttcttccttcaggaacatccttgagattgacaaagaaaggatggttgcaaaggtcgagccccttgttcacatgggtcaaataaccagagctacctgcccaatgaaccttgcccttgcggtcgtcgccgagctcaacgacctccctgttggggg

SEQ ID NO: 49435 - protein, 114 aa, Zea mays
  misc_feature: Ceres CLONE 1460382-F
MWSALKSEKKRQKQHDENVQKVVKRLKQRNPKKDGLVCTARKPWIAVGMRNVDYKRARHFEVDLSSFRNILEIDKERMVAKVEPLVHMGQITRATCPMNLALAVVAELNDLPVG

SEQ ID NO: 49436 - DNA, 754 bp, Zea mays
  misc_feature: Ceres CLONE 1460384-F
attctggagctccccgcggtggcggccgctctagaactagtggatcccccgggctgcaggaattcgcacgagaccattacctagaacatcctaatcgaaaaaataaaagtgaaattccattaccttgctgtctcggtctgtcggccatcgccggttgcgcagcgggcagcggctcacgtcgacggggaagactccggaggccacgggcgttacattctcctgccgtatttttgcgatccctggctaaccaaacaaatggtggagacatggattagtgcttatgggaaaatcatccccaacagggattgaagtgacagccagggatccactcatcctctgggtggaaaaattcaggttgtggattggattgctagctaccgaacaagccctcagcgtgctaatttcaatggaatcttggtagacaccactggaacttcttggtttccaattaagttcgagcatagagatcgtcttctctcacactgagttgccagtttattccgaaggtccttcaagctaagttctgatgatggctaaagccaagggagcattccatgcatccacgagggaaccccttgttttcttttggggccataagctgatgttcagtatgctgatatcccaaaaggccgctcattcttcggggtcccaagatataccccccataacatccacggtcctcccaaggggccgtcaaaaggggggaaacaaacaaggcaccatcaagttcccccaccatttttgggagacattt

SEQ ID NO: 49437 - DNA, 718 bp, Zea mays
  misc_feature: Ceres CLONE 1460385-F
  misc_feature (406)..(406): n is a, c, t, g, unknown, or other
aagctggagctccccgcggtggcggccgctctagaactagtggatcccccgggctgcaggaattcgcacgagaccattacctagaacatcctaatcgaaaaataatttctcccacccgtcaagggaggagataggaaggggatggcggccgacgtcgcgagtgtctcgtaagatgacttcgatgctgtccgcgttctccgccggcgtcgtgagtaaggttcacggatcgctggcccgctctgggtgcgtgccaggtcagacggcctaggttgctacggacgtgaagacgacgacctgcgcgaccgctcttcgatctgatgatatacgaacgccctctgcatcactgccgctgtagtagttcgaaacagcacggccgtatctagcggacaatgaaattctactgagnccccggttctaccccacaaattttggtcctggagccccctgcaagagattttgccctatgcggggccgggtaaaaagaggggcaaaaggaaaggctggggtcctttcctcatggaagggcgggcgatgaaaaatttccctggatgggcaaaaattttggcgccgggggctccctttgggtaaaaaagggaattggggggttcccccccgggggaaaagaaaaagggtgtttatttttcggccccgccggggggtggggaacaaatttcgggggggggggaaaaaaaccctttgtgggggagttattacaaaa

SEQ ID NO: 49438 - DNA, 767 bp, Zea mays
  misc_feature: Ceres CLONE 1460390-F
  misc_feature: Encodes the peptide sequence at SEQ ID NO. 49439
  misc_feature (390)..(390): n is a, c, t, g, unknown, or other
ctcaccgcggtggcggccgctctagaactagtggatcccccgggctgcaggaattcgtctcacccctaatcgaaaatcgagggaacatttgaccagatcaagcacgctagcgcaatggtcacagagttgattgtccgcatcagtggtaagccgcctccacaagccaagaacaacccaggtagggggcctggttctcatgccgggggtcctggaagcaacttcaaaaccaaattgtgcgagaacttcaacaaaggctcctgcacctttggagacaggtgccacttcgcccatggcgaaggtgagctgcgcaaacctgctgctgcttgacaggcatgcttattgtggcctgtggtgattaatctgcctgtatggctgaataacacatgaccnaggacagtggcgccagcgccatggtgaaagtgtgctgagccacatgctgcctgaaaaaaacatttccctggggcccggaattgatcctaaagtggaaccaaactccccccaaggaaaataaacaatggccgtttatttagaattggaagaatgcccaatttggccccctttttatcttccccggtttgggccggggggaaaaaatcgccctggtgggggaaaaaccccttgcacaaggaagggggcccccccctggggaaaaagggctaaccaccatgccgccgaaaaaagattttccgcggggccgtattttttttaaggggaaaaaaccccctcccaggaaaaaaaaagggccgttttattggatttggaggggt

SEQ ID NO: 49439 - protein, 70 aa, Zea mays; identical to SEQ ID NO: 48465
  misc_feature: Ceres CLONE 1460390-F
  misc_feature (36)..(61): Pfam Name: zf-CCCH Pfam Description: Zinc finger C-x8-C-x5-C-x3-H type (and similar)

SEQ ID NO: 49440 - DNA, 745 bp, Zea mays
  misc_feature: Ceres CLONE 1460394-F
  misc_feature: Encodes the peptide sequence at SEQ ID NO. 49441
tccccgcggtggcggccgctctagaactagtggatcccccgggctgcaggaattcgtctcacccctaatcgaaaaccattctctctctttctcctgttccccgcgagagtcgctcaaggccgcggcgaggagaagcggcagcgcgtcacctctccaatggcatccccgtccttcctccgtgcaacctgtgcaccctcatgaggactagttcactccctgctgtcattgaggcttctggcaatgatgactggaagaaacgaaaggaagcacagagcctgaagaggctcgaggttaagaagaagaggattgagaggaggaactctctcacctgcaacacttcaaaagaagctgctgggcagagtccagaagagatgaatgcaaacactgacaaattagtaagttctgatgaaactattgccagcgctaacgaaagccatagcagtggcaagcatctggtgaaggggcttccaccaaagtaccaggctacaattacatcacaagacagttcgtcagcaatgcgaaagaagccaaactcggccttcaaaggaacagccatcactgaggagcagaactcgtcatcgtctgttccttcctccggtgaagctataagtagcgtgacggcaccaagtctgcctgcgttgtctttggtccccataacagcaacccttggttccagggaagaacaaagcattttaggcagggctggtgcaagggcaaacggcatgggggacgtggaaaggaagaa

SEQ ID NO: 49441 - protein, 182 aa, Zea mays
  misc_feature: Ceres CLONE 1460394-F
MRTSSLPAVIEASGNDDWKKRKEAQSLKRLEVKKKRIERRNSLTCNTSKEAAGQSPEEMNANTDKLVSSDETIASANESHSSGKHLVKGLPPKYQATITSQDSSSAMRKKPNSAFKGTAITEEQNSSSSVPSSGEAISSVTAPSLPALSLVPITATLGSREEQSILGRAGARANGMGDVERK

SEQ ID NO: 49442 - DNA, 759 bp, Zea mays
  misc_feature: Ceres CLONE 1460399-F
  misc_feature (617)..(617): n is a, c, t, g, unknown, or other
  misc_feature (618)..(618): n is a, c, t, g, unknown, or other
aagctggagctccccgcggtggcggccgctctagaactagtggatcccccgggctgcaggaattcgtctcacccctaatcgaaaaatcttccatattatgtgagaccaacggcaccatataatgtggaatcaagtaacaacaacatagcaacaatggcgaccaacatattttccctcgttatgctcgttgctcattcagcatgagttgctaaagcgacaattttccctcattgctcacaagctcctataccttcccttcttcccccataccttcgatcaaggagacctccgatatgcgaaaacgcctctcttcatccctataggctccaacaggcaatctgcagcaggctgcatacctttatcacccttgttgtgtcaccactcgccagccctatctgtgtggcaatccttgataccaaccattctcgacacagcatgctgcagcatctcgtgctaccgtgtgatcaccaaggtagatcgtggcagaccatttctccctactgatcagcattgacaatttcttccagtacagccagctgtgctacctgcagccctgctaggtattttgaagcatcgactattaccaatcgctcctgctagctactgactactcttgnnaacaacatgttcttccatttaaccattgggacgaactgaaccccgcatgcttattgcagccaaaataaccgctcccggtcaggcccaggtggcatgaacttggtttcgtcttgaaaaattaaggttgggcctttaaaagaa

SEQ ID NO: 49443 - DNA, 763 bp, Zea mays
  misc_feature: Ceres CLONE 1460400-F
  misc_feature: Encodes the peptide sequence at SEQ ID NO. 49444
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggacgtacattgtcatttttggaagcttctgaagcatggcgtgcgcgtgaactatgaatggatgagtccctcccaacctaaactggtggagtactatgctaagctgaagagctgcatcccctcagtggggggagcgcggagggaggcttctttatgggaaagcccctttgtcaccaaggaattggggccccccccaggcgggaacacccgggttttggtttgcataaaaaccccccttggtttgccaaagccaacccaacgaaaaaaaattttttttaaacccaggggcccctccccaaaaaattggggccctttgtaaaggcgcgaaaaacctcttaaaaaaaaaaaaaaaaaagggcgggggccccctccccctatgggggagaataaccgccccgcgggggttttttaccggggggagaaac

SEQ ID NO: 49444 - protein, 72 aa, Zea mays; identical to SEQ ID NO: 46180
  misc_feature: Ceres CLONE 1460400-F

SEQ ID NO: 49445 - DNA, 759 bp, Zea mays
  misc_feature: Ceres CLONE 1460402-F
  misc_feature: Encodes the peptide sequence at SEQ ID NO. 49446
  misc_feature (482)..(482): n is a, c, t, g, unknown, or other
acccgcggtggcggccgctctagaactagtggatcccccgggctgcaggaattcgtctcacccctaatcgaaaacttttagatgcggactataacgcaaaactctctgattttggacttgctaaagatggccctgagggtgataaaacacatgtgtcaactagggtcatgggaacatatggatatgctgcacctgaatatgtaatgacaggtcacctgacatcgaagagtgacgtatatagctttggagttgtactactagagatgatgactggtagaaggtcaatggacaagaacaggccaaacggagaacacaacctggttgaatgggcacgcccttatctgggagaaagacgcagattctataagcttgtagaccctcgtttggatgggaacttctccataaaaggcgcccagaagacggctcagctggcccatgcctgcctcagccgtgaccccaaggctaggcctctgatgagccangtggtggaggtgctgaagcctctccagaaccctcaggacatggccagctcttcctactacttccagtccatgcaacatgagcgtcgcacagcacttgcaaacccatatggcagtcaaagcatgaaagcgcaaccacctttgcgcggaacgggcagcagcccatgaggagcctctcgtatggccctcatgctttcccgtatccccagtccccaagacttacagcaagcggcaatgaatcagggtgcttgtctgtccaccataacttattttcaagatg

SEQ ID NO: 49446 - protein, 159 aa, Zea mays
  misc_feature: Ceres CLONE 1460402-F
  misc_feature: SWISSPROT Homolog: EC 2.7.11.1 Non-specific serine/threonine protein kinase
  misc_feature (105)..(105): Xaa is any aa, unknown, or other
MGTYGYAAPEYVMTGHLTSKSDVYSFGVVLLEMMTGRRSMDKNRPNGEHNLVEWARPYLGERRRFYKLVDPRLDGNFSIKGAQKTAQLAHACLSRDPKARPLMSXVVEVLKPLQNPQDMASSSYYFQSMQHERRTALANPYGSQSMKAQPPLRGTGSSP

SEQ ID NO: 49447 - DNA, 762 bp, Zea mays
  misc_feature: Ceres CLONE 1460403-F
  misc_feature: Encodes the peptide sequence at SEQ ID NO. 49448
aagctggagctccccgcggtggcggccgctctagaactagtggatcccccgggctgcaggaattcgtctcacccctaatcgaaaactaatcgagcatcgcagagataggcgtcttcatactcgcctacctccgcgggtcaaacctttcccccttctcccaattccctccgtcggccgccgctccatcccgtacgacgacaccatgagggagtgcatttcaatccacatcggccaggccggtatccaggtcgaaaacgcatgctgggagctgtactgccttgagcatggcattcaggctgacggtcagatgcccggtgacaagaccattgggggaggtgatgatgctttcaacaccttcttcagtgagactggtgctgggaagcacgtgccacgtgctgtttttgtacaccccccacccactgtcatcgatgaggtgaggactggcacctaccgccagctcttccaccctgagcagctcatcagtgggaaggaggatgcagccaacaactttgcccgtggtcgctacaccattgggaaggagattgttgacctatgccttgatcccatcaagaaacttgccgacaactgccctggtcctccagggcttcctcgtcttcacacctgttggtggagaaacggtttctgcctttggttccctcttctaaagcgcctgtctgttgacacggcaaaaaatccaagctttggatcactgtgtaccttccccccaagttctacttcgggaggtgagcaaccaacagggta

SEQ ID NO: 49448 - protein, 186 aa, Zea mays
  misc_feature: Ceres CLONE 1460403-F
  misc_feature (49)..(175): Pfam Name: Tubulin Pfam Description: Tubulin/FtsZ family, GTPase domain
MRECISIHIGQAGIQVENACWELYCLEHGIQADGQMPGDKTIGGGDDAFNTFFSETGAGKHVPRAVFVHPPPTVIDEVRTGTYRQLFHPEQLISGKEDAANNFARGRYTIGKEIVDLCLDPIKKLADNCPGPPGLPRLHTCWWRNGFCLWFPLLKRLSVDTAKNPSFGSLCTFPPSSTSGGEQPTG

SEQ ID NO: 49449 - DNA, 766 bp, Zea mays
  misc_feature: Ceres CLONE 1460410-F
  misc_feature: Encodes the peptide sequence at SEQ ID NO. 49450
  misc_feature (524)..(524): n is a, c, t, g, unknown, or other
aagctggagctccccgcggtggcggccgctctagaactagtggatcccccgggctgcaggaattcgtctcacccctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggggtcggggcggccagggccgtctccagggaggcctacgtcgtcaccgtcgaagggctttcaggagactcgtccgggctagacgccgacggcggcaagcggagccatttctccagcatcagaggtgacgacggccagaggtcgctcgacgcagtggtaaaaacggccggcaaggaggccttccagtgggggttggcagccggagtctactcanggctcacgtacgcgctgcgggaggccaggggatgccacgactggaagaacagcgccatcgcaggcagcatcgctgggggcggcggtggcgctcacgggtgacgccggcggccactccgacaagctcgtcaacttcggcatcacgggcgacgcgctcatcagcgccgggagcttgctctccagcatattctgattgggccccagggctgcacccgcctgacacgagttcgctgcccggtgaac

SEQ ID NO: 49450 - protein, 144 aa, Zea mays
  misc_feature: Ceres CLONE 1460410-F
  misc_feature (21)..(145): Pfam Name: Tim17 Pfam Description: Tim17/Tim22/Tim23 family
  misc_feature (112)..(112): Xaa is any aa, unknown, or other
MSTLDTRTLKDELTSMDRKCLVDLGHPLLNRVADSFIRAAGVGAARAVSREAYVVTVEGLSGDSSGLDADGGKRSHFSSIRGDDGQRSLDAVVKTAGKEAFQWGLAAGVYSXLTYALREARGCHDWKNSAIAGSIAGGGGGAHG

SEQ ID NO: 49451 - DNA, 734 bp, Zea mays
  misc_feature: Ceres CLONE 1460419-F
  misc_feature: Translation starting site: 268
ggagctccccgcggtggcggccgctctagaactagtggatcccccgggctgcaggaattcgtctcacccctaatcgaaaacttagtcatctcctcccgcatcgctagccgccctcatccccacacgctcgccaaaccctagctatcaacatcctacctctccctcctggagctcgcccagcagcgcgacatccttgtctacgacttcgtctccaacggcacgctcagtgccgccgtgccgctgctccccaggcggacccacctcgcgatggtcgcccagatcgcggcggcgctcgagaacctccactttggcatgaacccgccgtcgtgcaccgcgacatcacctcgtccaacatcttcgtggaggccgacatacgggcatgcctcagtgacttcggcctctccctcctcctcgcaccgccggacatgtgcgcaacggagggcactcgtgacctcgtgtgctgcacctcgcctagctggggcccgtggacgttggcaggaaccgcgggacattgcgctggccgtctggggtgcgccccaaaaccaggtccgtgagcacagggtggtcgtccacccccggtggctgcccaaaccaaggggggtggggaggtaaaaattggccaataatttccccttggaggaaagaatccaacaaggggtttccttggaacccctttccaaaaaaaaggggattggaggcccttggaccctgtgaaggggggaatttttggccgg

SEQ ID NO: 49452 - DNA, 735 bp, Zea mays
  misc_feature: Ceres CLONE 1460426-F
  misc_feature: Encodes the peptide sequence at SEQ ID NO. 49453
  misc_feature (735)..(735): n is a, c, t, g, unknown, or other
ggagctccccgcggtggcggccgctctagaactagtggatcccccgggctgcaggaattcgtctcacccctaatcgaaaaacacaatttctcgcgctcctaccgccgccgcttcgttctctaaccttggctcccgctccctccgcaggagcatctcaacaccgccttgaggaccccccaactcgccggctgcagccatggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttccgcatgtattgtggcggtgttggacgtaccgctcaggctaagtctcgtcactcaaatgggcacggacgctggcctgtcaaatctgctagattcattctagaccttctcaagaatgctgagagcaatgctgacgtaaaaggtcttgatgtcgataccctctatgtgtcacacattcaagtgaaccaggctcataagcagcggcgcaggacctaccgcgttcatgggcgcatcaacacttacatgtcctcgccgtgccacatcttactcatcttgtcagacaagggacagcccgtgaagaaagaggctgagtctcacatcgcaaccagtaatgcttagagaatgggacataccttctatgn

SEQ ID NO: 49453 - protein, 171 aa, Zea mays
  misc_feature: Ceres CLONE 1460426-F
  misc_feature (17)..(153): Pfam Name: Ribosomal_L22 Pfam Description: Ribosomal protein L22p/L17e
MVKYSTEPTNPTKSTKAMGRDLRVHFKNTRETAFALRKLSLTKAKRYLEDVIAHKQAIPFRMYCGGVGRTAQAKSRHSNGHGRWPVKSARFILDLLKNAESNADVKGLDVDTLYVSHIQVNQAHKQRRRTYRVHGRINTYMSSPCHILLILSDKGQPVKKEAESHIATSNA

SEQ ID NO: 49454 - DNA, 803 bp, Zea mays
  misc_feature: Ceres CLONE 1460427-F
  misc_feature: Encodes the peptide sequence at SEQ ID NO. 49455
  misc_feature (403)..(403): n is a, c, t, g, unknown, or other
  misc_feature (404)..(404): n is a, c, t, g, unknown, or other
  misc_feature (444)..(444): n is a, c, t, g, unknown, or other
  misc_feature (470)..(470): n is a, c, t, g, unknown, or other
  misc_feature (768)..(768): n is a, c, t, g, unknown, or other
  misc_feature (801)..(801): n is a, c, t, g, unknown, or other
ccccgcggtggcggccgctctagcctagtggatcccccgggctgcaggaattcctctcacccctaatcgaaaaacaaagaagctccataattaattattgccctttcagttcgccatcggcagccgagcaccatgagctccacaggcggcgacgatggcgccgagaagtcttggccggaagtggtcgggctcagcctggaagaagccaagagggtgatcctgtgcgacaagcccgaccccgacatcgcctggctgcccgtcggggcggctgggaccgtggattcccggcccaaccgagtgtcggtttttttctaataccgtcgggcaggcaccccccatcggccggggattttgtcccccctcccccgagaggggggaggggctatttttccccctttttggnncaccccccgcgggtggggggggtgcccccccaaaactccnccagacaaccccaccccccccccccnaccccccccaccaaacacggaccacctggctgtggccgttgccgttctcccgcctgggaaggggggggcggtcttccggggctggggacgatgagagaggaaaagaaacgccgagatctgcgggtggtctccgcgtccccctctagtaaggaggggtccaattgaaggcgactcagccgccacgcgcctgggagagagggctgtggcggggtgcacccgccgcgagatggaccgcccgtgcggcgcgggcggtacacgcacccccccctccccccgctacgcgagcagtacccgcacnccccttctccccgctccgtacctactttacagnag

SEQ ID NO: 49455 - protein, 60 aa, Zea mays
  misc_feature: Ceres CLONE 1460427-F
  misc_feature (11)..(60): Pfam Name: potato_inhibit Pfam Description: Potato inhibitor I family
MSSTGGDDGAEKSWPEVVGLSLEEAKRVILCDKPDPDIAWLPVGAAGTVDSRPNRVSVFF

SEQ ID NO: 49456 - DNA, 755 bp, Zea mays
  misc_feature: Ceres CLONE 1460429-F
  misc_feature: Encodes the peptide sequence at SEQ ID NO. 49457
  misc_feature (536)..(536): n is a, c, t, g, unknown, or other
  misc_feature (750)..(750): n is a, c, t, g, unknown, or other
ggagctccccgcggtggcggccgctctagaactagtggatcccccgggctgcaggaattcgtctcacccctaatcgaaaaacgagtcatcgatcatcatcatgtgtcctaaatccaaagccagcgaagaagagattccgccggtgccgtagccgctgagctaaccaccagccggttcttgtcgcgttgtctgcaactttgcaagtaagcaactcgtcaccggtcagccaccaacaaggcaccttggttatcgtcttgcacgtccaagaaatcgagaactcaggcaggcgtcgcccacttgccctcctcctcctcctcccgtcgtgaattccacgctggttcagggatgtcgatcgagctcctgacgaaattcctcacattgctgttcgggtatgccatgccagcgctggagtgcttcaaggcgatcgagcagcggcccggccgggcagatcagctccgcttctggtgcgagtattggatcatcctagtcctcctcgtcatgttcgacgaaattgctggggttctcatttctaaccnaggaacggacatcgtgtacgagaccttcctccagccgctggtgatgcagtaccagcccaacatcgaggccaggctccagtacctgcgcgccaatgccggtgacatcctcgtcttctacctcaagaacttcaccgagagaagctacgagctcctcctccgagtgcttgactacgtccggtcgcaggcgtccagagggtcaagaacactgagtttnctctt

SEQ ID NO: 49457 - protein, 136 aa, Zea mays
  misc_feature: Ceres CLONE 1460429-F
  misc_feature (64)..(64): Xaa is any aa, unknown, or other
  misc_feature (135)..(135): Xaa is any aa, unknown, or other
MSIELLTKFLTLLFGYAMPALECFKAIEQRPGRADQLRFWCEYWIILVLLVMFDEIAGVLISNXGTDIVYETFLQPLVMQYQPNIEARLQYLRANAGDILVFYLKNFTERSYELLLRVLDYVRSQASRGSRTLSXL

SEQ ID NO: 49458 - DNA, 763 bp, Zea mays
  misc_feature: Ceres CLONE 1460431-F
  misc_feature: Encodes the peptide sequence at SEQ ID NO. 49459
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccacgcgacctcttttttttcctaagaacgtacattgtcatttttggaaagctctgaaagcatggcgtgcgcgtgaactatgaatgtatgagtcactccaaagctaaactgtttgagtactatgctaagctgaggacctgcattcacatcatggggttgaaaccccaagaaagctttcttttcggaaagcctcacttgtccccgacaaattcggccccccccccaggccggggaacacctcgggtttgggtttgaataaaacaaacgcgggtgtttgcataacccaatccaaacaaaaaaaaaaagtgttttaaacccaaggggccccccccccaaaaaaaaggggcgcctgttgaaagggccgaaaaacccctttaaaaaaaaaaaaaaaagaggcgccgggggccccttttcccatagggggaactaaacccgcctcgcgggggctttt

SEQ ID NO: 49459 - protein, 72 aa, Zea mays; identical to SEQ ID NO: 46180
  misc_feature: Ceres CLONE 1460431-F

SEQ ID NO: 49460 - DNA, 703 bp, Zea mays
  misc_feature: Ceres CLONE 1460433-F
  misc_feature: Translation starting site: 306
  misc_feature (408)..(408): n is a, c, t, g, unknown, or other
ctccccgcggtggcggccgctctagaactagtggatcccccgggctgcaggaattcgtctcacccctaatcgaaaaatctctaaaatagtctcccctgtgcaggcatccacttcttctctccctgatccaaatcgtgaaatagcgtcggcggttccctgcgctcctcccctctttttctagcggcgcgcagcagccacgaccggtgttctggcgatcctggacgccccctgcccagactgcgatccattttcgagcttcgaggaatcgacagtcaagcttcggcgaccaagtgatctggctcttcatgttctacaaagttgaagaccctgagcatctgtttggtgaaggttgcctttggtgcaatctatgctcaggtaaagaagaaagcgtcgagatggatctccagnagttccaggacgctgatgagttcgaggattaggctagcaacctccccccagtcagctgcctgtggtcatcttctccaccgaccctgtggacgagtacctgatgcagtacctgatggactacgacgaacaagaggtcccgaccgtgtccaaggatgtactgaaactgggcaaggactccaaactcagggaactcaaggaatccttcaaagaactaaatgactgtggaaaaaaggcctgaaaaacaaaaccgtgtactcggtgaaaatcgacaaccggttgacaaaccccctggttt

SEQ ID NO: 49461 - DNA, 726 bp, Zea mays
  misc_feature: Ceres CLONE 1460437-F
  misc_feature: Encodes the peptide sequence at SEQ ID NO. 49462
ggagctccccgcggtggcggccgctctagaactagtggatcccccgggctgcaggaattcgtctcacccctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaccgtagtggaggtagctatgcctctgcatgctcgttggatggcagcgtggccatcagcagcatgcggtcgtcgtcgtcgtcctagcagatgtcctagctacgtgtgtgtcctcagactggcactgtggcacataataaagaagtagatcatgcacccc

SEQ ID NO: 49462 - protein, 126 aa, Zea mays; identical to SEQ ID NO: 15591
  misc_feature: Ceres CLONE 1460437-F
  misc_feature (36)..(122): Pfam Name: Tryp_alpha_amyl Pfam Description: Protease inhibitor/seed storage/LTP family

SEQ ID NO: 49463 - DNA, 795 bp, Zea mays
  misc_feature: Ceres CLONE 1460439-F
  misc_feature: Encodes the peptide sequence at SEQ ID NO. 49464
  misc_feature (428)..(428): n is a, c, t, g, unknown, or other
  misc_feature (647)..(647): n is a, c, t, g, unknown, or other
  misc_feature (760)..(760): n is a, c, t, g, unknown, or other
  misc_feature (763)..(763): n is a, c, t, g, unknown, or other
  misc_feature (768)..(768): n is a, c, t, g, unknown, or other
  misc_feature (770)..(770): n is a, c, t, g, unknown, or other
acccgcggtggcggccgctctagaactagtggatcccccgggctgcaggaattcgtctcacccctaatcgaaaagccggtccctccctcacttcctgtgcctgttctcagcccgccgcttctcagtccacttctgccgcagcccctcttctctcggtctagagatccgtccgggcgcggcagcctcgctttcgtttcggcacggagaacaatcactttagaagacttgtactccttggcgtgtcatactctttgtaacaatcttaccattcttgagaagaggtacatctgtccgtcagcaatgtccatagaagaagagaagaatagtgtgataagcaagagcattgcgctaaatccaaaggccgaagaattgggtccttcctcccttaaaattggcaacccccccccccccaaaaacataggcaactngggttggctcaggggaatccaaagaactccgcctggaaaagccgaaatccatttttcgaagtacctcgggagagaaaccccttataagggggacaaaaggccccgagagaaattccccggatttcacaacctgggggaacaaaaaaaagccggggcccggagatgttttcccgcaaaacgggcccacaaaagggagggggggcccccaaaaatttgtcnccaaaaacacaacgagagggggggccgccgcgctctccctctctaccggggcaccaccccaccccccaccctgtttcttctgccgccccccctcttttggcggagacagcgcnccnccgtnantataaaccacgcccgaccaccgcta

SEQ ID NO: 49464 - protein, 265 aa, Zea mays
  misc_feature: Ceres CLONE 1460439-F
  misc_feature (143)..(143): Xaa is any aa, unknown, or other
  misc_feature (216)..(216): Xaa is any aa, unknown, or other
  misc_feature (254)..(254): Xaa is any aa, unknown, or other
  misc_feature (255)..(255): Xaa is any aa, unknown, or other
  misc_feature (257)..(257): Xaa is any aa, unknown, or other
TRGGGRSRTSGSPGLQEFVSPLIEKPVPPSLPVPVLSPPLLSPLLPQPLFSRSRDPSGRGSLAFVSARRTITLEDLYSLACHTLCNNLTILEKRYICPSAMSIEEEKNSVISKSIALNPKAEELGPSSLKIGNPPPPKNIGNXGWLRGIQRTPPGKAEIHFSKYLGRETPYKGDKRPREKFPGFHNLGEQKKAGARRCFPAKRAHKREGGPPKICXQKHNERGGRRALPLYRGTTPPPTLFLLPPPLFWRRQRXXVXINHARPPL

SEQ ID NO: 49465 - DNA, 755 bp, Zea mays
  misc_feature: Ceres CLONE 1460441-F
  misc_feature: Encodes the peptide sequence at SEQ ID NO. 49466
  misc_feature (593)..(593): n is a, c, t, g, unknown, or other
ccccgcggtggcggccgctctagaactagtggatcccccgggctgcaggaattcgtctcacccctaatcgaaaagttcgagtccatcttcttgtgccatccaacccctcgtccgtagatcgatcgctgctacgcgcctgcatgctgacggttcggcgccgctgatgcgatgaagctctcgtagcccgacgttagcgagaagacgggatcgcacaagtactgaggtctcggccaggtgtcgatttggttcaaccgagggagcacctgtgcattgctataacaacaatgctggatcgggttgccatgtcagctgaggattctgccctggctgaagatttgcaggttgaagaggttctccggttctcaattcaggcggggaaggcctgtgcagtttgcaaagaaggcatccgatcattggatgcctcgtggaaacctgaaaattgtgaccatgtcatctgcattgcctgcttctgccagtatgcacctgagactgaggccactggactgcccaggtgcgcggtggcatcttgtgattctttgtgcaatacaaagacacatcagggcaccaatgtggctcggtgcacttcaatctcnattgagacatggaccggaaaggaagaaacccctaggtagtagtacaatttcagagcttggtcaatgctctcaaggtgccagcccaaatatcaccagtgagttatactgtgccatctgcatggagaccgtgcccatcgaaaagtccttccccgggaatggagg

SEQ ID NO: 49466 - protein, 115 aa, Zea mays
  misc_feature: Ceres CLONE 1460441-F
MLDRVAMSAEDSALAEDLQVEEVLRFSIQAGKACAVCKEGIRSLDASWKPENCDHVICIACFCQYAPETEATGLPRCAVASCDSLCNTKTHQGTNVARCTSISIETWTGKEETPR

SEQ ID NO: 49467 - DNA, 754 bp, Zea mays
  misc_feature: Ceres CLONE 1460442-F
  misc_feature: Encodes the peptide sequence at SEQ ID NO. 49468
tggagctccccgcggtggcggccgctctagaactagtggatcccccgggctgcaggaattcgtctcacccctaatcgaaaaaagcaacttcaaaagaatcgtctccaccaaaagttgaagataaaccaaaggtagaggaaaaagccccaaaagtaaatcctcccaagatgcaagcaccaaagccaactgcaccatcaaaaacatccccttcagaaccacagctccctccaaaagaacgagagcggcgggtgccaatgccaaggctcaggaagcgtattgcaaaccgtcttacggattctcataacacctttgcaatgctgagtacatttaatgaagttgacatgaccaatttgatgaagcttcgttctgattataaagatgaatttgacacaaagcatggtgtaaaattgggtcttatgtcttgctatgccaaggctgctgcttctgcacgtcaacacggccaattgtcgatgctgtcattgatggtgatgacgtcatatgacgagactgcgtagacctcggtggtgctggttgcacttccaaggggccttggggttcccggtaatccaggaggctgatcccctgaactttgcttacatttaaaaaggggaaaaccaccctggaaaagaaaggaaccgggagggggcggctcccaattgaggagaggggggggggggaactttccccattcccccaagggtgggggcaaggggaaaccctcctgggcacccctaaggtaaaacccctcaagttg

SEQ ID NO: 49468 - protein, 115 aa, Zea mays
  misc_feature: Ceres CLONE 1460442-F
  misc_feature (22)..(108): Pfam Name: 2-oxoacid_dh Pfam Description: 2-oxoacid dehydrogenases acyltransferase (catalytic domain)
  misc_feature: SWISSPROT Homolog: EC 2.3.1.61 Dihydrolipoyllysine-residue succinyltransferase
MQAPKPTAPSKTSPSEPQLPPKERERRVPMPRLRKRIANRLTDSHNTFAMLSTFNEVDMTNLMKLRSDYKDEFDTKHGVKLGLMSCYAKAAASARQHGQLSMLSLMVMTSYDETA

SEQ ID NO: 49469 - DNA, 760 bp, Zea mays
  misc_feature: Ceres CLONE 1460449-F
  misc_feature: Encodes the peptide sequence at SEQ ID NO. 49470
  misc_feature (632)..(632): n is a, c, t, g, unknown, or other
  misc_feature (659)..(659): n is a, c, t, g, unknown, or other
  misc_feature (662)..(662): n is a, c, t, g, unknown, or other
  misc_feature (717)..(717): n is a, c, t, g, unknown, or other
  misc_feature (739)..(739): n is a, c, t, g, unknown, or other
ggagctccccgcggtggcggccgctctagaactagtggatcccccgggctgcaggaattcgtctcacccctaatcgaaaaattcccggcccgactcccgctcccccttcctccaccacggccacgtccacgcccacgccgccgccgccgacacggagcacctgcaccgggcgcaggggccgatggacccgccgtcgtcgtcggggcgccccaccacgccgcgccggcagctgcagggcccgcgcccgcccaggctcaacgtcaggatggagtcgcacgccatcaagaagccctcggcctcgggggctccgccggcgcccgggcaggggaggccgcgggaccaccaccaccaccacccgcagcccgggcgcgcgcccgtcatcatctacaacgcgtcgcccaaggccatccacgccaagcccagcgaattcatggcgctcgtgcagcggctcacgggccccggcgcgcaggcgcagcacgagcgccacgtggctgacgacgacgccaccgccaacggcggcggcgtgctggggcaggcgttcctcccccccgagctgctgctctcgccgtccgccgccatgtccccggccgcgcgcctcgcgaccatcaagcggtccgtgcgcctcttgcccnccccggcgcgggcgccggactactccnccnacggccccctcgcggcggtgctcggcctcgagaggaaccctggatcctgtcccgntggcttcttccttgcgtcgggnctcttgttctgtctggttctc

SEQ ID NO: 49470 - protein, 193 aa, Zea mays
  misc_feature: Ceres CLONE 1460449-F
  misc_feature (69)..(99): Pfam Name: VQ Pfam Description: VQ motif
  misc_feature (151)..(151): Xaa is any aa, unknown, or other
  misc_feature (160)..(160): Xaa is any aa, unknown, or other
  misc_feature (161)..(161): Xaa is any aa, unknown, or other
  misc_feature (179)..(179): Xaa is any aa, unknown, or other
MDPPSSSGRPTTPRRQLQGPRPPRLNVRMESHAIKKPSASGAPPAPGQGRPRDHHHHHPQPGRAPVIIYNASPKAIHAKPSEFMALVQRLTGPGAQAQHERHVADDDATANGGGVLGQAFLPPELLLSPSAAMSPAARLATIKRSVRLLPXPARAPDYSXXGPLAAVLGLERNPGSCPXGFFLASGLLFCLVL

SEQ ID NO: 49471 - DNA, 804 bp, Zea mays
  misc_feature: Ceres CLONE 1460450-F
  misc_feature: Encodes the peptide sequence at SEQ ID NO. 49472
  misc_feature (335)..(335): n is a, c, t, g, unknown, or other
  misc_feature (336)..(336): n is a, c, t, g, unknown, or other
  misc_feature (366)..(366): n is a, c, t, g, unknown, or other
  misc_feature (370)..(370): n is a, c, t, g, unknown, or other
  misc_feature (601)..(601): n is a, c, t, g, unknown, or other
ctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgctttatatcatggaggcggctgtagttctcttttccaccgcgacctcttttttttcttanngaacgtacattgtcatttttggaagcttcngaangcatgccgtgccgcgtgaactatgaatgttggagtcaccccaaacctaaactgtttgagagactatgctaagctgaaggagctgcttctccctccttgtggggagacccaaaggaaaattttttttttgggaaccccctctttgcaccaaagaaaatggggccccccccaaggcggggaaaaccctggtggttggttttgagaaaaaaaaaccccgcgtgtttttaaaaancttcttcccaaaaaagaaaaaagggtgttttaaaaaaaggggtcccccccccaacaaaaattggtggttctttttttttccgggggaaaaattttttttaaaaaaaaaaaaaaaaaaagaagggggggggcccccccccccctagggggagacacacccccgcgccgccgggctgttttttttctgggggggggagaaaacgc

SEQ ID NO: 49472 - protein, 71 aa, Zea mays; identical to SEQ ID NO: 46198
  misc_feature: Ceres CLONE 1460450-F

SEQ ID NO: 49473 - DNA, 814 bp, Zea mays
  misc_feature: Ceres CLONE 1460451-F
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (165)..(165): n is a, c, t, g, unknown, or other
  misc_feature (239)..(239): n is a, c, t, g, unknown, or other
  misc_feature (252)..(252): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (414)..(414): n is a, c, t, g, unknown, or other
  misc_feature (415)..(415): n is a, c, t, g, unknown, or other
  misc_feature (421)..(421): n is a, c, t, g, unknown, or other
  misc_feature (600)..(600): n is a, c, t, g, unknown, or other
  misc_feature (630)..(630): n is a, c, t, g, unknown, or other
  misc_feature (689)..(689): n is a, c, t, g, unknown, or other
  misc_feature (778)..(778): n is a, c, t, g, unknown, or other
nnaaaaaannnnaaattatggggctccccgcggtggcggccgctctagactagtggatttcttgggctgcaggaattcttctcacccctaatcgaaaaactctttccccttcccttcccttcccactcccagggtcccactctcacccctttcgcctacccaganaaagggtacacgaagtaagggccgcttctcccggcccccaccctcagggtcatgtcctgccgctccccatggcncctccagccgagntagaaaacttagggccccaccccgccggggtccacctccgcccctgtttggcccccggggggggggcgcgttttcccccccagctttctagggccccgggggccgcaccgccgggtttgtttttttccccgcgccccccgggaacagaaagggggcannncnntcacancccccccccctgggcgggggcggacccagacccccccggcggcgccggcccggggggccggcccaaggagcgccagcggggcggcttttggggcagaggccccccccggcgcccccgggagacgggacccgcccccagccgccgggcccgccccgccttggcgtgggccgcgccacgcnagggttaggaagggccctctcctcacaccncggcgccccggggtgctccccccccacagagggcggcggccgcgcgcataccacaaaanattttgagaatgccactgggccgcagtccctgtccggggggctcgcccccgcccacgggcgcaggcgcggtcgcgggtaggccggtgancccgggccccccgccaggggggcacgcgggccccgg

SEQ ID NO: 49474 - DNA, 734 bp, Zea mays
  misc_feature: Ceres CLONE 1460453-F
  misc_feature: Encodes the peptide sequence at SEQ ID NO. 49475
aaagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccacgcgacctcttttttttcctaggaacgtacattgtcatttttgggaagtttctgaaaacatggccgggcgcctgaactaccaatggatgaatcccccccaaccaaactgtttgagtactatgctaagctgaagaactgccttcccttcatgggggggaaacccagggaacttcttttttcggaaacctccctttgtcaccgagcaaatcgggccccccccaagcgcgggaaaaagtggggtttggctcttccaaaaaaacacccctcgttctttacaaaccctttccaacccaaaaaaaaagtggctcttaagacacaggggtccctccccaaaaagaaggggccgcctttgaccaaggcggaaaaacccctcctcaaaaacaaaaaaaacacacgcctggagccgcccccccccaat

SEQ ID NO: 49475 - protein, 73 aa, Zea mays; identical to SEQ ID NO: 46214
  misc_feature: Ceres CLONE 1460453-F

SEQ ID NO: 49476 - DNA, 633 bp, Zea mays
  misc_feature: Ceres CLONE 1460455-F
  misc_feature: Encodes the peptide sequence at SEQ ID NO. 49477
  misc_feature (190)..(190): n is a, c, t, g, unknown, or other
  misc_feature (575)..(575): n is a, c, t, g, unknown, or other
  misc_feature (576)..(576): n is a, c, t, g, unknown, or other
gggagctccaccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacgatggtttactcatgaggcangaagaaggataaactttacaaaggtgaaggcgggtaggcatgatgaagacattctgttcaagcgtgaactgctcaagtttgcttattacatggaggccgctgtggttccttttccacccgaccccctttttttcccaagaacgtacattgctttttttgaaacttttaaaagatggcggggcccggaaatttaaatgtttgacccccccaagctaacccgtttaaaaatatgccaacgaaggggcgccccccccccgggggggggaggggggggaggtttctttttagaaacccccttttttccccaaaaaataaggcgcccccccccccaggggaaaacggggggggtggtttttttaaaaaacaaccaccccgtttttttttnnacccttcccccaaaaaaaaaaaaaaagttttttttctcccccgggccccccccccaa

SEQ ID NO: 49477 - protein, 60 aa, Zea mays
  misc_feature: Ceres CLONE 1460455-F
ELHRGGGRSRTSGSPGLQEFVSPLIENKWERQRFGLQGGFVTNPLAEPNISSAGKTMVYS

SEQ ID NO: 49478 - DNA, 908 bp, Zea mays
  misc_feature: Ceres CLONE 1460456-R
ccgattgggtacctcgagcgtctcgtttttttttttttttaacaaacatgatttaacgttatttattatccattacaaatatgtgaaccaaacaacacctatagtcctccgaaacatgatcacggaaaaatgaggtacactaacaatgtaaatgtttgattgaccatacatcatagcacacagattcctcaagtaattgtcactacaatttaaattggagggatcagtgagctgtggatcaaagatgcagcatgttcataaagatggaacaactctagaacaaaaattgtattagtttatagttaaatgggggcaccatcactttgctcccaaccaccaagtctgtcagcaggatcataattcgtgaacagccggaactcgttgcccagtttgttcgagtggcgaggcctgaaaccgcagggacgaacattcagcagctccaacgcccgggtcatctgaacttcccctgtgagcagcagcaggaaatgaccttcaggccgtgcgaggaaaagaaactgtttttgcaacctttttccaagcacttccttactcaaaaaggggaaggtcggcaaacaataacctccgtagggcttgctttaatcgccgcggggaggcttcctccgggcgggttggaaacccaaaaaaagggaaaatccccccccttaatgcccaaaaccccttttttgtaattccaaaaattgggcggggacattccgggggccctccttttttaagggagagctaaaaaagcttcgggattttcaaataagggcccacggcacccggggggggaacccttatcccaaaagggggaaaaaagggggaaaaaccccttcccaaaagtcccccgcggggaacctttttaaaaccgaaaatgggttaaaaccccggtcctcccggaaaaaaat

SEQ ID NO: 49479 - DNA, 759 bp, Zea mays
  misc_feature: Ceres CLONE 1460456-F
  misc_feature: Encodes the peptide sequence at SEQ ID NO. 49480
  misc_feature (748)..(748): n is a, c, t, g, unknown, or other
aagctggagctccccgcggtggcggccgctctagaactagtggatcccccgggctgcaggaattcgtctcacccctaatcgaaaagtattcttaggaagaacattctgtctcatccacgacacctaggattttggaacattcaaagcgaccatgcctgcctcaattgccttcggtcggttcgatgactccttcgccttggcctcattcaagggcaacatcgccaagatcatctcccccctcatcttcgtctacgccggcgtctgctcagccatcacatactccaaagtgaacggaggtcctccgctagacccatcccgagtgatcctcgagggcatatatgaagggtttcggctgttcctatgcgacgccgacagcacaaacatcgcgaggggacatgacaacactgatgtcaccgtccccatcgcaataggatcctagattagcttcctgaccggaaacttccagtgagatgtccagctcttcatggccaccatactgcgccttcctcttactcttctgcaccggagctacaactcctatgcacagactactcggaggtcgatctcttcgaggacctcgtgatgcagatcatgatcatcatacggattcgtctagactgtgtaaggcacctccacacgacctcagaaggagagccctctgcaccgtctctccgatgcaccatcgggttgatcatacgctgcaaaatgctcggttaagccacttcgtcaggtggaatgctgaatctgncttatactttc

SEQ ID NO: 49480 - protein, 95 aa, Zea mays
  misc_feature: Ceres CLONE 1460456-F
MPASIAFGRFDDSFALASFKGNIAKIISPLIFVYAGVCSAITYSKVNGGPPLDPSRVILEGIYEGFRLFLCDADSTNIARGHDNTDVTVPIAIGS

SEQ ID NO: 49481 - DNA, 760 bp, Zea mays
  misc_feature: Ceres CLONE 1460458-F
  misc_feature: Encodes the peptide sequence at SEQ ID NO. 49482
acccgcggtggcggccgctctagaactagtggatcccccgggctgcaggaattcgtctcacccctaatcgaaaacactacatcttctttgtcttgaacctctacgccagtgtcaccgtggttgagagtttgatgatggccattgcaagtgtcatacccaatttcctcatgggcatcatcataggagctggaattcagggaatattcatgcttgtctccggatacttcagacttccatatgacatcccgaaggttttctggagataccccatgcagtacatcagcttccattactgggcactacagggccaatgccagaatgacatggacggtctcctattcgacaaccaatacccggaccagccgaagatccctggggagttcatcctgaagtacatcttccagatcaatgtgcaccggtcgaagtggatcgacctgtcggtcatcttcagcatgatcttcatctaccgcctgctgttcttcatcatgatcaaggtgaacgaggacgtgatgccctgaatccggggctacatcgcgaggaaaaggcttcagaagaaagtgcctgccatcggcaagacggcttcctttgaaagctattgttgtgaatcccgaagcttggccctaacaaaggctaagaaaaattaagcctgggggttgctgggaaaccacaaaatagaggccccctaccggttcctgggcggaatttttcttgtgcaaaaacttggaattttacctttgaaaaaaaaaaaaaacccccggtc

SEQ ID NO: 49482 - protein, 127 aa, Zea mays
  misc_feature: Ceres CLONE 1460458-F
MAIASVIPNFLMGIIIGAGIQGIFMLVSGYFRLPYDIPKVFWRYPMQYISFHYWALQGQCQNDMDGLLFDNQYPDQPKIPGEFILKYIFQINVHRSKWIDLSVIFSMIFIYRLLFFIMIKVNEDVMP

SEQ ID NO: 49483 - DNA, 723 bp, Zea mays
  misc_feature: Ceres CLONE 1460460-F
  misc_feature: Encodes the peptide sequence at SEQ ID NO. 49484
  misc_feature (723)..(723): n is a, c, t, g, unknown, or other
ctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagttgttaaataaagaan

SEQ ID NO: 49484 - protein, 72 aa, Zea mays; identical to SEQ ID NO: 46899
  misc_feature: Ceres CLONE 1460460-F

SEQ ID NO: 49485 - DNA, 716 bp, Zea mays
  misc_feature: Ceres CLONE 1460462-F
  misc_feature (424)..(424): n is a, c, t, g, unknown, or other
  misc_feature (438)..(438): n is a, c, t, g, unknown, or other
  misc_feature (446)..(446): n is a, c, t, g, unknown, or other
  misc_feature (462)..(462): n is a, c, t, g, unknown, or other
  misc_feature (465)..(465): n is a, c, t, g, unknown, or other
  misc_feature (482)..(482): n is a, c, t, g, unknown, or other
ggagctccccgcggtggcggccgctctagaactagtggatcccccgggctgcaggaattcgtctcacccctaatcgaaaactcactctcactctcacttccacactcctactcctccccgcccccgtcgccttccgccgccgtcttttgcgctaacgcttcgcctttcgatcccctttctgacttcttatagcatcatcccaagtcctcgcccggactccgcagattctctggttgctacgagttcttcgcctggtttttgggcaaggccaaaatttctgatttttttccaccgccgcaaacccctttgctgtgccataccgccattccattcctaagctgggcgtgggcgggtgaagaaaggagcgaggccggctgtttcgctgaaacccgccgcccttttttccttttcttttctggacctngtatgagaacgtancaaaatanggaaggaggaccggcngcngcccggtcgtcggtaantatgatcacctgctgttctcgtgctgttccggagggcccgtaacctgctctcatggtgaagtccgcccctccggaactgcaaatccctcttgaaccagtaaaaagggcaaggcccgggaacctcaaaaacctggatggaccctctgggatcctagggccaggtcccgagacctaaaaaccaaaagggggtaaattgggcccccccccctggaaaagggtttggaaaaccccccc

SEQ ID NO: 49486 - DNA, 765 bp, Zea mays
  misc_feature: Ceres CLONE 1460467-F
  misc_feature: Encodes the peptide sequence at SEQ ID NO. 49487
  misc_feature (651)..(651): n is a, c, t, g, unknown, or other
  misc_feature (656)..(656): n is a, c, t, g, unknown, or other
  misc_feature (704)..(704): n is a, c, t, g, unknown, or other
ctccccgcggtggcggccgctctagaactagtggatcccccgggctgcaggaattcgtctcacccctaatcgaaaaaccgatttgcagacccatggtgctgacgaagaatgcactccgcattctctacaaatagcttggcaccttgacacctagcttcacctccctcctcctggcccagtcgtcctagccatcaaaattcagttgagggttcttcagttcagccatgaagcttgagatgacagcagcggccatggtcttgatcctgctgacctcgggcgccgaggccaaggtctgctactcgcggagcaggaccttcaaggggtggtgctaccacagcatcaactgcatcgccatctgcatcaccgagggcgacaccagcgggttctgccaggccggggcctgcatgtgcacttatgagtgtctcaatggtgtcgtccccggtggcggcggtggcggcggacagcatccatcggttggctcatcgcgtggtggtggtgctgaggctaaagcagccgtcccatcagtatagagcttctgattctggcggggtgatggcagatggtgcactactactcttccgtgcacatgctaactcaaggtttcgagttgatgaataacacaaatggttcttttacttaaatgtgtatatntcccntaacccaatacaaaaaaaaaaaaaacgagacgctcgaggtaccaattncgccctatagtgagtcgtattacgcgcgctcactggccgtcggtttacaacgtcgtgactg

SEQ ID NO: 49487 - protein, 101 aa, Zea mays
  misc_feature: Ceres CLONE 1460467-F
  misc_feature (22)..(66): Pfam Name: Gamma-thionin Pfam Description: Gamma-thionin family
MKLEMTAAAMVLILLTSGAEAKVCYSRSRTFKGWCYHSINCIAICITEGDTSGFCQAGACMCTYECLNGVVPGGGGGGGQHPSVGSSRGGGAEAKAAVPSV

SEQ ID NO: 49488 - DNA, 738 bp, Zea mays
  misc_feature: Ceres CLONE 1460469-F
  misc_feature: Encodes the peptide sequence at SEQ ID NO. 49489
ctggagctccccgcggtggcggccgctctagaactagtggatcccccgggctgcaggaattcgtctcacccctaatcgaaaaatcaagaattcgcactagaccattacctagaacatcctaatcgaaaaactactacactccaaaatgtgctttaaccagggcttctgtctactgtaccccaatcggggatttgccagtagaccaggaagtcattgaggaactcagtgctactggaaagtttgaatttatggaccttaatgtggatgaagctgaacatagcatggaaatgcatttgccctaccttgctaaagtatttcaaggacataatgtgaaagtcgtccctatccttgttggtgcacttagctcccaaaacgaagccttgtatgggcagctgctctccaaatatgtggatgacccaaaaaacttcttttccgtgtcgtcagacttctgccattggggatccaggtttagctacacatactacgaaaagaagcacggtgccatccataaatctatcgaggccttggaccgtatgggcatggagatcatagagactggcgatcccgtagcgttcaaagaatacctgcaggagtacgagaacaccatatgcggacgccaccccatcagcgtcttccttcacatgttgaaacattgctcgacaaaaattaagataagctttgtccgctacgagcagtccagccagtgcaagaacatgagggatagcagcgtgagctatc

SEQ ID NO: 49489 - protein, 163 aa, Zea mays
  misc_feature: Ceres CLONE 1460469-F
MDLNVDEAEHSMEMHLPYLAKVFQGHNVKVVPILVGALSSQNEALYGQLLSKYVDDPKNFFSVSSDFCHWGSRFSYTYYEKKHGAIHKSIEALDRMGMEIIETGDPVAFKEYLQEYENTICGRHPISVFLHMLKHCSTKIKISFVRYEQSSQCKNMRDSSVSY

SEQ ID NO: 49490 - DNA, 757 bp, Zea mays
  misc_feature: Ceres CLONE 1460472-F
  misc_feature: Encodes the peptide sequence at SEQ ID NO. 49491
  misc_feature (519)..(519): n is a, c, t, g, unknown, or other
ctccccgcggtggcggccgctctagaactagtggatcccccgggctgcaggaattcgtctcacccctaatcgaaaacttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattttctattccgtattgaaggcgtcgatggccttgtccgccctaatcagcaccctcctcgccgtcgccatctgtcaacttattgctccagtttatacgaccattgccagaccgtgggaaggacaattcatattgtcaatctttgatcagctgctgagcacttcgactatcctgtagatatgatatcagagagctgatttcatttgaagatgttatggangaagttggggttggggccaaatggcggtctctcttctggctgggaccccttgaagacggcttggaatgattggtttgataaccccttaagaaccccccaaggaaggatacctgggtttaaatccccgcccaattaaacctttccccctggttcccttttggggaacttttgccgaccctgaaaacaaaaattttccggttgggccttttaaccttttgaacccatttggcccaagaaa

SEQ ID NO: 49491 - protein, 48 aa, Zea mays
  misc_feature: Ceres CLONE 1460472-F
  misc_feature (4)..(4): Xaa is any aa, unknown, or other
MLWXKLGLGPNGGLSSGWDPLKTAWNDWFDNPLRTPQGRIPGFKSPPN

SEQ ID NO: 49492 - DNA, 751 bp, Zea mays
  misc_feature: Ceres CLONE 1460476-F
  misc_feature: Encodes the peptide sequence at SEQ ID NO. 49493
tggagctccccgcggtggcggccgctctagaactagtggatcccccgggctgcaggaattcgtctcacccctaatcgaaaaaaccagcccaacaaatccaggcgtgccccgtgcgcgcatccctccgcgtctccgcctcatggcggcatcagcgtctcggcccctcgcgctcctcgcgtgcacctcggcatctcacggcgctgggcggcgggcgtgggctcgcttggctgtctcttcctattcggcgaggtcggcgctccccaggctccgcgggcgtcggtcgttcgccgcctccgcagggggcgccgtgatggggaacccaagccccggcgccgttgacgccgacgtcgggatggatgccgtccagcggcggctcatgtttgaggaccactgcattttagtggaccaacaagacaatgtcatcggccacaagtccaagtataactgccatctcatgtagaagatagaagctggaaatgtcctgcacagagctttcagtgttttccttttcaactccaaatatgaattgctactacagcagatgtctgcaacaaaagtgacatttccacttgtctggaccaacacctgctgtagccatcctctctaccgcgagtcagagttgattgaggaacattgtgcaggggtgagaaatgcatcccagcgcaaactatttgatgaactgggaatagttgctgacgaatacctggtgacagctccatctccttgggagatgctttacatggctcctaaa

SEQ ID NO: 49493 - protein, 106 aa, Zea mays
  misc_feature: Ceres CLONE 1460476-F
  misc_feature: SWISSPROT Homolog: EC 5.3.3.2 Isopentenyl-diphosphate Delta-isomerase
MAASASRPLALLACTSASHGAGRRAWARLAVSSYSARSALPRLRGRRSFAASAGGAVMGNPSPGAVDADVGMDAVQRRLMFEDHCILVDQQDNVIGHKSKYNCHLM

SEQ ID NO: 49494 - DNA, 656 bp, Zea mays
  misc_feature: Ceres CLONE 1460477-F
  misc_feature: Encodes the peptide sequence at SEQ ID NO. 49495
  misc_feature (216)..(216): n is a, c, t, g, unknown, or other
ccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaaacatggtttactcatgagggcagaagaaggataaaaactttacaaaagtgaagggncgggttaagcatgattgaaaacatcctggttccaagcgggactgctccaagtttcgctattatcagtgaaggcgggtgttagttctccttttccccccggaccctctttttttcccaagggaaccccactttgtccttttttgaaaacttttcaaaaaatgggccggcgccccgaaccttgaaaggttgggagccccccccaaacccaaaagtgtttggaaacactttcccaaccggaagggggttttttttcccctccctggggggaaccccccccagagaaggttttttttttttataaaaaccccccttttttttccccgcaaaaaaaaaggggggcccccccccccccaccgggggggagaaaaaccgtgggtgtttgttttttttttttataaaaaaaaaaccccccccgtttgtttgtttttaaaaaaaaaact

SEQ ID NO: 49495 - protein, 58 aa, Zea mays
  misc_feature: Ceres CLONE 1460477-F
PRGGGRSRTSGSPGLQEFVSPLIENKWERQRFGLQGGFVTNPLAEPNISSAGKNMVYS

SEQ ID NO: 49496 - DNA, 784 bp, Zea mays
  misc_feature: Ceres CLONE 1460478-F
  misc_feature: Translation starting site: 189
  misc_feature (732)..(732): n is a, c, t, g, unknown, or other
  misc_feature (733)..(733): n is a, c, t, g, unknown, or other
aagctggagctccccgcggtggcggccgctctagaactagtggatcccccgggctgcaggaattcgtctcacccctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaagggccgacggcgtcgcaggcgctgacggtggcgacgctgttcccgctggggcggctgctgctggtgctgtcggggctggcgctgacggcctccgtggtggggctggccgtggccaccccgggggttcctgatcttcagcccccgtgctggtccccgccgccgctgctcatcgggacaggccgcatggggtttccctcacgtcggggccccttgggctccggggccttttcccccctaaatgtccctccacaaacgggggggggggggtttccccccccccccgaaaccctggggagaggcgcccccccgaggtggggagaggccgggcccccgggcccaaaaaacccggggggggggcccccccccctggaggcgccaaaagccccccccccggaaaaaaaaaatcccccctcttggggggnnatttttccccctaaaaaaaccccctctttttattataaaaacccccccgcc

SEQ ID NO: 49497 - DNA, 733 bp, Zea mays
  misc_feature: Ceres CLONE 1460479-F
  misc_feature: Encodes the peptide sequence at SEQ ID NO. 49498
tggagctccccgcggtggcggccgctctagaactagtggatcccccgggctgcaggaattcgtctcacccctaatcgaaaaaagctcttgaaaactgctcgtcccctccacttcaaaatctactactcaaggatggaaagctgtcatctctgtacacaacccaaggtgtggcggttgctgagctacagttctgccatcctgaggtggtcccaacgtcaaagaacttctggaagccactatgtgcatctctgcagaatctgctgaggtgcagcgtcgacatccgaatcaacctatctcctatctccggcaacggggcgggatccaaggactcgtccgtcagccttgtcatggagtcaagagaagaagaccgcgaggcacaggacccagccacctcaaactgcagaaccgtggtgtcatccgggagagactgcccttccccacccttggggcaggccaaggagagatcgtcccacatcctggggtgcctccatggcggcgcgggtggcgacgccgtggacaccgagccgaggatcctgagctaccagaagatctccgttgtccctgcagcatccaccccaggaaacactcccctgaaagccgctgccgccgctgccggagacgagtcaaaggttgatgatggcggggttcgtcctggctgctgctcgcacattttaccctgtggtgcttgcgctccccgtcagaagccccggacgcgggagaaacgccgtgccaa

SEQ ID NO: 49498 - protein, 128 aa, Zea mays
  misc_feature: Ceres CLONE 1460479-F
MESREEDREAQDPATSNCRTVVSSGRDCPSPPLGQAKERSSHILGCLHGGAGGDAVDTEPRILSYQKISVVPAASTPGNTPLKAAAAAAGDESKVDDGGVRPGCCSHILPCGACAPRQKPRTREKRRA

SEQ ID NO: 49499 - DNA, 770 bp, Zea mays
  misc_feature: Ceres CLONE 1460482-F
  misc_feature: Encodes the peptide sequence at SEQ ID NO. 49500
ggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcacccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagttgttaaataaagaaaattatctgacaaaaaaaaaaaaaaacgagacgctcgaggtacc

SEQ ID NO: 49500 - protein, 72 aa, Zea mays; identical to SEQ ID NO: 46899
  misc_feature: Ceres CLONE 1460482-F

SEQ ID NO: 49501 - DNA, 709 bp, Zea mays
  misc_feature: Ceres CLONE 1460483-F
  misc_feature: Encodes the peptide sequence at SEQ ID NO. 49502
ggagctcaccgcggtggcggccgctctagaactagtggatcccccgggctgcaggaattcgtctcacccctaatcgaaaattccccaatccccgtgtcgcctgtgcccctctgccacctcgccgtcggcatgacaacagggtcgaccccgggttcggccccctctcagagaaaacgaaattctaccaaggattccgttgccctgtacgcggtgcaatgctataagtgctacaaatggagtacggttccaaaagaagaatttgagacgcttcgtgaaaacttcactaaggatccatggttctgcagcagacgaccagacagctcttgtgaagacgatgctgacattgagtacgacagcagccgcatttgggttttggacaagcccaacataccaaagcctccaccagagacggagaggctagtggttatgaggggcgactacagcaaaatggacacatattatgtcatgcccaatgggaagcgtgcaaggtgtgctggtgatgtggataagttctggaggcaaaatccggagtacaaagaccgcatatctgctttcggatttcagctttgcgccaccccaaggtgtttgagggaaactggttctcacaaaccctggcttggaaagtttccaaaacccaaaaacccgggaaaaggcgaaagccccaaaaggtgaatgaacccccccacggggggtttggggtttttttaaa

SEQ ID NO: 49502 - protein, 180 aa, Zea mays
  misc_feature: Ceres CLONE 1460483-F
  misc_feature (25)..(73): Pfam Name: zf-CW Pfam Description: CW-type Zinc Finger
MTTGSTPGSAPSQRKRNSTKDSVALYAVQCYKCYKWSTVPKEEFETLRENFTKDPWFCSRRPDSSCEDDADIEYDSSRIWVLDKPNIPKPPPETERLVVMRGDYSKMDTYYVMPNGKRARCAGDVDKFWRQNPEYKDRISAFGFQLCATPRCLRETGSHKPWLGKFPKPKNPGKGESPKR

SEQ ID NO: 49503 - DNA, 730 bp, Zea mays
  misc_feature: Ceres CLONE 1460490-F
  misc_feature: Translation starting site: 149
  misc_feature: SWISSPROT Homolog: EC 2.7.11.1 Non-specific serine/threonine protein kinase
  misc_feature (613)..(613): n is a, c, t, g, unknown, or other
tggagctccccgcggtggcggccgctctagaactagtggatcccccgggctgcaggaattcgtctcacccctaatcgaaaatcacattcacatcgcactctcctccagcctccaggcttggcaagcgtgcttcaacatgaccacatccatgtcgaacagcgccgctagcgagaagcaagcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacggcttcgtggacctcggcgagttcagggcgttccacgcgcgcggcggcggcggcgtggacgacgacgccgagatccgcgccgccttcgacgtctacgacgtcgacggcgacggccgcgtcacggcggccgagctgggcaaggtgctcgcgcgcatcggcgagggcggatgcagcgccgaggagtgcgagcggatggtcgccggcgtcgatgccgacggnctgcgtcgggttcgaggacttcaagaagatgatgtgcccccagccgcaagccgaagccggcgccgccgggcgggacaaggcagaggccgaggccgaagaacaggaggaagtgacggg

SEQ ID NO: 49504 - DNA, 744 bp, Zea mays
  misc_feature: Ceres CLONE 1460491-F
ggagctccccgcggtggcggccgctctagaactagtggatcccccgggctgcaggaattcgtctcacccctaatcgaaaattgccgtggatctctacgttcgcaaatccggccctcgaaagcaagctgtctgctcggacgtcaggatgattgatgcagcctgaacgcatggttgctggtgtgtgcagtctgatcgatacccatttacccagggggccggcacgacaactctgtggacgacctgctgttctgcgcgtgtgctggtccacttttctttctcctctgcaggctgctgcaattctcttttatgccatcagctcttttcttttctggtgaacgtacattgtcatttctgcaaccttgtgataccatggcgtgcacctgaaccatgaatgtatgactcactccgaatctaaactgattgagtactatgctaagctgaggatctgcattcacatcatgtgctggagcgcaaattaggtttcattatcagatccctcactttcaccaactcactcaggagcccccccaagccgtggactaccctgggattgcttacgtcataagaactaccgctgtgtttgtcagagtattgtcgtacctagagaatcaaggagcattgtaatcacaatgcctcaactgcccacagaacaatgcatacgtcttgaaaatagcccagttaaactccctcctaaaaaaaaaacataaagacgaaaccctccaccgtaccctgatcgccccaaga

SEQ ID NO: 49505 - DNA, 744 bp, Zea mays
  misc_feature: Ceres CLONE 1460492-F
  misc_feature: Encodes the peptide sequence at SEQ ID NO. 49506
aaagctggagctccccgcggtggcggccgctcctagaactagtggatcccccgggctgcaggaattcgtctcaccccctaatcgaaaagttactcctccgtcctccctccgtgtttacacccgccgccactcctgccttggcaccgtagctagcaaaggcgatatccatggctagccctgcacggatcgagctggacaagctgatcgtggaccacctcagggggctcaaggagcagacggatctggaggtcaacctcctccaagacagcctcaccaagatccgcaccgccgccacccgactcgagaacgcctccgccgcgctccaagacctatccctccgcccccaagggaagaagatgctcgtgccacttacagcgtccctctacgttcccggttcactggacgacgcggaaaatgtcctcgtccatgtcggcaccggttacttcatcgagaaaaccatgtctcatgggaaagaatactgtgaaaggaaaattaatttattgaagtcaaattttgatgaactggctgaggcggctactaagaagaaagccatagcatacgatgtgggtttgcttctacaagccaagctgaggcaagcgtcaccgcgctcaagttcatgagagctggatgcacacctcgtctcttctacctatgttgtatcagacatcatttagtaattttgaagttggaccccgcagcagcgaagattgtattcttgggcatcatctgtcttcagcaactgtt

SEQ ID NO: 49506 - protein, 150 aa, Zea mays
  misc_feature: Ceres CLONE 1460492-F
  misc_feature (24)..(143): Pfam Name: Prefoldin Pfam Description: Prefoldin subunit
MASPARIELDKLIVDHLRGLKEQTDLEVNLLQDSLTKIRTAATRLENASAALQDLSLRPQGKKMLVPLTASLYVPGSLDDAENVLVHVGTGYFIEKTMSHGKEYCERKINLLKSNFDELAEAATKKKAIAYDVGLLLQAKLRQASPRSSS

SEQ ID NO: 49507 - DNA, 758 bp, Zea mays
  misc_feature: Ceres CLONE 1460493-F
  misc_feature: Encodes the peptide sequence at SEQ ID NO. 49508
  misc_feature (704)..(704): n is a, c, t, g, unknown, or other
agctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtctcccttccagcataaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttcgatatgcatatacggtatctgtgcctggcaaacatattttgaggctagctaaatatgaaccttttgtctnctaagttgttaaataaagaaaatatctgacaaaaaaaaaaaaaaacgagacgct

SEQ ID NO: 49508 - protein, 72 aa, Zea mays; identical to SEQ ID NO: 47800
  misc_feature: Ceres CLONE 1460493-F

SEQ ID NO: 49509 - DNA, 754 bp, Zea mays
  misc_feature: Ceres CLONE 1460494-F
  misc_feature (304)..(304): n is a, c, t, g, unknown, or other
  misc_feature (310)..(310): n is a, c, t, g, unknown, or other
  misc_feature (311)..(311): n is a, c, t, g, unknown, or other
  misc_feature (415)..(415): n is a, c, t, g, unknown, or other
  misc_feature (504)..(504): n is a, c, t, g, unknown, or other
  misc_feature (615)..(615): n is a, c, t, g, unknown, or other
  misc_feature (616)..(616): n is a, c, t, g, unknown, or other
  misc_feature (631)..(631): n is a, c, t, g, unknown, or other
  misc_feature (687)..(687): n is a, c, t, g, unknown, or other
  misc_feature (703)..(703): n is a, c, t, g, unknown, or other
  misc_feature (725)..(725): n is a, c, t, g, unknown, or other
ctggagctccccgcggtggcggccgctctagaactagtggatcccccgggctgcaggaattcgtctcacccctaatcgaaaacagccatccgccgcggctcgtctccgtctcccggctcctcggcgtctagctcgtcaacgcgcgcgtccgccgtcggctcctccgaccggcgtcccaccacaggggaatacagatcgacgatccgctgggcttgcaaacatgtatatccgagtgaagcgcaacaagagtacctacttcattcgatgtgaaccaacagagacagctttgagcatcagaacatgnaaaagnntttttgggcccaaacccccttatcccgcggggccctcttttggggaaaaaattttgagggggaaaaatcttcccaaaaaaaacccccccctttttccccccccntaaagttaagggtccaagccaagctttggttccatttggttgggcgccataagccagttgggatgttggctttttggaaggaaacctcnccaaaaaagaaaccttttttgggggccaaagaaatctccaaaaagaggggtggggggggataataaaaagagaaatatttcccgctttgtggtttgggccgcgttttgggnncccccccccaaaaanaaaaaaaaaaaaaatgtggcagccgcgcggggaaatattctctgaaggagagaganagagtttttttttttntacaccccccccccaggggggnggccgcggggggaggttgttttttttttt

SEQ ID NO: 49510 - DNA, 764 bp, Zea mays
  misc_feature: Ceres CLONE 1460495-F
  misc_feature: Encodes the peptide sequence at SEQ ID NO. 49511
  misc_feature (387)..(387): n is a, c, t, g, unknown, or other
  misc_feature (399)..(399): n is a, c, t, g, unknown, or other
ctggagctccccgcggtggcggccgctctagaactagtggatcccccgggctgcaggaattcgtctcacccctaatcgaaaaaagactgcttaaacatgattgctcggcttccaccagtggcttcttatgtttaccggagaattttcaagggtgggaaatcaatataaactgacaattctctggattatgcagcaaatttctcacacatgcttggttttgatgaccctaaaatgctggagctgatgcggctctatgtaacaattcacactgatcatgaaggcggggatgtcagtgctcatactggtcatctggttggaagtgctctgtcagatccttatctttctttcgcagcggctctaaatgggttagctggggcactacatggncttgcaaatcanggagtgcttctatggatcaaatctgtaattcaggaaactgggagtgatgtaccaacggatcaacccaaagagtatgtctcgaaaaacctaaaaagtggaaaggtgtgtccctggatttgccaaaggaattctggctaaaaaaaacccccggtattttgtgtaaaagggaatttcccctaaaacttttccccaaaaaaccctttttccaagggggggcaaaaattttagaaacccccccccccaacccccctgggctgaaaaaggccaaaaccccgggcccaagtgtttttcccccccgggggtttttttaaaccccttttggatttttaaaaccgcgaaaccccggttttttttcttgtttagaa

SEQ ID NO: 49511 - protein, 109 aa, Zea mays
  misc_feature: Ceres CLONE 1460495-F
  misc_feature: SWISSPROT Homolog: EC 2.3.3.1 Citrate (Si)-synthase
  misc_feature (64)..(64): Xaa is any aa, unknown, or other
MLGFDDPKMLELMRLYVTIHTDHEGGDVSAHTGHLVGSALSDPYLSFAAALNGLAGALHGLANXGVLLWIKSVIQETGSDVPTDQPKEYVSKNLKSGKVCPWICQRNSG

SEQ ID NO: 49512 - DNA, 769 bp, Zea mays
  misc_feature: Ceres CLONE 1460496-F
tggagctccccgcggtggcggccgctctagaactagtggatcccccgggctgcaggaattcgtctcacccctaatcgaaaaaactactccgtcactttatttgcaaagctcctcctcgatctatcgatcactgtgaccggccggtggctccgacgctctgaggggctagccaacgagacagcagcaatggcgaaggtggcccacgacggcatctagcgggggacccaccccaccaaggggcagttccagctctccgaacgaggggtgctcgcgatggttaagcacggcaaggtcttgttcaacgagtcggagccgaacgcctcgcaggactagacggaggtgaccatgatagggggggtctggatggtggaggcccccggtgtgtccgcccccacgaacgtttgtgtgggggatggctgttgtctggacggtgtacctgatctacacccccgagctcatcccccacgccgctcctcaccggaccgccgtcttcggcttccacaattgggcgttctggaggtccgcagcaagtattttcatacctgactacaccacccgatctcgaaggctttctagggaatcccgccttaactcgaagaagggcctccgctaagagcgggcagggttgggtccaaaccggcccaaatatccctgaaccgtcgacaactcccacctgggttgcgatcacaacctacccccgtcccgggtaagggtgaccggacaattcctgggcccactcagccaaagttttccctcccaacgcaaaaaa

SEQ ID NO: 49513 - DNA, 764 bp, Zea mays
  misc_feature: Ceres CLONE 1460498-F
  misc_feature: Encodes the peptide sequence at SEQ ID NO. 49514
  misc_feature (711)..(711): n is a, c, t, g, unknown, or other
  misc_feature (743)..(743): n is a, c, t, g, unknown, or other
  misc_feature (745)..(745): n is a, c, t, g, unknown, or other
ctcacccgcggtggcggccgctctagaactagtggatcccccgggctgcaggaattcgtctcacccctaatcgaaaagagaatcgaggattattatcgaataacagaacaccacttacctggtattcatgcgtcgaccatcaccggcgacggcgtatctccgtgctcacgtcccggcgtcccgagccggcggccacgggccataacagacccggaggacatcaccagcgcgagcgccgccagccccaagcaccgaggccgagccgcccgagcgcggagcggcggtaccacgccacccgcccgccgccgcccgttgcggaggctgtgcagcacagccgttggggtgccgaggcaccgatcaggctgcgcaaccgccgaagtcggcctccgggtggcgccaagctgcagagcagcgcgccagcgcccctgtatcggactacctttttcggcgagaccaccctagtagaggatgatatacaccgcgattgacacgttctacctgacggaggagcagctgcgcaactcaccatcacggaaggatgggatcgacgaggccactgagactgtgctccgcgtctatggctgcgacctcatccaggagagcggcatcctcctcaggctaccacaagcagtgatggccacggcacaagtattgttccatcgcttttactgcaaaaaatcatttgttcgatttagtgcaaagagagttgcntgctagttgtgtttggctgggcagggaagttngnaggagagtccccagaaatc

SEQ ID NO: 49514 - protein, 82 aa, Zea mays
  misc_feature: Ceres CLONE 1460498-F
MIYTAIDTFYLTEEQLRNSPSRKDGIDEATETVLRVYGCDLIQESGILLRLPQAVMATAQVLFHRFYCKKSFVRFSAKRVAC

SEQ ID NO: 49515 - DNA, 731 bp, Zea mays
  misc_feature: Ceres CLONE 1460499-F
  misc_feature: Encodes the peptide sequence at SEQ ID NO. 49516
  misc_feature (405)..(405): n is a, c, t, g, unknown, or other
ctggagctccccgcggtggcggccgctctagaactagtggatcccccgggctgcaggaattcgtctcacccctaatcgaaaacaaaaacgttttaccccgtccggccgtccccctcgttctttctctcccccttctctctcgctgcgacgactgggtaggctgccgccgccgccctacgccaggtcccgaggaccaaggcattcgtattcgtcagtctcttcgccgggcgacgccagtttggttggaacttggagtgtagagggaagatttggtgatgagcagccgcagcccgccgccgaaggaccgcaggatgcgtactgaacgcacctcataccgtggcgcaccatatcggagggacagccgccatggtcccagcagggttcggaatgatttgtgcaacattngtaagcgtcctgggcattttgctagagagtgtcctagcgtggctgtctgtcatacctgcgggcttcctgggcacattgcagctgaatgttcttccaaggtacctgctgaaactggcaagagcctggccactggctaacagctgccaaatgaagggatttgcgtaactgtggcaagcccgaactatggcaagaaatgcctggtccacagtgccgcaggaaaatgatccttgcacacctgtaacagcaaggcatttctggaggatgcccaaggaaaggctggaaaattgcgggaaaaggcctttttccccgaactgccaatgatccgt

SEQ ID NO: 49516 - protein, 88 aa, Zea mays
  misc_feature: Ceres CLONE 1460499-F
  misc_feature (58)..(75): Pfam Name: zf-CCHC Pfam Description: Zinc knuckle
  misc_feature (44)..(44): Xaa is any aa, unknown, or other
MSSRSPPPKDRRMRTERTSYRGAPYRRDSRHGPSRVRNDLCNIXKRPGHFARECPSVAVCHTCGLPGHIAAECSSKVPAETGKSLATG

SEQ ID NO: 49517 - DNA, 671 bp, Zea mays
  misc_feature: Ceres CLONE 1460506-F
  misc_feature: Encodes the peptide sequence at SEQ ID NO. 49518
  misc_feature (494)..(494): n is a, c, t, g, unknown, or other
  misc_feature (565)..(565): n is a, c, t, g, unknown, or other
  misc_feature (566)..(566): n is a, c, t, g, unknown, or other
  misc_feature (614)..(614): n is a, c, t, g, unknown, or other
  misc_feature (661)..(661): n is a, c, t, g, unknown, or other
cgattgggtccgggccccccctcgagccactgcagtggtaaaggggtgtccttatccccacacaagcgccgcttaccgcccgggacaggactgttggaagtccccagacggcagcgatggcggaattatcgacatcatcggatggattggtggacgaagaagcgaggcagcaggaaccaggacaaggaagcactgaaggtagccatggtctgcaagacacaaaggagcaggacataagaaagggaaaggcggctcttgtttccactgaactgctgagggaggatctggttcagagtgctgttagttttctgaaacacccgaaagtagtagcctcttcggatggacagaggcgttctttccttgtaaataaaggactcaccatggatgaaatagatgaagcatttcgacgtctacaaagcccgtcatcgaattctgcgagctcaaatatgtgcacatctcaggggatgtttgatcattcatgcaggattactgangaaattgagtcgatagaaagtgtatggatggttttagagaggtggaaactgaagctggacctggtgccccnntgtgtacctcgtcatccaaatcatatatggagatcatggaatgatacnaaggggtgagcgcccgacgatataaggatattaacgatgaccctccnaatcctgatc

SEQ ID NO: 49518 - protein, 168 aa, Zea mays
  misc_feature: Ceres CLONE 1460506-F
  misc_feature (53)..(151): Pfam Name: Pex14_N Pfam Description: Peroxisomal membrane anchor protein (Pex14p) conserved region
  misc_feature (126)..(126): Xaa is any aa, unknown, or other
  misc_feature (150)..(150): Xaa is any aa, unknown, or other
MAELSTSSDGLVDEEARQQEPGQGSTEGSHGLQDTKEQDIRKGKAALVSTELLREDLVQSAVSFLKHPKVVASSDGQRRSFLVNKGLTMDEIDEAFRRLQSPSSNSASSNMCTSQGMFDHSCRITXEIESIESVWMVLERWKLKLDLVPXCVPRHPNHIWRSWNDTKG

SEQ ID NO: 49519 - DNA, 654 bp, Zea mays
  misc_feature: Ceres CLONE 1460511-F
  misc_feature: Encodes the peptide sequence at SEQ ID NO. 49520
  misc_feature (607)..(607): n is a, c, t, g, unknown, or other
  misc_feature (608)..(608): n is a, c, t, g, unknown, or other
  misc_feature (632)..(632): n is a, c, t, g, unknown, or other
cgattgggtacgggccccccctcgagccctgcagtggtaaaggatgcccaacccaccagcatcaaccacgcaacggctagtacggagggagagggggcaagcagcgagcagcgagcagcgccgtctcctcgtccgttccttgaggctgagagcctgagacaacggtcatattaccgttgtcctgctacaattccaactttttaaacctgccgcagggccttcaccgtctcccccagctctctctcccgctccttcgccctcgcacgtcgtctctttcctcgcgagcgacgcgcgcttctcacccgcatcgccgatggagacgccgctgtccaccaggaggatcactcgctcgctggccgccgcatccgcccagaagagcgccgccgcagggatggactccgccgccctcttctccctgtccaagaacgccgccgcgggtgagacacacgcacagacgcgcgcggcccttcacgacatcaccaacgactcccccgtcgtcggcctcgccgcgggcagcctccacgccaccgacaccacccccgccaagacccgccgcagggccccgcgctgcacgccaggctccggggaggcgctcctgcgcggccanngtcaagcgctcctgcacaaggtcnaacaagagcagggctgcgccgc

SEQ ID NO: 49520 - protein, 113 aa, Zea mays
  misc_feature: Ceres CLONE 1460511-F
  misc_feature (98)..(98): Xaa is any aa, unknown, or other
  misc_feature (99)..(99): Xaa is any aa, unknown, or other
  misc_feature (107)..(107): Xaa is any aa, unknown, or other
METPLSTRRITRSLAAASAQKSAAAGMDSAALFSLSKNAAAGETHAQTRAALHDITNDSPVVGLAAGSLHATDTTPAKTRRRAPRCTPGSGEALLRGXXQALLHKVXQEQGCA

SEQ ID NO: 49521 - DNA, 625 bp, Zea mays
  misc_feature: Ceres CLONE 1460514-F
  misc_feature: Encodes the peptide sequence at SEQ ID NO. 49522
  misc_feature (348)..(348): n is a, c, t, g, unknown, or other
  misc_feature (373)..(373): n is a, c, t, g, unknown, or other
  misc_feature (464)..(464): n is a, c, t, g, unknown, or other
ccgggccccccctcgagccctgcagtggtaaaggagtctttccctgccacagtcatcagccgccgtagggagcaggagtgagggagcgcgatggcggagaagaagcagcgcccaggagggtccaggaaggacgaggtggttacccgcgagtacaccatcaacctccacaagcgcctccacggatgcaccttcaagaagaaagcccccaatgctatcaaggaaatcaggaagtttgcacagaaggcaatgggcaccactgacatcaggattgatgtgaaactcaacaagcacatctggagcagtggtatccggagtgtgccgaggcgtgtccgtgtcaggatcgcacgncagaggaacgatgaagaagacgccnaggaagagctttactctcttggtaccggtgctgagattccccagaaggcctgaagggtctgggtaccaagggttgtggagacgacaagtanatctggctgggtactgatctggtgtcatgtcaaatcatttttttggtgggttttgagtttggtagcactaagtcgatagctttgtgagaaatcttgagttttctgatggcgcgcttggtcccggctggttttgaactttttgagatactgcaacaagtatt

SEQ ID NO: 49522 - protein, 111 aa, Zea mays
  misc_feature: Ceres CLONE 1460514-F
  misc_feature (12)..(106): Pfam Name: Ribosomal_L31e Pfam Description: Ribosomal protein L31e
  misc_feature (95)..(95): Xaa is any aa, unknown, or other
MAEKKQRPGGSRKDEVVTREYTINLHKRLHGCTFKKKAPNAIKEIRKFAQKAMGTTDIRIDVKLNKHIWSSGIRSVPRRVRVRIARQRNDEEDAXEELYSLGTGAEIPQKA

SEQ ID NO: 49523 - DNA, 662 bp, Zea mays
  misc_feature: Ceres CLONE 1460515-F
  misc_feature: Encodes the peptide sequence at SEQ ID NO. 49524
  misc_feature (551)..(551): n is a, c, t, g, unknown, or other
cgattgggtaccgggccccccctcgagccctgcagtggtaaaggtcatcaatcaaatactcagacaaccatggggcaccagcaggcgcagcacggcaaggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgccagcgagatcccggcgtccaaccacgactacctccggcgggtcatgcgcacgctgacagccatgcgcatcttcgcggccagccacgaccccgccaaggccgacgacgcggccgccatctcctaccagctgaccccggcgtcccggctgctcgtcagcagcagcagcagcgtcgacgacgccgtgggcgcctcgaaggagaacactactaccccgagcatcctccccaacatcgcccaccctggtccgccccaacaccatctccctgctgttcagcatggggcgagtggatgtangacgagagcgcggcgtccgtgtcgctgtacgagacggtgcaccggcagggaatgttggcgtgcgtagaagacaacgctgcccacagggccagcttctacgagagcatggac

SEQ ID NO: 49524 - protein, 182 aa, Zea mays
  misc_feature: Ceres CLONE 1460515-F
  misc_feature (34)..(82): Pfam Name: Dimerisation Pfam Description: Dimerisation domain
  misc_feature: SWISSPROT Homolog: EC 2.1.1.146 (Iso)eugenol O-methyltransferase
  misc_feature (161)..(161): Xaa is any aa, unknown, or other
MGHQQAQHGKDDTEELLAAHRQLWCHALGYVKSMALKCALDLRIPDTIDRCGGSATLGELLAASEIPASNHDYLRRVMRTLTAMRIFAASHDPAKADDAAAISYQLTPASRLLVSSSSSVDDAVGASKENTTTPSILPNIAHPGPPQHHLPAVQHGASGCXTRARRPCRCTRRCTGRECWRA

SEQ ID NO: 49525 - DNA, 679 bp, Zea mays
  misc_feature: Ceres CLONE 1460516-F
  misc_feature: Encodes the peptide sequence at SEQ ID NO. 49526
cgggccccccctcgagccctgcagtggtaaaggggggttctacaatatcattggcatcgacctgctctgctggtaaagagagaaggccgaaaggaccatgaccacacacgttccaaggtctacagctaccgcaagagccgcccgcctcatcactggccacaatgtgcaccctggagcagcgcgtgcgcgtcatcctcctcacccttaccgactacttcgagctccgcctgagcgacgcgctcatatcttcgcttcgatccgccgttgcttccccaccgactggtgcggccaaagcgtggtccggggtgcgcctcgtcaccgaccgggaggtccgcttcttctctaatcctctcgactcaaggaggagggatcttcgctcgcgccgcatatcaaatttcgtttacccgcgcggcggttggggttgacgacatccttaggctcctcatgttcaccgtcttccgtcgtgcccggccaaaccttcggaggcgggttcccacctttgcgatttgtcagaaaaaacaggaacacggggtgtggaccctgggattggtcctaaaagaaaccgaggtttaaatcctggctcctccctccccgccccatattttaggaccgttgcttccaatgccaggataaacggacaggcaaaccgggttcccaaaaaggttcagtgaactaatgg

SEQ ID NO: 49526 - protein, 87 aa, Zea mays
  misc_feature: Ceres CLONE 1460516-F
MCTLEQRVRVILLTLTDYFELRLSDALISSLRSAVASPPTGAAKAWSGVRLVTDREVRFFSNPLDSRRRDLRSRRISNFVYPRGGWG

SEQ ID NO: 49527 - DNA, 657 bp, Zea mays
  misc_feature: Ceres CLONE 1460517-F
  misc_feature: Encodes the peptide sequence at SEQ ID NO. 49528
cgaattgggtaccgggccccccctcgagccactgcagtggtaaagggggcgtcgcaccggaaccaaggccggaacagctgttcagcgagctgacagagatcaacgtgtccctcctcggcgggttcaacctcgaggactacttccccccgaatatggccatggcggacgtgctcctccggctggtgtccgtcaaggcccggcggctcaaccacaggtggaacgacctgttcgacgagctcatccaggaacacgtgcagagcaggccctccggcgagagcgaggagagcgaggcggacttcatacacgttctgctctccatacagcaagagtacggcctcactacggacaatctcgaggccatcttggtggacatgttcgaggcaggtatagagacatcttacctgacgctagagtacggcttggccgagctcatcaacaacaggcacgtcatggagaagctacagacggaggtgaggacgacaatgcgctcgccggacggcaagaagctggacatgctaacggaggaggacctcggcagcatgccctacctcaaggcgagcatcatggagacgctgcgcctgcacccgccggcgacgttcctcctccgcactactccaccgccgactccgagatcgacggatacttcgtctcagccgg

SEQ ID NO: 49528 - protein, 218 aa, Zea mays
  misc_feature: Ceres CLONE 1460517-F
  misc_feature: SWISSPROT Homolog: EC 1.14.13.68 4-hydroxyphenylacetaldehyde oxime monooxygenase
NWVPGPPSSHCSGKGGVAPEPRPEQLFSELTEINVSLLGGFNLEDYFPPNMAMADVLLRLVSVKARRLNHRWNDLFDELIQEHVQSRPSGESEESEADFIHVLLSIQQEYGLTTDNLEAILVDMFEAGIETSYLTLEYGLAELINNRHVMEKLQTEVRTTMRSPDGKKLDMLTEEDLGSMPYLKASIMETLRLHPPATFLLRTTPPPTPRSTDTSSQP

SEQ ID NO: 49529 - DNA, 649 bp, Zea mays
  misc_feature: Ceres CLONE 1460522-F
  misc_feature: Encodes the peptide sequence at SEQ ID NO. 49530
cgattgggtccgggccccccctcgagccctgcagtggtaaagggggggcggcggccgctcgtgtctgccgggctccgtcgtggtgacggccaccaacttctgcccgcccaacaacgcgctcccgtccgacgacggcggctggtgcaacccgccgcgcgcccacttcgacatgtcgcagcccgtgttccagcgcatcgcgctctacagggctggcattgtccccgtctcctaccgcaggtccgtgctccgtggttgtttattttgcccgtgtatagcaaaacaagaagggaaaggaactcgagcagatctgagagccgcgcttgtttgtttgtttgtttgtttgcttgcttgtttcctatcctacgtgctgtgcagggtcgcgtgcaacaagaagggcggcatcctgttcaccatcaacggccactcctacttcaacctggtgctggtgaccaacgtgagcggcgccggcgacgtgcacgcggtgcccgtgaagggcaccgttacgcggggtgcgcagccctgtcgcgcaactggggacagaactaggacagcaacacgctcctgtaccgataggcctctctcttccgacgaaccaccagagacggacgctccgtggtctacagcacactgcccccgcgcgtctggggtt

SEQ ID NO: 49530 - protein, 160 aa, Zea mays
  misc_feature: Ceres CLONE 1460522-F
  misc_feature (78)..(133): Pfam Name: Pollen_allerg_1 Pfam Description: Pollen allergen
MSQPVFQRIALYRAGIVPVSYRRSVLRGCLFCPCIAKQEGKGTRADLRAALVCLFVCLLACFLSYVLCRVACNKKGGILFTINGHSYFNLVLVTNVSGAGDVHAVPVKGTVTRGAQPCRATGDRTRTATRSCTDRPLSSDEPPETDAPWSTAHCPRASGV

SEQ ID NO: 49531 - DNA, 658 bp, Zea mays
  misc_feature: Ceres CLONE 1460533-F
  misc_feature: Encodes the peptide sequence at SEQ ID NO. 49532
  misc_feature (589)..(589): n is a, c, t, g, unknown, or other
caaatgggaccgggccccccctcgagccctgcagtggtaaaggcgagggtatctccatggccggcaaccgaacggtgcgtgagccgagggtcgttgtccagatcatgagcgatatcgacatcctcgacgacggctaccggtggaggaagtacgggcagaaggtggtgaagggaaatccaaacccaaggagctactacaagtgcacgacggtcgggtgccccgtgcgcaagcacgtggagcgcgcgtcccacgacctgcgcgccgtgatcaccacgtacgagggcaagcacaaccacgacgtgcccgccgcgcggggcagcgccgcgctctaccggcccgcgccgccgcccgcggacaccgccggccaccactacctcgccgcggcgcggccgggcgtggcctaccagacggggcagcagtacgggttcggtgaccagctgggctcgttcggcctcagcggcgcgccggcgcaaagcggcggcggcggcttcgcgttctcttccggcttcgacaacccgatgggctcgtacatgagccagcaccagcagcagcagaggcagaacgacgccatgcacgcgtcgagggccanggaggagccccgggaggacatgtttttcccgacgtcgttgctgtacactgactgaaggacaggacggca

SEQ ID NO: 49532 - protein, 213 aa, Zea mays
  misc_feature: Ceres CLONE 1460533-F
  misc_feature (41)..(100): Pfam Name: WRKY Pfam Description: WRKY DNA -binding domain
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature (196)..(196): Xaa is any aa, unknown, or other
NGTGPPLEPCSGKGEGISMAGNRTVREPRVVVQIMSDIDILDDGYRWRKYGQKVVKGNPNPRSYYKCTTVGCPVRKHVERASHDLRAVITTYEGKHNHDVPAARGSAALYRPAPPPADTAGHHYLAAARPGVAYQTGQQYGFGDQLGSFGLSGAPAQSGGGGFAFSSGFDNPMGSYMSQHQQQQRQNDAMHASRAXEEPREDMFFPTSLLYTD

SEQ ID NO: 49533 - DNA, 668 bp, Zea mays
  misc_feature: Ceres CLONE 1460545-F
  misc_feature: Translation starting site: 143
  misc_feature: Pfam Name: DUF558 Pfam Description: Protein of unknown function (DUF558)
  misc_feature (668)..(668): n is a, c, t, g, unknown, or other
ggagctccccgcggtggcggccgctctagaactagtggatcccccgggctgcaggaattcgcacgagaccattacctagaacatcctaatcgaaaaatgtcatcatgtgtagttccgtggaaacatatcgcctgtgactgagatggatgttacattgcagggtgaggtgattcgcatccaaggagacgagttctggcacatgacacgggttttgcgccttggcgttaacgacaaggttgaactattcaatggggcgggtggtttagctgaaggattcatacataaagttgacaaaggtggctcagatgttgagttattagaggatgctaggatcatagctcctcaaggcatccaatggcatgtctttgctgcgtttgggacactgaaaggcggacgtgcggattggcttatagagaaatgaacttggagcttctagtgttacccctctcctgacagaacgatgtcacacaatagcagaaaatcgggtggacaggctgcaacgccttgtgctggctgcagttaaacaatgccagaggatacatgaaatgtcgctgaaatccccaattcagataaagcaccttctacctgttgtatcacagtcaaagcttgctttcttagcatcagcggaagcgccctcctcttttaagtgttctgccagaatccagcan

SEQ ID NO: 49534 - DNA, 795 bp, Zea mays
  misc_feature: Ceres CLONE 1460547-F
  misc_feature (12)..(12): n is a, c, t, g, unknown, or other
aggaaaaaaagnagggggggttgtattagaagtataaaccccacctttatacaaatgcgtaccgggccccccctcgagacctgctctggtaaaggtggggggctactgttacaccagcaacaatggcggcggtaatcccaacaacaacagccacggcgtggaggtgaagagctacttcaacaagtccgccgggagggcggcgagcaacaacaacaacaacaacaacagccacgccggcggcggcaacaagaagggcggcgccggggagtacggcaggaagaagcacgccaagaacgagggcgcggcggcggcggtggccacagacaagcatcggtttcaagacgctcccggcgtcagacgcgctgccgcggggcccggccatcgggggctacatcttcctctgtcacagctaccccatgcacaacaccctctggagggagctgtttttggttgattaaaaaaaaaaaagaacacctcgcgcgtattcccgcccggagctgctccctcttccttctacatttactccacgccttctatctctacggccttcttccaaagcctcttatgcttctacgtaaaccaactctccccccttaacgtcgtggggaaagcaacagcaaatgcccccccgtccatttccccgttttcattgtaccagtatgtccggccgggctatagagaaaaaacttataccaaaccgctagggagccaggatcccctttatcgtccctattcccgtgccaccctctaaaagaaagccgcaaaaaaaatcccggggtaccggcgctttctatg

SEQ ID NO: 49535 - DNA, 658 bp, Zea mays
  misc_feature: Ceres CLONE 1460549-F
  misc_feature: Encodes the peptide sequence at SEQ ID NO. 49536
cgggccccccctcgagccactgcagtggtaaaggtctctccccagtgggcgtgggggcgccgcatggaagccatggacgtcaagtacaagcccgtcatgttccccaacggcgccggcctcaagaagccgaagccggcggcggccgtggcgctggccggggagccgctgtaccgggagtgcctcaagaaccacgccgcgagcctgggcgggcacgccgtcgacggttgcggcgagttcatgccctcgccgggggccaaccccgccgacccgacgtcgctcaagtgcgcggcgtgcgggtgccaccgcaacttccaccgccggacgctggagggttcccctccgccgcccgcgcccgcgccgctggcgctcccgcctccgccgagcgtgatgcacggccagccgcaccgcgcccgggaggagacgcccgaggaccgccacccgggggtcgtcgacgccgacgactccgattcggactcggaaggctcggagtacgacgaggagcggtcggtgtccccgccgccggcggcgcaccacctggtgccggcgccggtggcgcaacagccccccggcacggtcttacttccggagggggcggcacatggtgctctcgctagggtccggggggcccggggccgcggggggggtatccccgggggca

SEQ ID NO: 49536 - protein, 198 aa, Zea mays
  misc_feature: Ceres CLONE 1460549-F
  misc_feature (31)..(92): Pfam Name: ZF-HD_dimer Pfam Description: ZF-HD protein dimerisation region
MEAMDVKYKPVMFPNGAGLKKPKPAAAVALAGEPLYRECLKNHAASLGGHAVDGCGEFMPSPGANPADPTSLKCAACGCHRNFHRRTLEGSPPPPAPAPLALPPPPSVMHGQPHRAREETPEDRHPGVVDADDSDSDSEGSEYDEERSVSPPPAAHHLVPAPVAQQPPGTVLLPEGAAHGALARVRGARGRGGGIPGG

SEQ ID NO: 49537 - DNA, 482 bp, Zea mays
  misc_feature: Ceres CLONE 1460558-F
  misc_feature: Encodes the peptide sequence at SEQ ID NO. 49538
  misc_feature (215)..(215): n is a, c, t, g, unknown, or other
ggagctccccgcggtgggcggccgctctagaactagtggatcccccgggctgcaggattcgcacgagaccattacctagaacatcctaatcgaaaaatcaaccatattattgagaccaacaagcaacatagaaagtggaatccagtagcaacaatagagcacaatggcgaccaagatattttccctccttatgctccttgctctttctacatgtngtgctaacgcgacaattttccctcaatgctcacaagctcctatagcttccctttctcccccataactttcatcaattatagcttcaataatgggaaaaaccccgctctttcaaaccatatagggcttcaaacaaggcaattcgccgcaagaaaaattccttttttcgcccctgttttgtttaaaaattgccccgccccttttttttttggggggggcccctttggggaaaaaaaaccctgggggggaaaaaaaaggtgttgcgaaaa

SEQ ID NO: 49538 - protein, 38 aa, Zea mays
  misc_feature: Ceres CLONE 1460558-F
  misc_feature (18)..(18): Xaa is any aa, unknown, or other
MATKIFSLLMLLALSTCXANATIFPQCSQAPIASLSPP

SEQ ID NO: 49539 - DNA, 673 bp, Zea mays
  misc_feature: Ceres CLONE 1460567-F
  misc_feature: Encodes the peptide sequence at SEQ ID NO. 49540
tggagctccccgcggtggcggccgctctagaactagtggatcccccgggctgcaggaattcgcacgagaccattacctagaacatcctaatcgaaaatctgcccctccatgcatcttcctagtcctagccgcagctcctcatcttcctgcgcgcgctccttctctgtctcccatggccgagcgtcctccctgctcctctctcctttatctccctctccatgccggcgcttccctagctcgttttcccatctccctgctccttcccatggtgcgcagggcgtcctcccctcgactccctccctagctccccaccgctcgccttcctctccttcctagtcgcccgtctccagctcggtctgcactcgccgtccctgcccctcgctgtttttgtgccagccgagctcgcccagcccctcgcctctccacctcatcaacgccctcagccatggatgtcgaatcccctctctttagtgcctttctttgcagcccctgcgtcgccgtgcatgtaaggtgtttgtctaaatgctcaagaggagtgtcgtatcgtggacagcccttttggcgtcgtcgggtgtttgatgttttgcgcatcccgtctacgacaccgtcgaccctcagtgatatttcgttcttgctttgtcgttttatcgatcgacgtctatttgctaatgtg

SEQ ID NO: 49540 - protein, 76 aa, Zea mays
  misc_feature: Ceres CLONE 1460567-F
MDVESPLFSAFLCSPCVAVHVRCLSKCSRGVSYRGQPFWRRRVFDVLRIPSTTPSTLSDISFLLCRFIDRRLFANV

SEQ ID NO: 49541 - DNA, 669 bp, Zea mays
  misc_feature: Ceres CLONE 1460570-F
  misc_feature (641)..(641): n is a, c, t, g, unknown, or other
cgattgggtaccgggccccccctcgagccactgcagtggtaaagataggtcaatccataattccactcagagtgacgacaaaggaagtcagcctcagaggtcgcaatacacctcacattcttcggggcaatagcaaagctctttcaggccaccagctccaagggcagaggcgccaggggcttcgggggaaagatttggagatcagcctagaaatatctactgcttattctgtggtgaggacaagggccatactacaagaatgtgacaaatcaccattcagaagcaaaaggagatagcagaagccaaagcccggcagaaccagccgaagcaggtcttgcacactgcttcgtgccactctccctacataccaaaatatgtgggcaatcatcccacagcttctgctgcttcggctagccactcacaggcttcctggccacaactcccacccctaccaccactacagtcgacctactctcaaagccagccagaagggcgtcagtatcctcaatagcaacgtgaagtaagggaggaatccgaagctcgcacagtcaatagtactgtgccagattcaaagcacatttattaagcaatatcctacccctgaagtacttttatgttctatgtcatttttgtttttcaanaaggaacaaacaatgcagaactgggttt

SEQ ID NO: 49542 - DNA, 563 bp, Zea mays
  misc_feature: Ceres CLONE 1460571-F
  misc_feature: Encodes the peptide sequence at SEQ ID NO. 49543
  misc_feature (183)..(183): n is a, c, t, g, unknown, or other
  misc_feature (184)..(184): n is a, c, t, g, unknown, or other
  misc_feature (290)..(290): n is a, c, t, g, unknown, or other
ggagctccccgcggtggcggccgctctagaactagtggatcccccgggctgcaggaattcgcacgagaccattacctagaacatcctaatcgaaaaacacgacacaacaagtacccaaccactccttgattcccctttcctccactctcgcattcgtctccaccagccggtcggacttcttgnncgctccaagaactcggcgaggatgaatgttttttgcagcttctcagtgatcagtatcacgcagaccttttcggacacccggatgttgagaaatgcccattcctgangaaatatcatggagctacaacttttccctcgctttctgctttgcagtagctcaaaaagaggcaacccaccatcccctgaaggatttcaccgatgagtggttggaaatgggccagggccacttgggcgggtcttacggggaaatgaaggggggtttgcccccccttgcccaggccttaaaccccccactgggataaaacttaaatgccccccccggtggggttttggtttccaaaatgccctttggccaaatggggtttgggaaacccccccac

SEQ ID NO: 49543 - protein, 69 aa, Zea mays
  misc_feature: Ceres CLONE 1460571-F
  misc_feature (5)..(5): Xaa is any aa, unknown, or other
MPIPXEISWSYNFSLAFCFAVAQKEATHHPLKDFTDEWLEMGQGHLGGSYGEMKGGLPPLAQALNPPLG

SEQ ID NO: 49544 - DNA, 891 bp, Zea mays
  misc_feature: Ceres CLONE 1460578-F
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (433)..(433): n is a, c, t, g, unknown, or other
cgtaattctccccgcccctctctccccgcgtggttnnncttttnnnntncaaagtggagctcaccgcggtggcggccgctctatactagtggatcccccgggctgcaggaattcgcacgagaccattacctagaacatcctaatcgaaaaaaaaaatatttccgataggtctgcggtctgcttggggctgcggtgccccttgattcatccccggatcgccttcgccggcggggtgggaacagccagctcgcgctcgccggaggtgtcagggaacagctaggccggtgtcggttgcgctttctcctctcaggattggagccactgggtcctgaagtgcgcggactgttgcatcgcgaagagacttctccatgcgcgactggatttgtgttatagtcggtggaccacaacgagtggtaggacgcgtttgatttantttcttgggaaccggaaccgccttggcttcatgatttcgtttattcccgcggttgtttcgatggtgcggctctttgttgcaccatatagacattgttgttttttaggaccttttgcccggagttaggaagattgccgcccccacaggctggaaggcccccgttttggtgggttgtttgtggcttaaccttctttctcttcgcccgcgccttagaactttcaccctttttaaggttcttttcttggccatggatatcatttgtggggtgttcttttggcccaaattgagttccccaaaaactgcccttggattgctattcggttcgtttggatgcgcggtgtttgttgtgtcctcgcgaattctcctttcccacctcaacaatttgcgctgcgcccaccattcccatgttgtgtagctcctattagcagacgattgaaggggtctcgggggagttgttt

SEQ ID NO: 49545 - DNA, 694 bp, Zea mays
  misc_feature: Ceres CLONE 1460587-F
  misc_feature: Encodes the peptide sequence at SEQ ID NO. 49546
  misc_feature (475)..(475): n is a, c, t, g, unknown, or other
  misc_feature (495)..(495): n is a, c, t, g, unknown, or other
  misc_feature (497)..(497): n is a, c, t, g, unknown, or other
  misc_feature (498)..(498): n is a, c, t, g, unknown, or other
  misc_feature (503)..(503): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
ctccccgcggtggcggccgctctagaactagtggatcccccgggctgcaggaattcgcacgagaccattacctagaacatcctaatcgaaaaagctctcactcactcactcacaagtcacacagccacacttgaaccactgcccgcagcggagggagcttgcacgggccaacgcacacataacacaagctcgtcgtcgatggcgcggtgggctgcggtgctggcgctggccgcggccacggccatcgccgtggcgtccgtggcgggcggcgacatgagcgcggacaagacggagtgcgcggaccagctggtgggcctggcgccgtgcctgcagtacgtgcaggggcaggcccgcgcgccgccgcccgactgctgcggcggcctgcgccaggtgctggggaagagccccaagtgcctgtgcgtgctcgtcaaggacaaggacgaccccaacctgggcatcaagatcaaacgcaccntcgcgctcgcgctccccaangnnctgcngcgccacccgcgccaacgtctcccactgcgctcagctcctgcatattcccccggggctccaaagacgccgccgttctcagccccggnnngggaaaaagggctccactgcccgctccagccaaggaaaactcgacgggggaaaacggaatccccggcggctggaagggaacaaccggaaccgggggttcccc

SEQ ID NO: 49546 - protein, 165 aa, Zea mays
  misc_feature: Ceres CLONE 1460587-F
  misc_feature (33)..(108): Pfam Name: Tryp_alpha_amyl Pfam Description: Protease inhibitor/seed storage/LTP family
  misc_feature (93)..(93): Xaa is any aa, unknown, or other
  misc_feature (99)..(99): Xaa is any aa, unknown, or other
  misc_feature (100)..(100): Xaa is any aa, unknown, or other
  misc_feature (102)..(102): Xaa is any aa, unknown, or other
  misc_feature (131)..(131): Xaa is any aa, unknown, or other
  misc_feature (132)..(132): Xaa is any aa, unknown, or other
MARWAAVLALAAATAIAVASVAGGDMSADKTECADQLVGLAPCLQYVQGQARAPPPDCCGGLRQVLGKSPKCLCVLVKDKDDPNLGIKIKRTXALALPXXLXRHPRQRLPLRSAPAYSPGAPKTPPFSAPXXEKGLHCPLQPRKTRRGKTESPAAGREQPEPGVP

SEQ ID NO: 49547 - DNA, 560 bp, Zea mays
  misc_feature: Ceres CLONE 1460589-F
  misc_feature (79)..(79): n is a, c, t, g, unknown, or other
  misc_feature (90)..(90): n is a, c, t, g, unknown, or other
  misc_feature (91)..(91): n is a, c, t, g, unknown, or other
  misc_feature (106)..(106): n is a, c, t, g, unknown, or other
  misc_feature (196)..(196): n is a, c, t, g, unknown, or other
  misc_feature (215)..(215): n is a, c, t, g, unknown, or other
  misc_feature (216)..(216): n is a, c, t, g, unknown, or other
  misc_feature (388)..(388): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
ggagctccccgcggtggcggccgctctagaactagtggatcccccgggctgcaggatattcgcacgagaccattacctnagaacatactnnaatcgaaaaaccggntccccgtctcaccgcactgccttgccccctactctgcctcgcttagcttagccgccgctgctacgcactctcgccgtccttgttcccgcngtcgctctggctcgcgatnnggcgtcccgcgttgcagtgctgctcgtgggcccgtggcggcccgttgctgttcgccgcgcgtcggcgcagaaaatggacctggggggtggcgcccgcggcggggcccccaaacggggggcgggaaacggggggccccgggggtccgtccctggcccgggggtttggtcttgnccctctttttttatatcccccggtgggccggggggggggccccccttgggagaaaaaaaaaggcgccccccccccccccccaaacagtggggggggacaaatcctccctgtgttcccgggggggtannnnnggggggaaaaaaacccccctcttttttttttttttattttt

SEQ ID NO: 49548 - DNA, 656 bp, Zea mays
  misc_feature: Ceres CLONE 1460595-F
  misc_feature: Encodes the peptide sequence at SEQ ID NO. 49549
  misc_feature (656)..(656): n is a, c, t, g, unknown, or other
cgggccccccctcgagccctgcagtggtaaaggacgcgcccccccccccccaaggccccaaccttccaggaaaaaaaacccggaatccgcacccatccatggccgccgccgccctgctgcgccgctcgccggcggcgcgcgcgctcctctctccggcgctctcgtcccgcctcgtcgcgtccaagccccactcctcctcccccacgcagccgccccccgaggcaaagggcgcctccagcacgaagaccttctcgatctaccggtgggacccggactcgccgtcgaccaagccgcacctcagggactaccaggtggacctgtccgactgcgggccgatggtgctggacgcgctgctcaagatcaagaacgagcaggacccgtcgctcaccttccgccgcagctgccgcgagggcatctgcgggagctgcgccatgaacatcgacggggacaacggcctcgcctgcctcaccaagatctcctccgcctcctcggcgtccaccgtctcgccgctgccccacatgttcgtcatcaaggacctggtggtcgacatgaccaacttctacaaccagtacaagagcgtcgagccgtggctcaagcgcaaggacccgccgccgcagctaggcaaggaggtcccgcagaacaaggccgaccgcgcn

SEQ ID NO: 49549 - protein, 186 aa, Zea mays
  misc_feature: Ceres CLONE 1460595-F
  misc_feature (63)..(128): Pfam Name: Fer2 Pfam Description: 2Fe-2S iron-sulfur cluster binding domain
  misc_feature: SWISSPROT Homolog: EC 1.3.5.1 Succinate dehydrogenase (ubiquinone)
MAAAALLRRSPAARALLSPALSSRLVASKPHSSSPTQPPPEAKGASSTKTFSIYRWDPDSPSTKPHLRDYQVDLSDCGPMVLDALLKIKNEQDPSLTFRRSCREGICGSCAMNIDGDNGLACLTKISSASSASTVSPLPHMFVIKDLVVDMTNFYNQYKSVEPWLKRKDPPPQLGKEVPQNKADRA

SEQ ID NO: 49550 - DNA, 715 bp, Zea mays
  misc_feature: Ceres CLONE 1460601-F
aagctggagctccccgcggtggcggccgctctataactagtggatcccccgggctgcaggaattcgcacgagaccattacctagaacatcctaatcgaaaaacctacgcagtttgaggttgaatcgctctgtttcagttgacacactctcgaagatactatagcgaaccccacatttggaagacttggggacaggtaatttgacagatgagttccaagctgagtcctttgtcagacttactagtggtctggagaaatgcaaaaggctgaggaatttgtctggattttgggatgcttctcctatctttgttccgtttatctatccactctgtcatcaactaactggcctaaacttgagctatactcccacactggattattctgatctgactaagatgatcagccgctgtgtgaaactcccgcgtctttgggggagttctcttctctttgctttgggcttgtcatttttgtacggcgagagcaaaccaagtaaatgattttgagcctccacaggtactggactgcatttcacacaagggtttgcaggtgcgggcctctagttgcaaggatctaccagaactcacggtgtttccatcagaatttaacgttgctggtgctttttccgggactgaagagggacttgttgcaaaatcatcaggctgcgcaaaactggagctctttgcgcggagttctgtcaccttatgaccaccgtaccg

SEQ ID NO: 49551 - DNA, 658 bp, Zea mays
  misc_feature: Ceres CLONE 1460605-F
  misc_feature: Encodes the peptide sequence at SEQ ID NO. 49552
cgggccccccctcgagccctgcagtggtaaagggtgcgaggacgcgtcctattcttcttccctccccgacctttccccgacttctcctccctccttcaaatccgatcacaccgcaaggccggaatcatgcgcaactccaccgccgcccagccttctactccctcatccgcccccgatacgtccgggtcaggccccgcttacgtggagccggcctcttccacccccgacggcggcagatacacctacccggcgccggcctcctccgggggcagagccggctacacaaggatcgcgacctacaccgagccgccgttcggcgtaacccgccaccacccctcccacgccggaggtctccaccaacgccccggtccaggaccacacggcgccaccgtccccgctggccaaggcgtgcgagctcgtcgcgcggctccgcgagcatggcacaagctctgatgagcggtgcgccggctctgtaccgaggtcttccgcgcagaggacttctccaggccgccgtcgatcgaggaggcgctctgcctggatgcatctgacgccgcctacttccgcgcctactacgcgctggccgtgctcgacgccgtggcagactcgctgctctggcaccccggcacgctggtctcgctcgacctcctgtgagccaacg

SEQ ID NO: 49552 - protein, 108 aa, Zea mays
  misc_feature: Ceres CLONE 1460605-F
MRNSTAAQPSTPSSAPDTSGSGPAYVEPASSTPDGGRYTYPAPASSGGRAGYTRIATYTEPPFGVTRHHPSHAGGLHQRPGPGPHGATVPAGQGVRARRAAPRAWHKL

SEQ ID NO: 49553 - DNA, 698 bp, Zea mays
  misc_feature: Ceres CLONE 1460607-F
  misc_feature: Encodes the peptide sequence at SEQ ID NO. 49554
  misc_feature (698)..(698): n is a, c, t, g, unknown, or other
tcccccgggctgcaggatttcgcacgagaccattacctagaacatcctaatcgaaaaccttccaccacgcagtccctcccgggccgccgccgccgccgcctccgcgaaaaaccctagcaggcttcgccgctatcactccacggggcgcgaccatggtggccacacacaacaccaacaaatccacggacaacatcaataacaagctgcagcttgttatgaagagtggaaagtacactctcggctatgagaccgccctcaggactctcacgaactctaagtcgaagctagcgatcatcgcccaaaactagccgcccccttcgtaagtccgaaaatgaagaccaacgctatgcccggcaaaggcccctggcccccccctccctgggaaccaacgtccaccttggaaattggccggttggaaaatatcttctggggccgcccgccccctgccctccacggaccctgtgtggttctggaaacctctctaaaacccctcccggtgcgaattcttatttaagcccccctggcacatagggggaaactccccccgcatttgttcccccctgtgccttggtaaaaccccgtattttcccccccctcttatattgaagccctttctcaacacacggacctttggattcaccccttcctccttccgcggggtgctattttcccccttaaccacccgcctctttttcttn

SEQ ID NO: 49554 - protein, 51 aa, Zea mays
  misc_feature: Ceres CLONE 1460607-F
MVATHNTNKSTDNINNKLQLVMKSGKYTLGYETALRTLTNSKSKLAIIAQN

SEQ ID NO: 49555 - DNA, 685 bp, Zea mays
  misc_feature: Ceres CLONE 1460608-F
  misc_feature: Encodes the peptide sequence at SEQ ID NO. 49556
atagctggagctccccgcggtggcggccgctctataactagtggatcccccgggctgcaggaattcgcacgagaccattacctagaacatcctaatcgaaaaactgtaggccgctgctgctcctctcctcccatctcaccacacaccgcagccccagcaagatcgcgcggaggccatggcgaagcccaagccttcctccgccggcgccaagccgaccgcggctgcgccaccggttacagtgcactcggcgctggtcacctacacctccatgctcgcgctcctctccctctgcccgcccttcgtcatcctcctgtggtacacgatggtgcacgcggacggatcggtggtgcggacttacgagcacctcagggatcacggcgtgctcgaggggctcaaggccatctggcccatgcccaccctcgtcgcgtggaagatcatcttcggcttcgggctcttcgaggccgtcctacagctgctgctccctgggaagcgcttcgaaaggcccatctcgcctgccgggaacgtgccggtctacaaggcaaatggcttacaagcatatgcagggaccttgataacttacctttggtttgtggtggttcggtatatttaaccccgcattagtggatgatcacttggggggagaaatactccggctcttggtttttgcacccctcatggtcctgga

SEQ ID NO: 49556 - protein, 144 aa, Zea mays
  misc_feature: Ceres CLONE 1460608-F
  misc_feature: SWISSPROT Homolog: EC 1.3.1.21 7-dehydrocholesterol reductase
MAKPKPSSAGAKPTAAAPPVTVHSALVTYTSMLALLSLCPPFVILLWYTMVHADGSVVRTYEHLRDHGVLEGLKAIWPMPTLVAWKIIFGFGLFEAVLQLLLPGKRFERPISPAGNVPVYKANGLQAYAGTLITYLWFVVVRYI

SEQ ID NO: 49557 - DNA, 643 bp, Zea mays
  misc_feature: Ceres CLONE 1460616-F
  misc_feature: Translation starting site: 117
  misc_feature (342)..(342): n is a, c, t, g, unknown, or other
  misc_feature (546)..(546): n is a, c, t, g, unknown, or other
  misc_feature (595)..(595): n is a, c, t, g, unknown, or other
tcgagccctgcagtggtaaagggtccgcccccgtgacgcgagcgtcgccagggagccgaaagtaagcctcagttccgccggcgtgcgaggggttcgatctgggttagcctctcacgatgccgccagcccccaagtccggcgacgccctcttcgccagcgtggatcgcgtcaatgcggagctgttcacgctcacgtacggcgccatagagcggcagctgctcacggatctggaggaggtcgaggaggtcaacaagcagctcaatcaaatgggttacaacattggaacacgattggtcgatgagttcttagcacactcaaatgtatcaaggtgtgttgacttcnaggagactgccgatgttattgcgaagcttggcttcaaaatgttcttgcatgtgactgcaactgtgaccaattgggatgatgagggaacaagttgcagtattgtcctcgagaacaacctcttggtgattttgttgagctccctgacacttgccaaagccttcagtattgcactttgttaggcgaagttattagggtggcattggnaatcgtgtctatgaagacgggagtgacatgggtactagacatgcttcgncggggataatgcctatgagatgcgggtgaaaacgattcagtcagtccc

SEQ ID NO: 49558 - DNA, 669 bp, Zea mays
  misc_feature: Ceres CLONE 1460623-F
  misc_feature: Encodes the peptide sequence at SEQ ID NO. 49559
gctcttaactagtggatcccccgggctgcaggaattcgcacgagaccattacctagaacatcctagtcgaaaaatccagaggcacccccgagtttgttggcgatgttgcccgcgggaggaagccggctcgtcgcccccggactccggcggctcctcggcccgggggccggggagagggctgcgccggggctggcggcggcgggggcgggggcgagggcgtaccacaagcgggtggtggacctctacaacaacccgcggaacgtcgggtctttcgacaaggacgaccccaacgtcggctccgggctggtcggcgcgccggtctgcggcgacgtcatgaagcttcgtatccgcgtcgacgaaggcaccgggaagatcgtcgacgcctgcttcaggaccttcggctgcggatctggaatcgcctcgtcctccgtcgctactgaatgggtgaagggaaagcaaatggaggaagtagtgagtatcaagaacactgagattgtaaagcacttgtcacttccaccagtaaagctccattgcaggatgcttgctgaagatgcaataaaagctgccggtgaaaattatgattccaaatagagcttagctgggggacaccccttgcaaagaaggccgcccaaaccatggagcaggatatatgccttctggttctaagga

SEQ ID NO: 49559 - protein, 162 aa, Zea mays
  misc_feature: Ceres CLONE 1460623-F
  misc_feature (39)..(163): Pfam Name: NifU_N Pfam Description: NifU-like N terminal domain
MLPAGGSRLVAPGLRRLLGPGAGERAAPGLAAAGAGARAYHKRVVDLYNNPRNVGSFDKDDPNVGSGLVGAPVCGDVMKLRIRVDEGTGKIVDACFRTFGCGSGIASSSVATEWVKGKQMEEVVSIKNTEIVKHLSLPPVKLHCRMLAEDAIKAAGENYDSK

SEQ ID NO: 49560 - DNA, 699 bp, Zea mays
  misc_feature: Ceres CLONE 1460631-F
  misc_feature: Encodes the peptide sequence at SEQ ID NO. 49561
  misc_feature (343)..(343): n is a, c, t, g, unknown, or other
  misc_feature (346)..(346): n is a, c, t, g, unknown, or other
gggccccccctcgagccctgcagtggtaaaggtcgtcgtcgtcggtggcgctgcctcggccgcgatcgcgggtgcccgcaccgctcgtgcccgtgacgacgcggcggggggcgccgtcggtgcgcctgcgcgcggcgggcgcggacacgcctccccgcggcggcctgcagctccagcggcgggaggaggacgaggggctgccggggaccgtgttgggccgaggggaggacgatgaggtgtcggagaaggtcggggaggagaaggtggagaggtggatgcgggactcgatcgcggagatcgtgcggcacgtcggggaggcgccgttcctggtgcacctgttcancancggcaagggccagcgcgtgacggtgcggcgggagcccgcggccccggaaagctggccggacgtgcggccgcccgtgggggccaggcggggcccggaggccggaccggatcatcctggtcgagcaggtggccctcgaacggcggcggggccctccgcccccctccgaggcggggccgacaggtggggggggcttggggggtgccaggcggcccggccattggaaccgcgcggccctggttaccgggcttttcccacctggcccgcgggggcgcttcgttccgggccggggtttcccggacagcccactttttgtgccctcccgtgggaggcgccaagtggctttctcggctaaa

SEQ ID NO: 49561 - protein, 140 aa, Zea mays
  misc_feature: Ceres CLONE 1460631-F
  misc_feature (23)..(23): Xaa is any aa, unknown, or other
  misc_feature (24)..(24): Xaa is any aa, unknown, or other
MRDSIAEIVRHVGEAPFLVHLFXXGKGQRVTVRREPAAPESWPDVRPPVGARRGPEAGPDHPGRAGGPRTAAGPSAPLRGGADRWGGLGGCQAARPLEPRGPGYRAFPTWPAGALRSGPGFPGQPTFCALPWEAPSGFLG

SEQ ID NO: 49562 - DNA, 718 bp, Zea mays
  misc_feature: Ceres CLONE 1460639-F
  misc_feature: Encodes the peptide sequence at SEQ ID NO. 49563
  misc_feature (367)..(367): n is a, c, t, g, unknown, or other
tggagctccccgcggtggcggccgctctagaactagtggatcccccgggctgcaggaattcgcacgagaccattacctagaacatcctaatcgaaaacgagggcggaagctgtccagatcgcgtgattccgcatcccgttcgcgagcgcgacacacgctgacagctcacggctgaccttcccgacggcctccagctccatcttgattcttgaggcgaagccccggtgcgtaagagtctgccatggccagcgagaataaggtctttgggttcgaggaagtcgccaagcacaacgtcaccaaggactgctggatcatcatcgccggcaaggtgtatgacgtcactccgtttatggatgagcatcctggntggagacgagtttttgctaactgtaaccgggaaaaatgctacacctgatttcaaaaattttggcaccgtgaatcccccagggaactggtggaaaaattcccctttcgggcaaaataaaggcttccaaatccccaaaaaaaggggcccattggccccccccaaaaggcccccccccctggaaaaaaagggaatagacccccccccacaaaaaccccaacattcccttgggccccattataaaaccgggcgccctgtttttgggtttcggggcctcccccccaacccgagggtgtccccttttttttaaaacgtttcctttttggaccccccccttatggagaaaggtgccca

SEQ ID NO: 49563 - protein, 57 aa, Zea mays
  misc_feature: Ceres CLONE 1460639-F
  misc_feature (8)..(42): SWISSPROT Homolog: EC 1.7.1.1 Nitrate reductase (NADH)
  misc_feature (12)..(46): SWISSPROT Homolog: EC 1.1.2.3 L-lactate dehydrogenase (cytochrome)
MASENKVFGFEEVAKHNVTKDCWIIIAGKVYDVTPFMDEHPGWRRVFANCNREKCYT

SEQ ID NO: 49564 - DNA, 683 bp, Zea mays
  misc_feature: Ceres CLONE 1460640-F
  misc_feature: Encodes the peptide sequence at SEQ ID NO. 49565
  misc_feature (683)..(683): n is a, c, t, g, unknown, or other
ctccccgcggtggcggccgctctagaactagtggatcccccgggctgcaggaattcgcacgagaccattacctagaacatcctaatcgaaaactctctcttctctctctaccgccccaggccccccgatctcctcctcccactccgatcgcccgaccgatcgccgagcttccctgttccctccccgcccccgcgacgccatggagccgccgcacgccgagcaggccgtcgccgtcgcacgctgagcaggccgtcgccgctgtagcagcaggaggagagggtggcactgcaagcccgggcaccggcctcgaaggtgctgtctgcttaacgttttttgtttcgttcagatctatggccggacgaggcggactgtggctactacctccgcacgacgctgcgacgggcgctcctcagatcggcagagacctctttcgaacgcaagccgggagattcggaatcccgcgcgcgagttgggcctggccagcagataatcgaattgctttgccgtggaaacaggagaaggaagaatgcaaaacacgtagtgagttcagttgtgacacaagcaccaaactttgatgggtatcagtggagaaagctgcaattgagtatattcattctttatcaagggcacagcctgctcgttctctcaatggtgctggcctttgtcctgctagtagatcactn

SEQ ID NO: 49565 - protein, 74 aa, Zea mays
  misc_feature: Ceres CLONE 1460640-F
MAGRGGLWLLPPHDAATGAPQIGRDLFRTQAGRFGIPRASWAWPADNRIALPWKQEKEECKTRSEFSCDTSTKL

SEQ ID NO: 49566 - DNA, 1006 bp, Zea mays
  misc_feature: Ceres CLONE 1460643
  misc_feature: Encodes the peptide sequence at SEQ ID NO. 49567
caacaaccagatccagccccccggaaacctaagctcccgcaaacaaataccctcttcccattctgcccctcccccgcgcagcatgccatcccgccccacgaccacagccccgccgccgccgccgcccacgaccaccacgtggggagcgagagagccatgtccttccttgacccgctcgcctcgctcggcctcgggtacgcgatcgccatcgcgttcggattcctcgtgctcctcgcgtcggtgctgctcgcctcctacttctgcctccgccgcggggccgccagccaggggttcggcaccggagccggcgtcggcgtcggctccaccaggcacgccgcctcctccgcctccagctccggccacatctccatcaccgtgccccgcgtcgtcttcgtcgcggaggactacgactcgcctgggtcctcctcccgcggccccgccgccgcggcctcccccgtcgggctcgacgcctccgtcatcgcgtcgtatccgatggtgcccttctccaaggccggggcgggggcggacacggaggtcgcgtgctccatctgcctctgcgagtacaaggagggcgagatgctgcgggtgatgccagagtgcaggcacaggttccacctcacgtgcctcgacgcgtggctgcgtcgtagcgcgtcgtgccccgtctgccgttcgtcgcccatcccgacccccgtcgccacgccgctctctaccccactctcggagcttgtcccgctgtcgcagtatgccgccgaccgtcgccggagcaggtttgggtgattaatgggtgatggagatgtgaactgttcggctagagctaccataactaggacaaaagtttttgcttgacagcggtacattattggacccaggaggaagacatgcagtgtacatacattgttcttctgttctaagatagtgtctatcaagtgaggttacctgtgatcttatagttgtacgtggaagattgttctatgaatcatcttatttcaccaaaaaaaaaaaaaaa

SEQ ID NO: 49567 - protein, 206 aa, Zea mays
  misc_feature: Ceres CLONE 1460643
  misc_feature (129)..(170): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: The sequence is a functional homolog of SEQ ID NO 384 in the 10/666,642 US patent application
MSFLDPLASLGLGYAIAIAFGFLVLLASVLLASYFCLRRGAASQGFGTGAGVGVGSTRHAASSASSSGHISITVPRVVFVAEDYDSPGSSSRGPAAAASPVGLDASVIASYPMVPFSKAGAGADTEVACSICLCEYKEGEMLRVMPECRHRFHLTCLDAWLRRSASCPVCRSSPIPTPVATPLSTPLSELVPLSQYAADRRRSRFG

SEQ ID NO: 49568 - DNA, 709 bp, Zea mays
  misc_feature: Ceres CLONE 1460647-F
  misc_feature: Encodes the peptide sequence at SEQ ID NO. 49569
aagctggagctccccgcggtggcggccgctctagaactagtggatcccccgggctgcaggaattcgcacgagaccattatctagaacatcctaatcgaaaaacatacactgtcttgctagacacacccgaaaaacaaagggaaaaaatagtaaagaaacggagcgaggctcctcctcgtttcctatctatcctgatccaaatccgccctactcgcttcatatatcctcctgcgaggaaaacaattcattccgcgccgcatctgggaaggtctcgtcttgctcgcctccgtccgtcgccgcaccctgcgtcgtcgccatggccaccgacgaagccaccaagccgtccccgatcccaccctatcccgagatgatcctggcggcgatcgagggtctagacgacaagagcgggtcgaacaagtccgccatctccaagtacatcgagggcaagtacggttcgctgccccccgcgcacgcgtcgctgctgaccgcgcacctggcgcgcatgaaggagtccggagagctcgtcttcctcaagaacaactacttccgcgcgggcaacaaaaatttgattccaactccgtcatgaaataataataacgaggttgcaccgctttgaatgcttgctcggaaacatcgactgtatctcagggttcgcataattagattttaatgaatatcacggggaacacgttttatcgaaaaaaaaaaa

SEQ ID NO: 49569 - protein, 89 aa, Zea mays
  misc_feature: Ceres CLONE 1460647-F
  misc_feature (13)..(81): Pfam Name: Linker_histone Pfam Description: linker histone H1 and H5 family
  misc_feature: The sequence is a functional homolog of SEQ ID NO 2902 in the 10/374,780 US patent application
  misc_feature: The sequence is a functional homolog of SEQ ID NO 496 in the 10/225,066 US patent application
  misc_feature: The sequence is a functional homolog of SEQ ID NO 60 in the 10/669,824 US patent application
  misc_feature: The sequence is a functional homolog of SEQ ID NO 60 in the 10/870,198 US patent application
  misc_feature: The sequence is a functional homolog of SEQ ID NO 1741 in the 11/479,226 US patent application
  misc_feature: The sequence is a functional homolog of SEQ ID NO 2594 in the 10/374,780 US patent application
  misc_feature: The sequence is a functional homolog of SEQ ID NO 58 in the 10/669,824 US patent application
  misc_feature: The sequence is a functional homolog of SEQ ID NO 58 in the 10/870,198 US patent application
  misc_feature: The sequence is a functional homolog of SEQ ID NO 66 in the 10/225,066 US patent application
MATDEATKPSPIPPYPEMILAAIEGLDDKSGSNKSAISKYIEGKYGSLPPAHASLLTAHLARMKESGELVFLKNNYFRAGNKNLIPTPS

SEQ ID NO: 49570 - DNA, 703 bp, Zea mays
  misc_feature: Ceres CLONE 1460656-F
  misc_feature: Encodes the peptide sequence at SEQ ID NO. 49571
ggagctccccgcggtggcggccgctctagaactagtggatcccccgggctgcaggaattcgcacgagaccattacctagaacatcctaatcgaaaaggagcagggcaggggttgcgtctcagttcctggttgtgttgttgaaagctcccaggtttcttctcttcgcgtgagctacctagactagagtgggatcgcgaggaagaaggatgtcgtgctgcggaggaaactgcgggtgcggcagcggatgcaagtgcggcagcgggtgcggagggtgcaagatgtacccggacatggctgagcaggtgaccaccaccaccaccatcatgggtgttgcaccatccaagggcgggttcgaggcggccgccggagctgagaacggcgggtgcaagtgcggcgccgccagctgcacctgcgacccctgcacctgcaagtgaggatgaccgggtgcagcatgcaggccgtgacgatggaggaagtagatcggaaggacacccttcagtatctctagctaaatcaagctctgagagtatgttgtagcagcgtcgtctgtgtttgccgccatgcgtatctagctagctagtggtggcaaacgaataattgtcctgttcttcctcctcctcggcccctgccagtgttgcgtcgtgtggggccggccggggtgcatggacaacacccgggccatggcccggctgcttatgtaagg

SEQ ID NO: 49571 - protein, 75 aa, Zea mays; identical to SEQ ID NO: 45247
  misc_feature: Ceres CLONE 1460656-F
  misc_feature (1)..(74): Pfam Name: Metallothio_2 Pfam Description: Metallothionein

SEQ ID NO: 49572 - DNA, 708 bp, Zea mays
  misc_feature: Ceres CLONE 1460657-F
  misc_feature: Encodes the peptide sequence at SEQ ID NO. 49573
aaagctggagctccccgcggtggcggccgctctagaactagtggatcccccgggctgcaggaattcgcacgagaccattacctagaacatcctaatcgaaaacccggacgtcaccagctacagctcccagcttgacgtcaatttctggggttccgttcaaacaaccttcgctgccctgcctcacctgaagaggagccgaggaagaatcgtggtgacggcatctgcaaccggatggaacccagttcctagaatgagcatctacaacgctgccaacgctgcgctcatcaacttcttcgagacgctgcggaccgagctagggaaccaggtcgggatcacggtggtgacgcccgggtgggtcgagtccgagatgtccagagggaagttcctcaaggagcacggccaagtggaggtcgatcaaaagatgcgcgacgctcagatcggcctgttcccggtggagtacgccaagaactgcgccaaaggccatggtgcaaggcggcgcggcaagggcaagcgggtacctcacccgggcccggcggtgtttccgggggcaatggtacctggtgggcgggcggtttccccaccggaaggtgggtggaaggccctggctacccgccctcctggttcattgcaccgggccccttgggcccccaggggaaaggtcccaaaccgccgcccaagcaaaggagacactgggccccaaagaggggg

SEQ ID NO: 49573 - protein, 152 aa, Zea mays
  misc_feature: Ceres CLONE 1460657-F
MSIYNAANAALINFFETLRTELGNQVGITVVTPGWVESEMSRGKFLKEHGQVEVDQKMRDAQIGLFPVEYAKNCAKGHGARRRGKGKRVPHPGPAVFPGAMVPGGRAVSPPEGGWKALATRPPGSLHRAPWAPRGKVPNRRPSKGDTGPQRG

SEQ ID NO: 49574 - DNA, 680 bp, Zea mays
  misc_feature: Ceres CLONE 1460660-F
  misc_feature: Encodes the peptide sequence at SEQ ID NO. 49575
ccgcggtggcggccgctctagaactagtggatcccccgggctgcaggaattcgcacgagaccattacctagaacatcctaatcgaaaagatcgcctcgctgtgttgcactgctaggtagccagctcgtttcctcccccaacccaaatgggcgactccaccgccaccaacccctcctcgccgaccgcagccatggatcccgactccgaggtcgtcttcgacttcccgccctacctctgccagtacaagagcggccgcatccaccgccccggcggcgcccccaccgtcccagctggcacggacccagccaccggcgtcgtgtccaaggacatccgcgccggccccgcctccgcgcgagtctacctccctcccggcgcagccggcaagatcccggtggtcgtctacttccacggcggcgggttcgtggtcggctcgccggcgcggccgggcacgcacaactacctcaacgacctggtcgcccgctcgggcgccatcggcgtgtccgtctactaccgcctcgcgccggagcacaagctgcccgcggcgtacgacgacgcgtgggcggcgctacggtgggcggcgacgctcggcggcggcgaggacccgtggctgctggagcacgccgacctgtcccgcgtgttcctggcgggctgcagcgccggcgccaacatcgcgcacaaca

SEQ ID NO: 49575 - protein, 163 aa, Zea mays
  misc_feature: Ceres CLONE 1460660-F
  misc_feature (69)..(163): Pfam Name: Abhydrolase_3 Pfam Description: alpha/beta hydrolase fold
  misc_feature: SWISSPROT Homolog: EC 3.1.1.3 Triacylglycerol lipase
MDPDSEVVFDFPPYLCQYKSGRIHRPGGAPTVPAGTDPATGVVSKDIRAGPASARVYLPPGAAGKIPVVVYFHGGGFVVGSPARPGTHNYLNDLVARSGAIGVSVYYRLAPEHKLPAAYDDAWAALRWAATLGGGEDPWLLEHADLSRVFLAGCSAGANIAHN

SEQ ID NO: 49576 - DNA, 660 bp, Zea mays
  misc_feature: Ceres CLONE 1460664-F
  misc_feature: Translation starting site: 160
ggagctccccgcggtggcggccgctctagaactagtggatcccccgggctgcaggaattcgcacgagaccattacctagaacatcctaatcgaaaatctcgcttcccccagccgcacgaaaccctaacgccgccgccgcttcacaggtaaaccgccgccatggtctcgggttccggcgtatgcacgaagcgcatcgtggtggacgcgcgccaccacatgctgggccgcttgtcgtcgattatcgccaaggaactgctcaatgggcagaaggtggtcgtcgtccgctgcgaggagatctgtatgtccggtgggctcgtacgccagacgatgaagtacctccgctttctccgcatgcggatgaacaccagccatgccatggggccatcccacttcgcgccccgtccaagatcctgtgacgcaccatccgcgggatgattccgcacagaccaaaaagggggaggcggttctgccaagcctcagaagttaaaaggcttccccccccctaaaaaaaaaacaaggggcgtggcttccctgaacctcttaaggccctaagggtggaaccggaaacaaatacggcccccttggggaactttccaagggggcgggaaggaccccctgaccccccttgggaccttgggaaaaaaaaaaggaaaacccccg

SEQ ID NO: 49577 - DNA, 654 bp, Zea mays
  misc_feature: Ceres CLONE 1460668-F
  misc_feature: Encodes the peptide sequence at SEQ ID NO. 49578
  misc_feature (343)..(343): n is a, c, t, g, unknown, or other
  misc_feature (350)..(350): n is a, c, t, g, unknown, or other
  misc_feature (493)..(493): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (568)..(568): n is a, c, t, g, unknown, or other
tggagctccaccgcggtggcggccgctctagaactagtggatcccccgggctgcaggaattcgcacgagaccattacctagaacatcctaatcgaaaaacacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcngacaccngtccggcgggaaaaagggggcaccccccccaacccaattttcccggggagcccttgggaaaaaagggggtttttttttttttttaaaaaaaaaaaaatttcccccctttcaccccaaaaaaaaaatggaaaatggtggggaancctcttccggggggaaaacacaatttgtttgggcccccccaattgggcgcnnnnggttaccctggtcccgtccgnccgaaataaatgggaatggtggtggtggtggcctttcggtttcccaaataaaaaatttgcctaagtaaaaaaaaattaatggggcc

SEQ ID NO: 49578 - protein, 158 aa, Zea mays
  misc_feature: Ceres CLONE 1460668-F
  misc_feature (12)..(75): Pfam Name: potato_inhibit Pfam Description: Potato inhibitor I family
  misc_feature (62)..(62): Xaa is any aa, unknown, or other
  misc_feature (64)..(64): Xaa is any aa, unknown, or other
  misc_feature (112)..(112): Xaa is any aa, unknown, or other
  misc_feature (129)..(129): Xaa is any aa, unknown, or other
  misc_feature (130)..(130): Xaa is any aa, unknown, or other
  misc_feature (137)..(137): Xaa is any aa, unknown, or other
MSSTGGGDDGAKKSWPEVVGLSLEEAKRVILCDKPDADIVVLPVGTPVTMDFRPNRVRIFVXHXSGGKKGAPPPTQFSRGALGKKGGFFFFLKKKKFPPFHPKKKMENGGEXSSGGKTQFVWAPPIGRXXLPWSRPXEINGNGGGGGLSVSQIKNLPK

SEQ ID NO: 49579 - DNA, 597 bp, Zea mays
  misc_feature: Ceres CLONE 1460671-F
  misc_feature: Translation starting site: 250
  misc_feature: SWISSPROT Homolog: EC 1.15.1.1 Superoxide dismutase
gggctgctggaattcgcacgagaccattacctagaacatcctaatcgaaaaatcggtcaatcagtaatcaccccaaatcctagggttctagtcgcttctcgtcgtttcgttcgtagatcacagagacaattgtgaaggcagttgctgtcctcgccggcactgatgtcaagggcaccatcttcttttcacaggaaggggatggtccgaccaccgtgactggaactatctctggcctcaagacaaggctccatgggttccatgtgcacgcgcttggggacaccaccaacggctgcatgtgaactgggccacacttctatcctgttgggaaagaacatggaacaccggaagataaggaccgccatgcccccgatcttggaaatgtgacaccgggagaagatggtgttgttaatgtcaatgttactgacaaccacatacctcttgctggacccccctcgatcattgtaccagctgttgcttgtccatgggtgattccggatgatctttggcaaagggggacatgaatctttataaagagcactgtaaaatgcttggcggaacatgttggcctggtggaatcctttgggtctcctaagttta

SEQ ID NO: 49580 - DNA, 700 bp, Zea mays
  misc_feature: Ceres CLONE 1460680-F
  misc_feature: Encodes the peptide sequence at SEQ ID NO. 49581
  misc_feature (458)..(458): n is a, c, t, g, unknown, or other
  misc_feature (475)..(475): n is a, c, t, g, unknown, or other
  misc_feature (476)..(476): n is a, c, t, g, unknown, or other
aagctggagctccccgcggtggcggccgctctagaactagtggatcccccgggctgcaggaattcgcacgagaccattacctagaacatcctaatcgaaaaataaccctctgttcccacgccccctctgccccactcccaaaatcttgacgcctgacgtccccacaagtgatcagcatgagtaacacagctgaggaaaacactggcggcggcggcagcagcagcaccccgacgcgcgttgtggtagtcgagcgcgtggtgacggtggagtacctggagccgtccatgtcgcgggagctgctgggcaagttcccggacccatccgccttcgacttcgactactcgcagagcggcatctggtcgccgctcaaacaggtcccgcgcggcggcgcgtgcgaaccccgaaacgggcgaaccccaccaactcctcgaccgatttcctcgtcgcccaccccaaancgcagggcgaagggccnnggcgtcggccaaaggactcccccggcggcgggaagtccaaggggaagccccaggggctgcggcaaaaagggtccttcctccgacctcacaaaaaatggaagggccaggtttaaattcccgccccggggcccttcccccgaaaaaaaggggggagaggggggggccccaaggggccccataaaaaaattttaagggcgggaaaggggggcccccggaaaaccccc

SEQ ID NO: 49581 - protein, 163 aa, Zea mays
  misc_feature: Ceres CLONE 1460680-F
  misc_feature (94)..(94): Xaa is any aa, unknown, or other
  misc_feature (100)..(100): Xaa is any aa, unknown, or other
MSNTAEENTGGGGSSSTPTRVVVVERVVTVEYLEPSMSRELLGKFPDPSAFDFDYSQSGIWSPLKQVPRGGACEPRNGRTPPTPRPISSSPTPXRRAKGXGVGQRTPPAAGSPRGSPRGCGKKGPSSDLTKNGRARFKFPPRGPSPEKKGGEGGAPRGPIKKF

SEQ ID NO: 49582 - DNA, 674 bp, Zea mays
  misc_feature: Ceres CLONE 1460683-F
  misc_feature: Encodes the peptide sequence at SEQ ID NO. 49583
  misc_feature (419)..(419): n is a, c, t, g, unknown, or other
  misc_feature (674)..(674): n is a, c, t, g, unknown, or other
cgattgggtaccgggccccccctcgagccctgcagtgggaacggaccccggcgaagcccggtgacgaggttgttacaaatccaattaactcatctgcatgacgaggctactcgtcatcctgttcgccggggcgaccctagtagtcgccaccaccgcgcacgagcaccatggtgaggcgcccacctgcgccggaggcagcgagcacgtgcttgcggagttccgccccggtgaggtgaccgtggacgggcacaacgaggactgggagagcgtggaggcctcggagtccgcgctgctgccggctctagatccagacgatgataaggcctactccggcggtaagatcgccgtaaaggctgtgcatgatggcgtcaacgtcttcttcttgcttcaggttgatggggcttacgcttacactaaangccaaagtaacaaatgcccttctgttgctctgatgttccaagttggagagaaagccccattttacaatatgggaggatgcaaagatatgccaggttcttgcacaagtaaaagttggaaacgtcatgaggttgacattatgcacttctcaattggaaatgctatccccggacaactttacgggtggaattcacatagacaatgcagcctgggaattgaaaacgacagatttggtcccccttgttgatgtccatgcn

SEQ ID NO: 49583 - protein, 188 aa, Zea mays
  misc_feature: Ceres CLONE 1460683-F
  misc_feature (108)..(108): Xaa is any aa, unknown, or other
MTRLLVILFAGATLVVATTAHEHHGEAPTCAGGSEHVLAEFRPGEVTVDGHNEDWESVEASESALLPALDPDDDKAYSGGKIAVKAVHDGVNVFFLLQVDGAYAYTKXQSNKCPSVALMFQVGEKAPFYNMGGCKDMPGSCTSKSWKRHEVDIMHFSIGNAIPGQLYGWNSHRQCSLGIENDRFGPPC

SEQ ID NO: 49584 - DNA, 676 bp, Zea mays
  misc_feature: Ceres CLONE 1460685-F
  misc_feature (103)..(103): n is a, c, t, g, unknown, or other
  misc_feature (110)..(110): n is a, c, t, g, unknown, or other
  misc_feature (115)..(115): n is a, c, t, g, unknown, or other
  misc_feature (146)..(146): n is a, c, t, g, unknown, or other
  misc_feature (147)..(147): n is a, c, t, g, unknown, or other
  misc_feature (640)..(640): n is a, c, t, g, unknown, or other
caattgggtacgagcccccctcgagcactgcagtggtaaggtgtgaccagtgctcgccgtcgtcccctgcctctggccctctgctagccgctaggcgacgggnccttcgncgggncgagggcacaccgcccctgttaccatggcanncgatgaatactgggtagggaaagttttaggtggcaggccaatccatcccccaaccaaatccttttgggaaatgcccttggaaggggcttgaaaacaaaattaatcccaaactggggtaaaaaaaaaaaggggggaaggagatttaaaaaccaaagttccgaaatttttggcaaaaaaaaaaaaaacaaaaaattttttcgaacacccccaaaaaatttttttttttgacaaaacccccttttttgtgggagaaaaaaaaaagaggggggaattttttttctctcttcttttttgggggggggggggggggggaaaaaaaaaaaaataaacccccccccgaggagagaagggggggtgttttaaaaaaaacaccccccccggaaaaaaaaaaataggccgggggggtgggggaacccccctctttggggaggtggggggggccaccaaaaaaaaataaacccgggagagagacctcgtgggggttttttaaaanaaaaaaaacaccccccacccggggaggacccaattt

SEQ ID NO: 49585 - DNA, 596 bp, Zea mays
  misc_feature: Ceres CLONE 1460687-F
  misc_feature: Translation starting site: 140
  misc_feature (131)..(131): n is a, c, t, g, unknown, or other
  misc_feature (160)..(160): n is a, c, t, g, unknown, or other
  misc_feature (292)..(292): n is a, c, t, g, unknown, or other
cgattgggtaccgggccccccctcgagccctgcagtggtaaaggcgacctcgccgccgtcggcgacctcaccaagcccgaccccgccgcgctcggccagctcgtctactccgtccccggcgccaaacacantcctcgagatgccccccatgaccgcgcangtgaacgaggttcaagtggtggggggccttcccgctcgggctggccatgaaacactgcatggtcgacgcatcggcgccatgaagttcgtcactcctgggcggaaacggggcggggggtccccgacttcaccnggccccccgttcctgggacccaaacccttcctgaaaggggcgggaaacccgcccggggccccccttttccccccacacagagttttccccaaaagatcccccaaaattcttccaaaaaaagggggggggcttttttttaggggggccccaaaaaagaaactcctgttttaaacccctttccttttttgttttttaaaaccccaaaaaacagttttgttgaaaacccggtgggggccgggggttttttttcttctcccccccaaaaaaaagaacgccccccgggggggccggccggagggaacca

SEQ ID NO: 49586 - DNA, 651 bp, Zea mays
  misc_feature: Ceres CLONE 1460690-F
  misc_feature: SWISSPROT Homolog: EC 1.2.1.3 Aldehyde dehydrogenase (NAD(+))
  misc_feature (97)..(97): n is a, c, t, g, unknown, or other
  misc_feature (175)..(175): n is a, c, t, g, unknown, or other
cgattgggtacgggcccccctcgagccctgcagtggtaaaggttaggaggcaagtcccctttcatcataatggacgatgctgatgttgaccatgctngtgagcttgcgcactttgccctggtcttttaacaggggacaatgctgctgcgctggatctcgcacgtttgtacatgancgtgttaatgatgaattggtggaaaaagcaaagctccttgcattgaaccccgcccttggggatcctttcagggaaagggtttaaaaggggcccccaggcaactcccgaaagtggaatttaggggggtcttttttttacccctctcctttccccccccgaaaatcccgggggccccccaaaaattgggaaaactcccccccaaaaatggggcgccccccgggggcccttaaaaaaaaattttttttttttcccccccggcggcccatttgcgccccttttttttttaaagagaaggaggaaaaaattttcccccccccccccccccccaaaagcggcccgaaaaaaaaattgggggggggccttccccctccgggggggggggggggggttaaaagggggggcgtcctttttttttttttttctggggggggaggagaaaaaaaaaaaaatttttttttttttctcttaaaaaaaaa

SEQ ID NO: 49587 - DNA, 734 bp, Zea mays
  misc_feature: Ceres CLONE 1460692-F
  misc_feature: Encodes the peptide sequence at SEQ ID NO. 49588
  misc_feature (36)..(36): n is a, c, t, g, unknown, or other
  misc_feature (41)..(41): n is a, c, t, g, unknown, or other
  misc_feature (46)..(46): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
attatttaacctccccctttttaaactaatataaanccccnccccncccnnnnntcgattgggtacgggccccccctcgagccactgcagtgggaaaggccgccccaacgagaagagcggcggcgcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgaaggacacaaggttgaggcagcagctgaggaaacgaaaaaaagcaaccatgtcaccaggaaccttgaaaaacgcaaggaaggaaataccccttgacccacaccattgaaggacaaattctgacagtggaccgggttgctgggaatgcattttccc

SEQ ID NO: 49588 - protein, 167 aa, Zea mays
  misc_feature: Ceres CLONE 1460692-F
  misc_feature (1)..(167): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKTPAAKKDNAEGHKVEAAAEETKKSNHVTRNLEKRKEGNTP

SEQ ID NO: 49589 - DNA, 664 bp, Zea mays
  misc_feature: Ceres CLONE 1460693-F
  misc_feature: SWISSPROT Homolog: EC 4.4.1.14 1-aminocyclopropane-1-carboxylate synthase
cgattgggtacgggcccccctcgagccctgcagtggtaaaggcatacagatgggcctcgccgagaaccaggtgtccttcgacctcctcgaggggtacctcagggaccacccggaggccgcgggctggggcggctccggcgtcgccagcttcagggacaacgcgctgttccaggactaccacggcctcaaggccttcagaaaggcgatggccaacttcatggagaaggttaggggcggcaaggcccggtttgaccccgaccgcatcgtgctcaccgccggcgccacggcagctaacgagctgctcacgttcgtcctggccaacccgggagacgcgctgctgatccctactccttactatcctgggtaagcgctaagaagcatccagcatgctgcatgcatgcacggacccccggcgctatgctactgttacaccgcaacagtgctctacacagacagacagactgacatgctctgcttgcagtttcgacagagacctgcggtggaggacgggggtgaacatcgtgccggtgcactgcgacagcgccaacgggttccaggtcacggccgccgcgctccaggcggcgtacgaggaggccgaagcagcggggacgcgcgtccgagccgtcctgctcaccaacccgtccaacccgctgggcaccaccgg

SEQ ID NO: 49590 - DNA, 643 bp, Zea mays
  misc_feature: Ceres CLONE 1460697-F
  misc_feature: Encodes the peptide sequence at SEQ ID NO. 49591
  misc_feature (585)..(585): n is a, c, t, g, unknown, or other
cgattgggtaccgggccccccctcgagccactgcagtggtaaaggaagctgctctcgtccctagaataaagcagctcctccgcggggcggcgaactactacccatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgatggaggctacttcaatgcaataatgaccttcccccagaactatcccaacagcccgccatcagtaagatttacttctgggatgtggcatccgaatgtttatccggatgggcgtgtttgcatttctattcctcatccacctgatgaagatcccagtgtttatgagcttgcaagcgaacagtggacaccagtgcacacggttgacagtatagttctgagcatcattttcatgctctctagtccgaatgacgagtctccagcaaatattgaaactgccnaggattgaacaaagaagcgggatgagtccagaaccagggttaggcaaggtgtccccag

SEQ ID NO: 49591 - protein, 146 aa, Zea mays
  misc_feature: Ceres CLONE 1460697-F
  misc_feature (11)..(146): Pfam Name: UQ_con Pfam Description: Ubiquitin-conjugating enzyme
  misc_feature: SWISSPROT Homolog: EC 6.3.2.19 Ubiquitin--protein ligase
  misc_feature (145)..(145): Xaa is any aa, unknown, or other
MAGTPSQASLLLQKQLKDLAKNPVDGFSAGLVDDSNVFEWQVTIIGPPDTLYDGGYFNAIMTFPQNYPNSPPSVRFTSGMWHPNVYPDGRVCISIPHPPDEDPSVYELASEQWTPVHTVDSIVLSIIFMLSSPNDESPANIETAXD

SEQ ID NO: 49592 - DNA, 653 bp, Zea mays
  misc_feature: Ceres CLONE 1460704-F
  misc_feature: Encodes the peptide sequence at SEQ ID NO. 49593
  misc_feature (639)..(639): n is a, c, t, g, unknown, or other
cgattgggtaccgggccccccctcgagccactgcagtggtaaagggatcactagcagcgccaccagtcggcactccaccgccattgccaagttgaagctcctcatcacgtacgtggtcttctcatttgcccctcacttaacttacttgactagcttgcaatatgtcggggcatgcacgccaagctccgttcgccctactccgcgccttcctcgtcatcgtctccttccgagctggagcaggtgtttcgtcgacgagaacattgaccatgacgaaccactgcgggtacacggtgtggccaggcatcctgtcgagcgcgggctcgccggcgctggaaaccaccggcttcgccctagagccgggccagtcacggtcgctaccggcgccgcgcgggtggtcggggcgcctgtggggccgcacgcactgctccgccgacgcggcggggaggttcgcctgcgcgacgggcaactgcgggtccggccggctggactgcgcgggccacggcgccaagccgccggcgaccctggccgagttcaccttcgacggccacgaaggcctggacttctacgacgtgagcctggtggacgggtacaacctgccgatgctggtggagccgcacgcgccgaaacggcgcggcggcngcaactgcctgctg

SEQ ID NO: 49593 - protein, 164 aa, Zea mays
  misc_feature: Ceres CLONE 1460704-F
  misc_feature (38)..(163): Pfam Name: Thaumatin Pfam Description: Thaumatin family
  misc_feature (160)..(160): Xaa is any aa, unknown, or other
MSGHARQAPFALLRAFLVIVSFRAGAGVSSTRTLTMTNHCGYTVWPGILSSAGSPALETTGFALEPGQSRSLPAPRGWSGRLWGRTHCSADAAGRFACATGNCGSGRLDCAGHGAKPPATLAEFTFDGHEGLDFYDVSLVDGYNLPMLVEPHAPKRRGGXNCLL

SEQ ID NO: 49594 - DNA, 767 bp, Zea mays
  misc_feature: Ceres CLONE 1460709-F
  misc_feature: Encodes the peptide sequence at SEQ ID NO. 49595
  misc_feature (13)..(13): n is a, c, t, g, unknown, or other
  misc_feature (14)..(14): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ttttcttttttannacacccatacataaaaatntnnnnnnnnnananannnnccgattgggtacgggccccccctcgaggcctgcgttggtataggaggcgccccagcagctcttgcggtcgtccctcagccgcgtcgcaccgcatcgcattctacgattcgaagctctctgctcgcaggggaccatggcgaagaactacccaaccgtgagcgccgagtacagcgaggccgtcgagaaggccaggcgcaagctccgcgccctcatcgccgagaagagctgcgcacccctcatgctccgcctcgcgtggcactccacggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgacttctaccagcttgccggagttgtggccgtcgaggtcaccggtgggcctgagatccccttccacccaggcagggaggacaagcctcaacccgccaccttgagggccgtcttcccggatgccacccaagggttcctgaccaccctgaaggcaagtcctttggccaagcagaatgggtttggagtggatcagggaactccgttggccctcctcctggggggcccccccaccttgggggaaaggtggccccacaaagaaagcggtccctggggttttatgaaggggcggccttgggaccca

SEQ ID NO: 49595 - protein, 194 aa, Zea mays
  misc_feature: Ceres CLONE 1460709-F
  misc_feature (19)..(181): Pfam Name: peroxidase Pfam Description: Peroxidase
  misc_feature: SWISSPROT Homolog: EC 1.11.1.11 L-ascorbate peroxidase
MAKNYPTVSAEYSEAVEKARRKLRALIAEKSCAPLMLRLAWHSTGTFDVSSRTGGPFGTMKCPAELAHGANAGLDIAVRLLEPIKEEFPTLSYADFYQLAGVVAVEVTGGPEIPFHPGREDKPQPATLRAVFPDATQGFLTTLKASPLAKQNGFGVDQGTPLALLLGGPPTLGERWPHKESGPWGFMKGRPWDP

SEQ ID NO: 49596 - DNA, 657 bp, Zea mays
  misc_feature: Ceres CLONE 1460721-F
  misc_feature: Encodes the peptide sequence at SEQ ID NO. 49597
cgattgggtacgggccccccctcgagccactgcagtggtaaaggcggaaaaatggaatgcccacagatctgtaaaatttgttggtttactcgcgaccaaccgaatcgctgttgatgactcgtgcacaaacaaaaatcgaatcgaattcctgcccccttcttccccacacacgctaaactccaagcaagcaagcgcgaaataaccaccgtttccttgcagctcgcgaatctgcggcccccgttcccccacccgacacggcacaccactcgctccagtccgccttcatccaacggttcccctcctatttgccctcggaatcccgcccgcgaaccctagccggcctccgcgagatggacgaggactgggagctactcctcgcgtcccccaaggcggcggcggcggcggcgccggccgagccgtacgccggcggcggaggagatggggaggacgacgccggcgcaatcaagcacgactacttcgacctcggctccgatgccaagtacccccggagggcgtcgccgtcgaagggaagcgaggaggagtgtgctgaggaggggcctttcgcggcgtcggacaacgcgggctgggtggagccggaccccgacgaccttctcttccccggccgcgaccgcgcggcgctctggtcggactcgtcct

SEQ ID NO: 49597 - protein, 102 aa, Zea mays
  misc_feature: Ceres CLONE 1460721-F
MDEDWELLLASPKAAAAAAPAEPYAGGGGDGEDDAGAIKHDYFDLGSDAKYPRRASPSKGSEEECAEEGPFAASDNAGWVEPDPDDLLFPGRDRAALWSDSS

SEQ ID NO: 49598 - DNA, 674 bp, Zea mays
  misc_feature: Ceres CLONE 1460727-F
  misc_feature: Encodes the peptide sequence at SEQ ID NO. 49599
  misc_feature (674)..(674): n is a, c, t, g, unknown, or other
tcgagccctgcagtggtaaagggcgcgagactgttctttctccatttcccaatggccgccgccgccgccgccgtcttctttccctccaccccgagtcctcgataccgcctcgccgccgccgcccgccgctctccacccagcttcaccggcgccaccgacgccgtgccgccgccggaggacgaggactccagcgacgacgatgccgacgacgacgccgcgccacgcaggagcgggcgcagggaccggcgccgcgcggtgcgcgtcgcgtgggagaagctagtccggtggtcccgctcctggcgccgccgcaaccgcagcgacgtcctcgagaccacgcgcaaggtggtggttctcgggggcgggtcgttcgggacggccatggcccctcacgtggtggccaagaaggccgacctcgaggtgggcatgctgctccgggacgacctcgtctgccggtccattcacaacggacatggtcaattgcaagttccttttcacaaacccagattggcccaaaaatatccccaccaacaactagtggcggccgctgcctttaaacgggagctggaattctggcttcccgggttgtccccgggtttaattccaatttcacccctcttcttggaaggatttttcagacaccggggtgccatccaaatgtctgccccatccctccn

SEQ ID NO: 49599 - protein, 207 aa, Zea mays
  misc_feature: Ceres CLONE 1460727-F
MAAAAAAVFFPSTPSPRYRLAAAARRSPPSFTGATDAVPPPEDEDSSDDDADDDAAPRRSGRRDRRRAVRVAWEKLVRWSRSWRRRNRSDVLETTRKVVVLGGGSFGTAMAPHVVAKKADLEVGMLLRDDLVCRSIHNGHGQLQVPFHKPRLAQKYPHQQLVAAAAFKRELEFWLPGLSPGLIPISPLFLEGFFRHRGAIQMSAPSL

SEQ ID NO: 49600 - DNA, 645 bp, Zea mays
  misc_feature: Ceres CLONE 1460728-F
  misc_feature: Encodes the peptide sequence at SEQ ID NO. 49601
  misc_feature (510)..(510): n is a, c, t, g, unknown, or other
cgattgggtaccgggccccccctcgagccctgcagtggtaaagggcgtttcagttccttgcttgcttgcttgctcttgctctccctctctcgtggaagccagccacacaaggcagaaagagagagtgacgttgtgttccatcccgttccgctgaagcaaccgctctcctacaccaaaccacccacaccactctaggtctctagccgatgcgatggatgtggatccagcagcggaccagcggaggaagaacaagggcgggctggagtcggagctggagcgccactacgacgacctgcagcgggagatgatgctgatggccgccgatcggccgcacaagcaactgcaacagcatcgacgtcacgggcaccgccccgatctgctccagaactgcgacctgcccccaccggccaagctcttcggccccgtacccaccctgcagaggctggagaccgctgctgcccaggaccacaggccgacgacggcctgctgcgggcgctgcgcctgtcccantcgcgcgcgcgggaagcggaagacaagctgggcggcgcgggcgccaccaacgttcaactccgcgcgctgctcgtgcgggactccgttgggttcttcgcccaccgcgttgggtcatgatgctggagggcgagaaat

SEQ ID NO: 49601 - protein, 144 aa, Zea mays
  misc_feature: Ceres CLONE 1460728-F
  misc_feature (100)..(100): Xaa is any aa, unknown, or other
MDVDPAADQRRKNKGGLESELERHYDDLQREMMLMAADRPHKQLQQHRRHGHRPDLLQNCDLPPPAKLFGPVPTLQRLETAAAQDHRPTTACCGRCACPXRARGKRKTSWAARAPPTFNSARCSCGTPLGSSPTALGHDAGGRE

SEQ ID NO: 49602 - DNA, 695 bp, Zea mays
  misc_feature: Ceres CLONE 1460729-F
  misc_feature: Encodes the peptide sequence at SEQ ID NO. 49603
  misc_feature (545)..(545): n is a, c, t, g, unknown, or other
ggagctccccgcggtggcggccgctctagaactagtggatcccccgggctgcaggaattcgcacgagaccattacctagaacatcctaatcgaaaagggacgagggaggggaaaagagagatggtggaggcatcgccggagtccggcgccgcggcgaccggaggtgcctctagtacggcggcggtgcggaaggggaagtcatgcaagggctgcctctactactcgtcagtgctcaagtcccgcggttacaacccaatctgcgttgggatcccccgctccatcccccaagttcctaactacgtggtggatgaacctaaggaggaggcgacggcgcaggggcatgacctcaggcggttcaggtacgggtgcgcgggttactccatgttcgtggacaacagggacggccagggtggtgagagcgagggcaagacgttgttgccatattgcaggggcctcgagttattggtggacagcagattggtcgagagaaagccatcggcaactgaacaagctccagcacatgttgcaaaggatgctaccatccngctctcaccaacaaggacaacagagacctcagaacttgtcaagcaggaaatctttggacaggtttaagaagagccgctgaactgctccctttcaggggttgcgaaaaatcctaaccaaacagcccaattttttcaaagaaaattttccgg

SEQ ID NO: 49603 - protein, 163 aa, Zea mays
  misc_feature: Ceres CLONE 1460729-F
  misc_feature (142)..(142): Xaa is any aa, unknown, or other
MVEASPESGAAATGGASSTAAVRKGKSCKGCLYYSSVLKSRGYNPICVGIPRSIPQVPNYVVDEPKEEATAQGHDLRRFRYGCAGYSMFVDNRDGQGGESEGKTLLPYCRGLELLVDSRLVERKPSATEQAPAHVAKDATIXLSPTRTTETSELVKQEIFGQV

SEQ ID NO: 49604 - DNA, 683 bp, Zea mays
  misc_feature: Ceres CLONE 1460730-F
  misc_feature: Encodes the peptide sequence at SEQ ID NO. 49605
tggagctccccgcggtggcggccgctctagaactagtggatcccccgggctgcaggaattcgcacgagaccattacctagaacatcctaatcgaaaaaatcttcctccttcctttttcctattgctgtgctctacagttcaataatttccctgccatctctcggcctttagtgaatttctccatgagctttactggtcaccgaactcgcattcgagttgacatgctttgcgtcgttcaactggccagagctcgccgcatgtcatctccggttcttcccagcccatggtgtgtgtcgctgcacacttgccagcggtcgtcggccatcgaccccacgctcattctcgcaacctcactgcagcatcgtcgttctcccagttctgcgcgaacgtctgtgaacatttagagaagaagcggtgtctgaaaaaggagttcactccagagcctcttgatccagtggtggagttttatctaactacttacagagtagaataattttgggatctactcctgcaataaggagaagttttattcccttatctttgggttagttacttcatgtggaggacttgaagcttagaaggtttttatatatctcttatggaaaggcttcacccttcgaattattgtagttaagttatgcccttcaagtactatcaggacttgtaataaatacatctctttc

SEQ ID NO: 49605 - protein, 73 aa, Zea mays; identical to SEQ ID NO: 48873
  misc_feature: Ceres CLONE 1460730-F

SEQ ID NO: 49606 - DNA, 699 bp, Zea mays
  misc_feature: Ceres CLONE 1460731-F
  misc_feature: Encodes the peptide sequence at SEQ ID NO. 49607
  misc_feature (393)..(393): n is a, c, t, g, unknown, or other
  misc_feature (432)..(432): n is a, c, t, g, unknown, or other
  misc_feature (489)..(489): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (525)..(525): n is a, c, t, g, unknown, or other
  misc_feature (560)..(560): n is a, c, t, g, unknown, or other
  misc_feature (570)..(570): n is a, c, t, g, unknown, or other
  misc_feature (592)..(592): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
gctctttactagtggatcccccgggctgcaggaattcgcacgagaccattacctagaacatcctaatcgaaaaatccagtcgcacctccctctccgaaatcaaggtagcatacaccgctgcagtttctagagccctctctgccactcgtgatcccactagtcacgatgcctgccctcgctaagcccgcctcccgcaccgcctagcccgccgcggctccgaagccgaagcctgccgccgccaagccgaaggcggccaccgctggtgcctcccacccgccttacttcgagatgatcaaggaggctatcacggcgctaaaggagaggaccggctccagcttgcatgttatctccaagtatgtggggtacaaacacggcccgcctctgggggtgaanttgaagaagatgctttccatccaactccgtgggtccgcngccaagggcaagctcgtgaaggtcaaggtttcgtacaaactctcggactcctcccanaaggcatcccccnnnaccaacgctctaacccagcanaagcccgctgctgccaagaccaccgcccaataganggtctaagtncgtctccggccaatctaataangaaaccnnntgccatctccataaaacctatctgctactctcgacccaactcaaagtgtccnnnnaaaaatggtctggttttaagctaatgaattctccctcccgcca

SEQ ID NO: 49607 - protein, 89 aa, Zea mays
  misc_feature: Ceres CLONE 1460731-F
  misc_feature (1)..(64): Pfam Name: Linker_histone Pfam Description: linker histone H1 and H5 family
  misc_feature (35)..(35): Xaa is any aa, unknown, or other
  misc_feature (67)..(67): Xaa is any aa, unknown, or other
  misc_feature (72)..(72): Xaa is any aa, unknown, or other
  misc_feature (79)..(79): Xaa is any aa, unknown, or other
MIKEAITALKERTGSSLHVISKYVGYKHGPPLGVXLKKMLSIQLRGSAAKGKLVKVKVSYKLSDSSXKASPXTNALTQXKPAAAKTTAQ

SEQ ID NO: 49608 - DNA, 695 bp, Zea mays
  misc_feature: Ceres CLONE 1460733-F
  misc_feature: Encodes the peptide sequence at SEQ ID NO. 49609
  misc_feature (628)..(628): n is a, c, t, g, unknown, or other
tggagctccccgcggtggcggccgctctagaactagtggatcccccgggctgcaggaattcgcacgagaccattacctagaacatcctaatcgaaaaaaaacccagccgtccagaaccgtcgtcgccgccacagcccgtccttccaccacgctcgcgccgttgcgcgctcttagggttccgcagggtcgggatcgccggagatggactggagcgcggtgacggcggaggacctggtggacgcgctgcgggaggtggactggtccacgccgccgcggactgtctcggagttcttctcccggttcaccgtcccacgctcctattccaagtggaccagccgcctcaagtgcaacctctactactacaggacaaactatttcatcttgatcatgttcatccttgggatgggcttcctttggaagccagttgctatccttgctgcttttatgactggacttagcatcgcatttctcaatgatagttttgcagtcactttcaatgagaaagtcacaaggaccataagacagttttcaccacatttagctgcaaagatgaggccaccaataacacctgttcttcgtggtcgacaaactcgagagatcaattcattatttgtgggcgaccgcccangggggttggccatatcctttctgcattagctgttacccttggtggactcctgcatcttccccaagcc

SEQ ID NO: 49609 - protein, 151 aa, Zea mays
  misc_feature: Ceres CLONE 1460733-F
  misc_feature (16)..(146): Pfam Name: PRA1 Pfam Description: PRA1 family protein
  misc_feature (143)..(143): Xaa is any aa, unknown, or other
MDWSAVTAEDLVDALREVDWSTPPRTVSEFFSRFTVPRSYSKWTSRLKCNLYYYRTNYFILIMFILGMGFLWKPVAILAAFMTGLSIAFLNDSFAVTFNEKVTRTIRQFSPHLAAKMRPPITPVLRGRQTREINSLFVGDRPXGLAISFLH

SEQ ID NO: 49610 - DNA, 810 bp, Zea mays
  misc_feature: Ceres CLONE 1460734-F
  misc_feature: Encodes the peptide sequence at SEQ ID NO. 49611
  misc_feature (360)..(360): n is a, c, t, g, unknown, or other
  misc_feature (367)..(367): n is a, c, t, g, unknown, or other
  misc_feature (369)..(369): n is a, c, t, g, unknown, or other
  misc_feature (372)..(372): n is a, c, t, g, unknown, or other
tggagctccccgcggtggcggccgctctagaactagtggatcccccgggctgcaggaattcgcacgagaccattacctagaacatcctaatcgaaaaaccgccgcgccgcccaaaccctagccgccgccgccgtcgccgccatggtcgccgtgaaccgccctctcgtctccgtgaaggccctagagggagacatggtaaccgacgcccccggcatcgccttaccgcccgtcttcggggcgccgatccgccccgacgtggtcaggttcacccacaagctgctgtcctgcaacaagcgccagccctacgcagtctcccgccgcgccggccaccagacgtcggccgagtcctgtggtaccggncgtgccngnccncgtatcccccgcgtccccggcggggggacccacctcccccggccagggaacggttcgggaaatggggccgcgggggggggactgttcccggcaacccaaaattgggcgcaagggggccccgcccggttaaaatttaaactcccccccggttccccttgccctccgggttttgcccccaacgggggttccgggccctttttcagggggggggacccccgtttagaggtttgtcccaagaaacccccttttgttttttccaaacccccgggaaacacattagaaaaaaccccccaggggccaaaaatcctccaaagatattgggccccccctcccccccgagagggggaggagttccttctgtgctctccccgcccgagagatataataatccccccccctattatacaaaggggggggcccttttttttttataccata

SEQ ID NO: 49611 - protein, 223 aa, Zea mays
  misc_feature: Ceres CLONE 1460734-F
  misc_feature (76)..(76): Xaa is any aa, unknown, or other
MVAVNRPLVSVKALEGDMVTDAPGIALPPVFGAPIRPDVVRFTHKLLSCNKRQPYAVSRRAGHQTSAESCGTGRAXPRIPRVPGGGTHLPRPGNGSGNGAAGGGLFPATQNWAQGGPARLKFKLPPGSPCPPGFAPNGGSGPFFRGGDPRLEVCPKKPPFVFSKPPGNTLEKTPQGPKILQRYWAPPPPREGEEFLLCSPRPRDIIIPPPIIQRGGPFFFYTI

SEQ ID NO: 49612 - DNA, 744 bp, Zea mays
  misc_feature: Ceres CLONE 1460739-F
ggagctccccgcggtggcggccgctctagaactagtggatcccccgggctgcaggaattcgcacgagaccattacctagaacatcctaatcgaaaaacctgccgtcccaccttcccagtgaaaacaccacctcacctctccccgtcgacgcaagaagcaccagcggcatccttggcccccaaggtgtataataggccggtggcggacaagggcgagaagaccacggcggcgaacaaaaccagggccgataggcggccgccggcttccaaggagggcggttagagaaatggctagaataattcccagaacagcgtggagacttacaagatctacatcttcaaggtgctgaatgacgtgcacccggacatctgcatctcctccaagggcatgtccatcatgaaatccttcacccacaacttcttctagaatctcgccggcgagtcggccaagctcgccaggtacaacaagaaaccctccttcgcgtcaagggagatccagacctgcgtccgcctcgtcctacccggcgagctcgacaagcacggcatctctgagggtacaatgggcgtcaccaagttcacatccgtttagataccctgctcttgtggtttctctgactgaggcgatttcacctggctgttgatgaagtcctcgctcattgaagttagatgatcgtagtgcgtcggcgtgtaatttgtgacgacacacatgtttcatgatgcggtagaaataggaatgctgttgctt

SEQ ID NO: 49613 - DNA, 778 bp, Zea mays
  misc_feature: Ceres CLONE 1460747-F
  misc_feature: Encodes the peptide sequence at SEQ ID NO. 49614
  misc_feature (21)..(21): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
gggggtgggggggggggggtnttctttttgtaggtggggggnnnnnnggntaataaaaactggagctccccgcgggggcggccgctctagaactagtggatcccccgggctgcaggaattcgcacgagaccattacctagaacatcctaatcgaaaaaaaacctccctctctcgatctcgacctcgccccttcgaccgcaagccatcccgctccctcggtaagcttccaagcggagtccggcggcgtcaagtcgaatggcgggcaagtcgcacacgcgcaaggcgttcctcctgtgcaactacgtcctcatgggcgccgcttccagctgcatcttcctcacgctgtcgctgcgcctgctgccgtccccgagcggcctcctcctgctcttcctccacgccctcaccgccgtcttctccgcggccgggtgcttgggatccttcacggcgcccgccacgcccgcgcagtgccacaacccggggacgggggggggcgcgctcaccgccatcttccaaggggcccgcgcgctgctcgggttcactcgcaccaccgacttcctgggcgagcttcagccctagcggcccggaagaaggacggcgcccttcatccctcaagatgggtcggggggcctcgtgtgtcccggccatctttcggtccctgggagtggggggggcggctccggcgccctgtggtttgctcccccttccgggcctccggatggaactaaccaaatgaactgaaccgaacccttccctaagtggtcagaggaaacccgcgggg

SEQ ID NO: 49614 - protein, 106 aa, Zea mays
  misc_feature: Ceres CLONE 1460747-F
MAGKSHTRKAFLLCNYVLMGAASSCIFLTLSLRLLPSPSGLLLLFLHALTAVFSAAGCLGSFTAPATPAQCHNPGTGGGALTAIFQGARALLGFTRTTDFLGELQP

SEQ ID NO: 49615 - DNA, 798 bp, Zea mays
  misc_feature: Ceres CLONE 1460748-F
  misc_feature: Encodes the peptide sequence at SEQ ID NO. 49616
  misc_feature (423)..(423): n is a, c, t, g, unknown, or other
aagctggagctccccgcggtggcggccgctctataactagtggatcccccgggctgcaggaattcgcacgagaccattacctagaacatcctaatcgaaaatcacttccattagcagttagtctcgggctcgttggccgtctttgctggggcagctacctagcagacgcatggcacacgtcgaccggccacggagccgcgccgtgctcgcggtcgccgtcgccgtcgccgccgcggcgctcctcctttttgccgcagcgggcgtcccgcgtgcggccggccagacgacgacgacagcggtggtggatctggacagctgggccgatcgcggcgcggcgtgcacgggcgcggtggaggcgtgcggcggcatccgcccgacggccaggagggagctgggttcccggcgggtacaccatctacaacnccatgagccgcggggcgcgtgccgtgctcgtacccgcggcgcgtacttaatacaactgcccggccgggcccccccggcccaacctttactcccgcgggtggccccgcctatcacccgcttgcaaaaggcatggggcgccaagggatgaacaatccccctccccctccccccggggacacaaaaaaaaaccgccccggggggtttttgggtctcggaaataaccggggcttttaaaaggggggggtgtttaaccgtaaaaaaaacaaaggcgcccctgggccccaaatatttaaaagggccccaaaaaaaagaaaatttggggtacaacaaacccccggctccattttaaaaaaaaaaaaaaaagctccctcgccg

SEQ ID NO: 49616 - protein, 133 aa, Zea mays
  misc_feature: Ceres CLONE 1460748-F
  misc_feature (85)..(85): Xaa is any aa, unknown, or other
MAHVDRPRSRAVLAVAVAVAAAALLLFAAAGVPRAAGQTTTTAVVDLDSWADRGAACTGAVEACGGIRPTARRELGSRRVHHLQXHEPRGACRARTRGAYLIQLPGRAPPAQPLLPRVAPPITRLQKAWGAKG

SEQ ID NO: 49617 - DNA, 703 bp, Zea mays
  misc_feature: Ceres CLONE 1460751-F
  misc_feature: Encodes the peptide sequence at SEQ ID NO. 49618
aagctggagctccccgcggtggcggccgctctagaactagtggatcccccgggctgcaggaattcgcacgagaccattacctagaacatcctaatcgaaaagcctccgcctcccaaacacccgaatcaaactaacagccaccgatggcgtcgccgtcgcggttgctcccgcccacgcctccttcggccgcccagccccgcggcccgcgggatcgcctcgccttgccgcgcctccggtgcctcgccgccgccgcagcctccgcctcgcccactgatggcgctgtgctgctggagcgtggcggttccgcggcggtggccgtgcgggagttcgtcacgcttgacgagctccgcgctgccgtgcgcctccgcgtccgcaccttccacgagtacgcagacgactccgtcggaaccgagttttgttaggatcacagaaaggctcttgcagatagggagtttgaagcattacaggataggatttctgggaagatgataaattttcgaagagtttcttgcataaacgggactgttccactgtccccatcattaatgtcagctgaggaactttgttctatgtgcaagttgtggaggatggaaaagaagatagtagttggtagtttagaccttattcgggggctttggcttccaaataatttgccgggaaaaggcccggggaacaaaccttgttcccccttcctcccattgga

SEQ ID NO: 49618 - protein, 92 aa, Zea mays
  misc_feature: Ceres CLONE 1460751-F
MASPSRLLPPTPPSAAQPRGPRDRLALPRLRCLAAAAASASPTDGAVLLERGGSAAVAVREFVTLDELRAAVRLRVRTFHEYADDSVGTEFC

SEQ ID NO: 49619 - DNA, 699 bp, Zea mays
  misc_feature: Ceres CLONE 1460752-F
  misc_feature: Translation starting site: 169
  misc_feature: SWISSPROT Homolog: EC 3.2.1.23 Beta-galactosidase
  misc_feature (699)..(699): n is a, c, t, g, unknown, or other
ggagctccccgcggtggcggccgctctagaactagtggatcccccgggctgcaggaattcgcacgagaccattacctagaacatcctaatcgaaaaaaaatcatcttcctcctcttctctcctctcctcttactcttccccaccaacgccaccaaaaccaacactccgatggatgttttcaccaagcaactcctccccatgcctcaccagcgggaccccaactacccttcctcttccacctcttcctcctcgtcgtcgtcctcctccacgcccccatctcgccctcaccaccgtgcgcaaccccaaccccaaccccacaacctcccccagtccccgagacccgtcgccgtaccgtccgtccttgtttcgtgaggtgcttgctttgctgttctccttgatcgacgccgtatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgtttaaattcgcgttaaatttttgttaaatcagctcattn

SEQ ID NO: 49620 - DNA, 903 bp, Zea mays
  misc_feature: Ceres CLONE 1460753-F
  misc_feature: Encodes the peptide sequence at SEQ ID NO. 49621
  misc_feature (11)..(11): n is a, c, t, g, unknown, or other
  misc_feature (13)..(13): n is a, c, t, g, unknown, or other
  misc_feature (15)..(15): n is a, c, t, g, unknown, or other
  misc_feature (18)..(18): n is a, c, t, g, unknown, or other
  misc_feature (20)..(20): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (309)..(309): n is a, c, t, g, unknown, or other
  misc_feature (419)..(419): n is a, c, t, g, unknown, or other
  misc_feature (462)..(462): n is a, c, t, g, unknown, or other
  misc_feature (475)..(475): n is a, c, t, g, unknown, or other
  misc_feature (883)..(883): n is a, c, t, g, unknown, or other
  misc_feature (903)..(903): n is a, c, t, g, unknown, or other
aaattttttanancncancnacaaacaaaaacacnnnnnncaaaaccggaactccccgcgggggcggccgctctattatagtggatcccccgggctgcaggaattcgcacgagaccattacctagaacatcctaatcgaaaaacccagccgattctttctcccgttcaccccgcgagcacgctctttcccttcctcgtgccgacgaccgggcgaccgccgcgccccggcccgcgcccccttgtctcgggccactcgccggcaacgagcagccaccaggaaatgttgtgaggactgatgcattacccaancttgctggatggacggatgtgattgcatcgagccactatggcctaccgatgatctccttgtcaagtatcagtacttctccaacttctttatagcccttgtgtattgaccnattcggttggagtttagttatttaagagaaaaagcggccttgnccccccaaaaaanggggtattggctccctttggagcgacaacagctcccccctacagggaacaacaggggacaaacctgtggacgggtggtctctcattagtacagacggattaggaatggttcatgaactctttggcagaggggtttccacaagctagtagttgcgctggaggactctgggttattgaatgctctgggcataattactgcgcgcgaaatatctttcaagcgtgtattaaccactctgaactcgcctccatggtactatatagtcggctgagagtagtttagtagctagaatagatttggggtcttagattgtaggcactctagatcatcggcacgcgggacagcacagatggttaagagacagctccgatctgcctgtgataattcgcttaagtgtagttttcgtgtaangcggggtagccgtatctctn

SEQ ID NO: 49621 - protein, 32 aa, Zea mays
  misc_feature: Ceres CLONE 1460753-F
  misc_feature: SWISSPROT Homolog: EC 2.7.13.3 Histidine kinase
MDGCDCIEPLWPTDDLLVKYQYFSNFFIALVY

SEQ ID NO: 49622 - DNA, 693 bp, Zea mays
  misc_feature: Ceres CLONE 1460757-F
  misc_feature: Encodes the peptide sequence at SEQ ID NO. 49623
  misc_feature (579)..(579): n is a, c, t, g, unknown, or other
  misc_feature (663)..(663): n is a, c, t, g, unknown, or other
ctggagctccccgcggtggcggccgctctagaactagtggatcccccgggctgcaggaattcgcacgagaccattacctagaacatcctaatcgaaaaacgtgtggatgaggctggattcggcagcacagtggagctgcaattctgtgcctcctgctcgtacaagggaactgcagtgaccatgaagcgcatgctggaaacctcatttcctggcattcatgttatcttgcataattatcctcctccattccccaagcgtgtactcagcaaagttatcccaattgttcaagttggagccgttgcaacaataatggctggtgaccagattttccccagaattggcatggttgctcctccatggtactactcgcttcgtgccaatagattcggaaccatggcaacaatctggctatttggcaactttgctcaatcctttctacaaagctctggtgcctttgaagtttactgcaatggagatttggtattctcaaaacttgctgagcagaggttccctagcgagttcgagttgcgggaccttgttggcagcagattgcctggggtctccattttggagaatccngggaaaaacctgacttgatgatgaccccggaaaatcaaagctccaaaaggcccccaattaaaaaggtgctttttaaggattaanaaaaaggaactaattgggaatgaaccaacg

SEQ ID NO: 49623 - protein, 138 aa, Zea mays
  misc_feature: Ceres CLONE 1460757-F
MKRMLETSFPGIHVILHNYPPPFPKRVLSKVIPIVQVGAVATIMAGDQIFPRIGMVAPPWYYSLRANRFGTMATIWLFGNFAQSFLQSSGAFEVYCNGDLVFSKLAEQRFPSEFELRDLVGSRLPGVSILENPGKNLT

SEQ ID NO: 49624 - DNA, 766 bp, Zea mays
  misc_feature: Ceres CLONE 1460759-F
  misc_feature: Encodes the peptide sequence at SEQ ID NO. 49625
ttgtccgccctcccgcggcctcccccctatatatcttttttcctttctttcaaaactggtactccccgcggtggcggccgctctattctagtggatcccccgggctgcaggaattcgcacgagaccattacctagaacatcctaatcgaaaagccgcaccgcaaaacgcatatccctgcctgcacacggcatccggagttccggactcccctcctcttctcgggcagccgggcgccgcttcgcctcctcctcgcaggcaagaagagcagccagccgcttcgcgatcggggacgcggagaggggaaaggcgagtcgtcgtccgtccacggcagcttccctccctctcctctccgcccccgcttacctagcccggcccctcctacgccccccctcccgccgccgcaagatgagcacctctccggccgcgtccgccaccacgtcacctcccccacctattgcctccgccgccgaggcctcgcgggcgacggatacgttggtggcccaccagagggtcgcctcacacgtggacccgttcctcgtagaggagctcgacaaccctcgccaccgcctcatggttcttcggatggaactggatatccgaaaacttttcgcagaaaccttcttctgcagggaagtccctaattccacaaatttttccaaaacttcctaaacaaaccccttggggcctgcccccatccccttgttttcctaacaattccttgggctttaaaaaacccctaatgtggggatcaaaaatattcttatt

SEQ ID NO: 49625 - protein, 87 aa, Zea mays
  misc_feature: Ceres CLONE 1460759-F
MSTSPAASATTSPPPPIASAAEASRATDTLVAHQRVASHVDPFLVEELDNPRHRLMVLRMELDIRKLFAETFFCREVPNSTNFSKTS

SEQ ID NO: 49626 - DNA, 688 bp, Zea mays
  misc_feature: Ceres CLONE 1460763-F
  misc_feature: Translation starting site: 509
  misc_feature (551)..(551): n is a, c, t, g, unknown, or other
atagctggagctccccgcggtggcggccgctctagaactagtggatcccccgggctgcaggaattcgcacgagaccattacctagaacatcctaatcgaaaaaacacgtgacaccccgcgcggcaccctcgcctccgccgcacgcccccactctctcaccgccaccgccgagaatggcctgctcccacctcgccgccgcgggtggctcttcccctgccgccgccgcagtggttcgttccccgacgcattccccagccgccgccttcgcgcgcctccggtcgacgccgcgtttctcgagcgccggcctgtcggttaagagaagcagggcggcttttcccgtgggtcgccgccgcggggccggccgcggcggcgccggtgggcgacctggacggccgccccggccacggagaacaacccatcattgtcatcgataactacaacggcttcccctacaacctatgccagtatatggggggaccttggattgaacctcccaaatatacccccaatggatgacctgacccttaaaaaggtaaaaagggaaaaacccnagaaggaatacctttttttccccaggccccgggggaacccccaaaatttcggggaatttcttttggaaactgttctttaattaggcccccccccccccatttttcaaaattcgctgggcccccccaggcatttggaa

SEQ ID NO: 49627 - DNA, 795 bp, Zea mays
  misc_feature: Ceres CLONE 1460764-F
  misc_feature: Encodes the peptide sequence at SEQ ID NO. 49628
aagctggagctccccgcggtggcggccgctctagaactagtggatcccccgggctgcaggaattcgcacgagaccattacctagaacatcctaatcgaaaaacgtctcgtcggtttctctcatgccaatttctctcaccctggttctctctcgctcgtcgccgtgcagttggagtcgccgagagcgccgtccgcgccgaatggtactcgccgtcgaactccgtcgtgatcgtgattcgtttctgagcttcgaggaatcaacggtcaagctttggcgaccaagtgatcgaactcttcgagttctacgagatcgaagatcctgagcatctgtttggtgaaggttgtctttggtgcaatctatgctcaggtaaagaaaaaggagaatggtgtcgaggcctatctccggggagtccaccgacctcgatgagttcgaggattaggctagcgacttcccccagccagctgccggtggtggggtttatttacgttgggccacgttttgaatccggggaccttggatttatattaaggaaaaggctcccagcccggaaaaattataacctacctctttttgggaatccaaagcctttggctttggaagagccattttggggccaaaaaaaaaaaccctcaaaaaaaaaaaaaaagctttttcctacccccccccccccagggggggggcccgggacccaatttccccctataagggggtcatattaacgcgcctccccggggcggggttttttacacctccgggggtggggaaaaaccctgggtgttccccattataactcgc

SEQ ID NO: 49628 - protein, 40 aa, Zea mays
  misc_feature: Ceres CLONE 1460764-F
MVLAVELRRDRDSFLSFEESTVKLWRPSDRTLRVLRDRRS

SEQ ID NO: 49629 - DNA, 696 bp, Zea mays
  misc_feature: Ceres CLONE 1460766-F
  misc_feature: Encodes the peptide sequence at SEQ ID NO. 49630
  misc_feature (696)..(696): n is a, c, t, g, unknown, or other
aaagctggagctccccgcggtggcggccgctctagaactagtggatcccccgggctgcaggaattcgcacgagaccattacctagaacatcctaatcgaaaaacgctgtgagtgactcggtcgcatcttccccattctccatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcccgcgagaaggttcatttctccatttccaagtggacggatggcaagcaggagaagccaactgtccgcacagaatcggatgactaagggctggcgccatggcgacatagtccttcctacagatgatttgaagcgtcgttgcaagtttctgggacttgttatttagttggcttgatttgtaatcaatgctgaagaataaatactttttgcgacaatggtctttttacaatgtcgtgttgttttcgttgctaattgcacttgccctaccctaatcaagcatgtgaactaatggaatgcttcagttttgtgcaaaaaataaaaaaaaaaagcttatcgataccgtcgacctcgagggggggcccggtacccaattcgcn

SEQ ID NO: 49630 - protein, 70 aa, Zea mays; identical to SEQ ID NO: 4918
  misc_feature: Ceres CLONE 1460766-F
  misc_feature (9)..(57): Pfam Name: ATP-synt_Eps Pfam Description: Mitochondrial ATP synthase epsilon chain

SEQ ID NO: 49631 - DNA, 772 bp, Zea mays
  misc_feature: Ceres CLONE 1460769-F
  misc_feature: Encodes the peptide sequence at SEQ ID NO. 49632
tccccgcggtggcggccgctcttgaactagtggatcccccgggctgcaggaattcgcacgagaccattacctagaacatcctaatcgaaaaagatttcatcctcggcgtcgtctcctgtcctctccacgccaagcaacctccccaccccgccccaccctccatgctcgcctcgagatcttagcgggcagctccggagagcgccgacgagccccctgatccctcctcgccgccgccgccaaccgaccgggggaggagaggaggggaggggagcgatggagaccgccgactactccgggaagctcttcgtcggcggcatctcatgggagacggacgaggaccgcctccgcgagtacttcggccgcttcggtgaggtcactgaggccgtcatcatgcgggaccccccccccggccgcgctcgaggtttcggtttcgtggtcttcgctgacgccaccgccgccgagcgcgtcaccatcgaaaaaacttgatcgacggacgaatggtgtaggccaagaaggctgttcccagggatgaccacagtattgtgagcaagagcaacacaagttggattagggtcacctgggccggggccgaccaaaaaaaatctttggttggaggtctgccctccaatgttacagaagctgacttcaggggggtattttgaggcagttgggggccataactgatgtggcttgttgatgtatgatcctaactctcagagcccgcaggggctttgggattcactcacctatgaattcagaaagaagcggtgga

SEQ ID NO: 49632 - protein, 70 aa, Zea mays
  misc_feature: Ceres CLONE 1460769-F
  misc_feature (10)..(69): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
METADYSGKLFVGGISWETDEDRLREYFGRFGEVTEAVIMRDPPPGRARGFGFVVFADATAAERVTIEKT

SEQ ID NO: 49633 - DNA, 774 bp, Zea mays
  misc_feature: Ceres CLONE 1460771-F
  misc_feature: Encodes the peptide sequence at SEQ ID NO. 49634
  misc_feature (166)..(166): n is a, c, t, g, unknown, or other
  misc_feature (573)..(573): n is a, c, t, g, unknown, or other
  misc_feature (589)..(589): n is a, c, t, g, unknown, or other
aagctggagctccccgcggtggcggccgctctagaactagtggatcccccgggctgcaggaattcgcacgagaccattacctagaacatcctaatccaaaacacaagaacatcacacggcgatagcaaaaccttccgtcggaggatggcttccgccggcgctgganaagggaaggagacggctgccgggagcagcctccacagcaagactctcctcaagagccaaccactgtaccagtacatactggaatccaccgtcttcccacgcgagccggactgcctgcggggagcttcgcgtcgccaccgccacccaccccatgggggggattgtttgcctcccccgaagaggggttgttttcccacccccccgaccaaaatttttggggccaaaaagggctttcccccccctttttttaacggggaattttttgtttgtaaaagggccttggccttcccacaaaaaagggaaaaaagtgggggccctccctttttccccccgaaagaatcaacacaaaaaggggcccccgcggagaaaaaaaaaggggggggggggggggcacagaaaaaaaattcnccctaccggggttttnccccccgccgggggggaccaaaatttgttccagaaggggaaaaaagggggagttttcttttcttctttctggggcgcgaaaagggggattttttctcctcccccaaagggggggtgctatttttacaggggggggggggggctcctctcccataaaaaaaaccccgtgggtgggggctcccccgc

SEQ ID NO: 49634 - protein, 199 aa, Zea mays
  misc_feature: Ceres CLONE 1460771-F
  misc_feature: SWISSPROT Homolog: EC 2.1.1.104 Caffeoyl-CoA O-methyltransferase
  misc_feature (8)..(8): Xaa is any aa, unknown, or other
  misc_feature (149)..(149): Xaa is any aa, unknown, or other
MASAGAGXGKETAAGSSLHSKTLLKSQPLYQYILESTVFPREPDCLRGASRRHRHPPHGGDCLPPPKRGCFPTPPTKIFGAKKGFPPPFFNGEFFVCKRALAFPQKREKSGGPPFFPPKESTQKGAPAEKKKGGGGGAQKKNSPYRGFXPRRGGPKFVPEGEKRGSFLFFFLGREKGDFFSSPKGGVLFLQGGGGAPLP

SEQ ID NO: 49635 - DNA, 720 bp, Zea mays
  misc_feature: Ceres CLONE 1460772-F
  misc_feature: Encodes the peptide sequence at SEQ ID NO. 49636
aaactggagctccccgcggtggcggccgctctatactagtggatcccccgggctgcaggaattcgcacgagaccattacctagaacatcctaatcgaaaaatactattagacataccggtatatattattgttcttagtcatcgcacaagactcttgtcaacaagaccaacaacaggatgaggactgccgtgcatgctgcgctttgcattgtgcttgtgataatgtcttcaacactgtcatcttgcgaggacgatgagaaggtatctatcgcatgtgacacaggatgcaatgccgcgatctcccgtctcaaatgcttcctgatggcctattctgaagggaaagtgttggtcagcagcaactgcgaaacgccgaccaggtgcggctgcgtgtttcgtcacaaacaagatgcaacccttatcgccggcgacgttggcaacaaaaagggatattgatggcagacctgcatttcttgggttgaataatatatactgccagaaattattatggggccccaccaaacaaattatctattatgtttattcctccagggtaatgcttcccagcattgttccgttttaaaaaaaataaaaaatttacttttccccccccaaaaaaaaaaaaaacaaaaaaaaagtttttctcataccccccaaacctccaaggggggcccccggaacccaattcccccccttagggggaccgaattaaccccccccccc

SEQ ID NO: 49636 - protein, 91 aa, Zea mays; identical to SEQ ID NO: 46700
  misc_feature: Ceres CLONE 1460772-F

SEQ ID NO: 49637 - DNA, 754 bp, Zea mays
  misc_feature: Ceres CLONE 1460773-F
  misc_feature: Encodes the peptide sequence at SEQ ID NO. 49638
aagctggagctccccgcggtggcggccgctctagaactagtggatcccccgggctgcaggaattcgcacgagaccattacctagaacatcctaatcgaaaactctcctttctcacacctcgacgcctctctctctttccccgagctctcgaaaccctaggtgcgtgccgaccggcggcggcggcgaggtgatggcgatggacccggacgcggtggcgaaagccttcgtggagcactactaccggacgttcgacaccaaccgcgcggcgctggtggggctgtatcaggagacctccatgctcaccttcgagggccagaagttccagggcccatccgccattgccggcaagctcggatctcttcccttccaggcctgcgagcaccagatcgtcaccgtcgactgccagccgtcggggccccagggaggcatgctcgtcttcgtctccggttccatccgcaccggccccgaggagcaccccatcaagttctctcaggcattccatttgctgcccggagctgggtccttcttcgtgcaaaatgacttgttccgcttgacctatgggctaaggaacagcgaaaactctggggatgaaccaatttgttaagggcttcctgttgaaacaataaaacccaatggcccccccacccccaccccctttggaaccccccggggggcggattaacgggtttaaacgaaaatgggggggctttttttttcccggtgttttaaaccggtttaggggtgcggggcccct

SEQ ID NO: 49638 - protein, 137 aa, Zea mays
  misc_feature: Ceres CLONE 1460773-F
  misc_feature (8)..(121): Pfam Name: NTF2 Pfam Description: Nuclear transport factor 2 (NTF2) domain
MAMDPDAVAKAFVEHYYRTFDTNRAALVGLYQETSMLTFEGQKFQGPSAIAGKLGSLPFQACEHQIVTVDCQPSGPQGGMLVFVSGSIRTGPEEHPIKFSQAFHLLPGAGSFFVQNDLFRLTYGLRNSENSGDEPIC

SEQ ID NO: 49639 - DNA, 802 bp, Zea mays
  misc_feature: Ceres CLONE 1460778-F
  misc_feature: Encodes the peptide sequence at SEQ ID NO. 49640
tggagctccccgcggtggcggccgctctagaactagtggatcccccgggctgcaggaattcgcacgagaccattacctagaacatcctaatcgaaaaaccgacccaacccagatccattcctgtcccgtgtttaccttcacccagcggcgctgcccctgtcgtcgtcttcccgctcgcttccgagcgccgccctccccttctttccccatcgcctcccttccaccccctctcatctccgtctcccgcgccgacgacttaagtagggtttggccttagggttcaggcaagatgggtgagcgcaaagtgctgaacaagtattacccgccggacttcgacccgtcgaagatccctgcgcggcggcagcccaagaaccagcagatcaaggtgcgcatgatgctccccatgagcatccagtgcggtaccctgcgggacatacatatacaagggccactagttttcattccaaaaaggaagacttcctcggaaaagacctaccttggaaacccaaatttttaggttttaacttcaggggccctaaaggcttctggtgaaaatcaatttaaaaggggccccctaaaatttcaaacaccccggggaaatcgggggttaacccaaattttaaaccctgggggggcccggggggaggccccaaaaaaaaagaaatttccccggtgttgcagagaggggggggtctcataaaacccttgaaaaaaaaaaaagggtgttcaaggaggagggggcctcctcccgcttttgaaaaaagggcgcccaaaaaaaaaaaggggtgggttttttaaaaaa

SEQ ID NO: 49640 - protein, 75 aa, Zea mays
  misc_feature: Ceres CLONE 1460778-F
MGERKVLNKYYPPDFDPSKIPARRQPKNQQIKVRMMLPMSIQCGTLRDIHIQGPLVFIPKRKTSSEKTYLGNPNF

SEQ ID NO: 49641 - DNA, 769 bp, Zea mays
  misc_feature: Ceres CLONE 1460779-F
aagctggagctccccgcggtggcggccgctctagaactagtggatcccccgggctgcaggaattcgcacgagaccattacctagaacatcctaatcgaaaaatccatcaactcaacatcatcagctcgcgttgcgtgctcggcccgcctaatcctctttctttagctcaagaccggcgactaaatttggcgccagccggcagcagggggtataagtagtcgccgccgccgtcttcctcgcacctccccgctccgctctcccttgtcgagttctcagcaccggccgatccatcctcctccgcctccctcggttcggcctctggcctgcacaccatgaactctcgcttccggagcctctggagagccatggctggggctttgcagccgccgtgccgcctcggagctgccgcgtgtagcttgctcgctaagcagcagctatagtagctgagcgagtgcgtccatcgatcggagtcgtccacctccgtctccctttgcgattcggcgtcgtgaactcgtgttcttgagcgtgggggcaaggggcagagcaacaaggagacacttcttcttcttctttacaacaaataagataggtaaatttcagtccaattcagttctatatgtctaagttcctttccgttgctcctgaagacctgcacagaaccttttacatttggcgtctatcttactatctacatacatacagttctaagcagcagattaaaaaaaatcaagcttatcgatactgtcgaccatcgagggggggcctgtac

SEQ ID NO: 49642 - DNA, 712 bp, Zea mays
  misc_feature: Ceres CLONE 1460780-F
  misc_feature: Encodes the peptide sequence at SEQ ID NO. 49643
aagctggagctccccgcggtggcggccgctctagaactagtggatcccccgggctgcaggaattcgcacgagaccattacctagaacatcctaatcgaaaaagcgggatgaactactacgcctgcctctccatcatgtcgctggtgatcctcctgcccttcgccgtcgccatggaggggcccaaggtgtgggcagcgggctggcagacagcagtcgccgagatcggtcccaacttcgtctggtgggtggcggcgcagagcgtgttctaccacctgtacaaccaggtgtcctacatgtccctggacgagatctcgcccctcaccttctccatcggcaacaccatgaagcgcatctccgtcatcgtcgcgtccatcatcatcttccagacgcccgtccagccccatcacgcgctcgggggcgccatcgccatcctcggaaccttcatctactcccaggccaagcaataccccccccttgccccgcgcgtctggctctcaggcctccagtcagttcaccgccaaatcaactcggggcttcaaaaaaataacaaattaattaacctttggagaattccccccaagctttgaaaaaaaagaataataccaaaaccccccccctccttttttccaaaattttcttttttcccacagaaaaacctttttaacaaaaaacctttcccgcccccgggtgtttcccaaagaaaaaataaagg

SEQ ID NO: 49643 - protein, 194 aa, Zea mays
  misc_feature: Ceres CLONE 1460780-F
  misc_feature (17)..(151): Pfam Name: TPT Pfam Description: Triose-phosphate Transporter family
AGAPRGGGRSRTSGSPGLQEFARDHYLEHPNRKSGMNYYACLSIMSLVILLPFAVAMEGPKVWAAGWQTAVAEIGPNFVWWVAAQSVFYHLYNQVSYMSLDEISPLTFSIGNTMKRISVIVASIIIFQTPVQPHHALGGAIAILGTFIYSQAKQYPPLAPRVWLSGLQSVHRQINSGLQKNNKLINLWRIPPKL

SEQ ID NO: 49644 - DNA, 726 bp, Zea mays
  misc_feature: Ceres CLONE 1460782-F
  misc_feature: Encodes the peptide sequence at SEQ ID NO. 49645
ctggagctccccgcggtggcggccgctctagaactagtggatcccccgggctgcaggaattcgcacgagaccattacctagaacatcctaatcgaaaaagaacgcatcactacgtctctgcagaagcttcctagggttttttaggcgtcgcagataagagatcccctcactgcattccctctgagcgccgccactccctgacatcgagaccggctgcccgaccccggtccggcgatccctctgcacccctttctttgcgctgccagccccaatctctcgcatccctgtcaaccatggcggcgtcagcaggcggaggcgcggtgcgcgcgctgtcccagaaggagcaggacatacagatgatgctcgcggccgacgtccacctcggcaccaagaactgcgatttccagatggagcggtatgtctttaagcgtcgcaccgacggcatctacatcatcaacctgggcaagacatgggataagctccagctcgcggcgagggttattgttgccattgagaacccacaagacatcatcgtccagtcggcccgcccctacggccagcgtgctgtcctcaagttcgcgcagtacactggcgcccatgccatcgctgggaggcacacccctggtaccttcaccaatcagctccagacctctttcagcgagcctcgcctgctcatccttactgacccaaggactgaccatcagccaatcaaggagtctgctctgg

SEQ ID NO: 49645 - protein, 144 aa, Zea mays
  misc_feature: Ceres CLONE 1460782-F
  misc_feature (23)..(144): Pfam Name: Ribosomal_S2 Pfam Description: Ribosomal protein S2
MAASAGGGAVRALSQKEQDIQMMLAADVHLGTKNCDFQMERYVFKRRTDGIYIINLGKTWDKLQLAARVIVAIENPQDIIVQSARPYGQRAVLKFAQYTGAHAIAGRHTPGTFTNQLQTSFSEPRLLILTDPRTDHQPIKESAL

SEQ ID NO: 49646 - DNA, 769 bp, Zea mays
  misc_feature: Ceres CLONE 1460783-F
  misc_feature: Encodes the peptide sequence at SEQ ID NO. 49647
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
tttttcgtcgcacgaactgaagaagctgtttttctttntnngtttcntcctcaaactcggactccccgcggtggcggccgctctttactagtggatcccccgggctgcaggaattcgcacgagaccattacctagaacatcctaatcgaaaaccccacacactgtcactgccagcctccccttcgcttcgcttagctcgccgtcaccatggcgacctccaccttctctccgcgccccgccaccctcaagcccctgcgggcacgcgccaagcccgccggcctccagctccacctcctccccttcccgcgcctccgcgtcgcctgcgccaccgccgccggggaggcgccgcccgttgagcagcgggacgaggaggagccggcctctgccgcggcatccaacgggactgccgttaaggtcgaggagtcaaccccaaatcccgagtccccgcctgcgtccgcgccggacccggccttccgcgacgccaggtgggcgaacggcacctgggacctcaccaactccgacaagggcggcggagactattgggacgcccccttcgccgccgaggccccgaacaaggaaatggcttcgaaaactacccggtaggccgacgaatcatagaacgatgcccgctgtccttcgtacatccctccattatccccggcggggggggccttggatggaaggcgcgtttccccccctcctctgaaaacctgaagaaaacacttaaacgggctgtgcgcccggccgcgtgggccggggggttcccgtt

SEQ ID NO: 49647 - protein, 131 aa, Zea mays
  misc_feature: Ceres CLONE 1460783-F
MATSTFSPRPATLKPLRARAKPAGLQLHLLPFPRLRVACATAAGEAPPVEQRDEEEPASAAASNGTAVKVEESTPNPESPPASAPDPAFRDARWANGTWDLTNSDKGGGDYWDAPFAAEAPNKEMASKTTR

SEQ ID NO: 49648 - DNA, 737 bp, Zea mays
  misc_feature: Ceres CLONE 1460784-F
  misc_feature: Encodes the peptide sequence at SEQ ID NO. 49649
aagctggagctccccgcggtggcggccgctctttaactagtggatcccccgggctgcaggaattcgcacgagaccattacctagaacatcctaatcgaaaaaggcacaaggaagaacgaagagagatcagcgacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcgggtctgccacgctgccggacctcgtggccgcgctgtccctgccagcggccaagctcccgttcctcgggcgcgtgatgcggctgctggacacgtagggcgtcttcgcgtcatccgaccaccccccttccggctgaacccgctgtcctgactgctggtggagggcgtgcagtcggaggaccacacctaccaaaagtacttcgtgctgggcaccgtctctccactacgtggaggccggcatgtccctggccgactggttcatgaaggaggaggaccaggaccgccagctgccgtcgccgttcgaggccctgcacggggtgcccctcgtccacgagagcaccaagctgctggacgaggagctggacagggtcgtggatgaaggcctggccgcgcacaacaacctgtccatcgggatcgtcatacgggagtgcggcgacgacttcttcagc

SEQ ID NO: 49649 - protein, 79 aa, Zea mays
  misc_feature: Ceres CLONE 1460784-F
  misc_feature (30)..(78): Pfam Name: Dimerisation Pfam Description: Dimerisation domain
  misc_feature: SWISSPROT Homolog: EC 2.1.1.150 Isoflavone 7-O-methyltransferase
MATAIVPTDAELLQAQADLWRHSLYYLTSMALKCAVELHIPTAIHNLGGSATLPDLVAALSLPAAKLPFLGRVMRLLDT

SEQ ID NO: 49650 - DNA, 709 bp, Zea mays
  misc_feature: Ceres CLONE 1460786-F
  misc_feature: Encodes the peptide sequence at SEQ ID NO. 49651
ggagctccccgcggtggcggccgctctagaactagtggatcccccgggctgcaggaattcgcacgagaccattacctagaacatcctaatcgaaaaagcaagcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggcagacgtaccggggctgaagaaggaggaggtcaaggtggaggtctaggacggcaacgtccttcagatcagcggcgagcgcaacaaggagcaggaggagaagacggacacctggcaccgcgtggagcggagcagcgggagattcctgcgcaggttccgactgcccgagaacgccaagacggagcagatcagggcccgcatggagaacgcgtggctacagtcactgtgcccaaagaagacgcccagaaagcctgaaatggaagcccattccatctccgggctgaacctcggctgggggcctccaacctggcaaatttgag

SEQ ID NO: 49651 - protein, 80 aa, Zea mays
  misc_feature: Ceres CLONE 1460786-F
MSLIRRSNVFDPFSLDLWDPFEGFPFGSGSSSSLFPSFPRTSSETAAFAGARIDWKETPEAHVFKADVPGLKKEEVKVEV

SEQ ID NO: 49652 - DNA, 726 bp, Zea mays
  misc_feature: Ceres CLONE 1460790-F
  misc_feature: Encodes the peptide sequence at SEQ ID NO. 49653
  misc_feature (526)..(526): n is a, c, t, g, unknown, or other
ggagctccccgcggtggcggccgctctagaactagtggatcccccgggctgcaggaattcgcacgagaccattacctagaacatcctaatcgaaaatccgcatctcgcattctcgccggtgctgctgcaattaacgccacccccggccaaccgcctgaaaactacctctgccgccggcgccgccatccccaacatggcgagccaaggggagccctcggcctctgcttccgatccgaaggagaagaaggactactcgacggcgatactagagaggaaaaagtcaccgaaccgccttgtcgtcgacgaggccaccaacgacgataactccgtcgtcgcactgcaccctgacaccatggagaggctgcagctcttccgcggcgatactgtgctcctcaaggtctgatatggctaatctgagcttgttgcagcagcttggggatgttgagctaatctagcagattgtattatcacgtgaccgatctgtgtgtgttcaacctgaatccgtgtattcagagtgcagacctgntagaaataacttagcttttgccacagtactggctgaaggggttaaggtgaatttgggtgaatggtttgaaaatttaaatagctgaggcagggaggggaattggccccccccggtttggcttcgggtggggaaatttaaaaattcccatttcatttcaaccccttgtttctttgaggggaaaaaaacaaatttttttaggt

SEQ ID NO: 49653 - protein, 69 aa, Zea mays; identical to SEQ ID NO: 48138
  misc_feature: Ceres CLONE 1460790-F

SEQ ID NO: 49654 - DNA, 632 bp, Zea mays
  misc_feature: Ceres CLONE 1460792-F
  misc_feature: Encodes the peptide sequence at SEQ ID NO. 49655
  misc_feature (512)..(512): n is a, c, t, g, unknown, or other
aaagctggagctccccgcggtggcggccgctctagaactagtggatcccccgggctgcaggaattcgcacgagaccattacctagaacatcctaatcgaaaacgtccccgtctcaccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgacacgggcgcggcagcgggggccgcggcgtcggtcctggccgtggcttgctctgccgtcttcttcatcctcgtcgccggtggcctcgtgcagtaggcgctgccgtcgacgtggtggctagctgctggtttcggggtcaggcggaacccttgggtccatccgttttccccccttatttttggaaaaaaaaaaaaccccncccctgggccttggttttatatgggcccccctcccccccgggggggggggggggaacttggggaaatgctaaatcttttttgtaccaaccgggttttggcccacaaaaacccgggggggg

SEQ ID NO: 49655 - protein, 66 aa, Zea mays; identical to SEQ ID NO: 45446
  misc_feature: Ceres CLONE 1460792-F

SEQ ID NO: 49656 - DNA, 794 bp, Zea mays
  misc_feature: Ceres CLONE 1460800-F
  misc_feature: Encodes the peptide sequence at SEQ ID NO. 49657
  misc_feature (45)..(45): n is a, c, t, g, unknown, or other
  misc_feature (224)..(224): n is a, c, t, g, unknown, or other
  misc_feature (225)..(225): n is a, c, t, g, unknown, or other
  misc_feature (377)..(377): n is a, c, t, g, unknown, or other
  misc_feature (378)..(378): n is a, c, t, g, unknown, or other
  misc_feature (386)..(386): n is a, c, t, g, unknown, or other
  misc_feature (388)..(388): n is a, c, t, g, unknown, or other
  misc_feature (794)..(794): n is a, c, t, g, unknown, or other
gtggatcccccgggctgcaggaattcgcacgagaccattacctanaacatcctaatcgaaaactagtctactcggcagatttcactgactctcaccggcggtctttgtgcctccaccggccgccgccatgccgtacctcgtccgcgagcggctctacttcggcggcatcaaagacgccattgccgccctcacggagtcttcctccacgccggacttcacccacnncctctccgtggtcagttccgcctccatctccttcatcaccgattgccgcccgggcctcgagattccccaccgaggaggtcctccgcgtaattcccggctaggagggcccggcaccgattgccgcgtgttccccggggacgctagaccccctnnctcagaancnccaggaaagggctggtgggtcactgcgcatggccgcgccccttccggaacctcgaggagggaggactggttccacccgcctcgggccttggcttggaggttcttcattagaggctagcaaggccgagagattccctccccccatggctttgtgagggcggctccaagcaccgcctccagtagatgggggcttccctcttcgaatccctaaaacctgatatctcttccaaagggctgtttcaccctcctcaaagatatatgtggtgatcatgttggtccccacaaaaagatctttttgtcgcgctgtctcaattggttatcaaactcgccctcgcacggacgcactgccctggggctggtctctcctggaggttcgctgccgaccttctgtttggccatttttctgn

SEQ ID NO: 49657 - protein, 125 aa, Zea mays
  misc_feature: Ceres CLONE 1460800-F
  misc_feature (33)..(33): Xaa is any aa, unknown, or other
  misc_feature (84)..(84): Xaa is any aa, unknown, or other
  misc_feature (87)..(87): Xaa is any aa, unknown, or other
MPYLVRERLYFGGIKDAIAALTESSSTPDFTHXLSVVSSASISFITDCRPGLEIPHRGGPPRNSRLGGPGTDCRVFPGDARPPXSEXPGKGWWVTAHGRAPSGTSRREDWFHPPRALAWRFFIRG

SEQ ID NO: 49658 - DNA, 754 bp, Zea mays
  misc_feature: Ceres CLONE 1460806-F
  misc_feature: Encodes the peptide sequence at SEQ ID NO. 49659
  misc_feature (47)..(47): n is a, c, t, g, unknown, or other
  misc_feature (306)..(306): n is a, c, t, g, unknown, or other
  misc_feature (336)..(336): n is a, c, t, g, unknown, or other
  misc_feature (400)..(400): n is a, c, t, g, unknown, or other
ggagctccccgcggtggcggccgctctagaaactagtggatcccccngggctgcaggaattcgcacgagaccattacctagaacatcctaatcgaaaaaggccgagagttgtcaacgacgacgtctgccggcagtgctcctgctcctcctcctccttcccggccgccgcgcgagcttgggttagtgtctcttcttcgcggaggcctgtgagaggagccatcatcatggccgctgttgagactgttgtccctcaggttgctatgtcatgcgagggctgcgccgggggcgtcagaagagtgctctccnagatggaaaggagtgaaaccttcgacatanaccctcaggagcagaaggtgacagtcaaaggcaatgtcaagcctgaggacgtctttcagaccgntttccaagtcgggaaaaaggacctcctactgggagggcgaaaccaccgcccccggaccttcggggggttcaaaagccaaagcaatttccagaccccggaaaaaagcccttcttgtgtttctggggggccagaaaattcccccccccaaagattaacccctggatcgcccccttttatttccccccaggtggaggggtgggggggtggaccccttaaacctttaaatttataaaaaatcggggaataaagttttgcttttaaccgggtgttttccccgccaaaaaggggggttttttaaaaaaatgggaaaaaccccacgccccccccgtgggggtgtattcttcctcctcaaca

SEQ ID NO: 49659 - protein, 135 aa, Zea mays
  misc_feature: Ceres CLONE 1460806-F
  misc_feature (7)..(68): Pfam Name: HMA Pfam Description: Heavy-metal-associated domain
  misc_feature (28)..(28): Xaa is any aa, unknown, or other
  misc_feature (38)..(38): Xaa is any aa, unknown, or other
  misc_feature (59)..(59): Xaa is any aa, unknown, or other
MAAVETVVPQVAMSCEGCAGGVRRVLSXMERSETFDIXPQEQKVTVKGNVKPEDVFQTXFQVGKKDLLLGGRNHRPRTFGGFKSQSNFQTPEKSPSCVSGGPENSPPQRLTPGSPPFISPQVEGWGGGPLKPLNL

SEQ ID NO: 49660 - DNA, 752 bp, Zea mays
  misc_feature: Ceres CLONE 1460807-F
  misc_feature: Encodes the peptide sequence at SEQ ID NO. 49661
  misc_feature (381)..(381): n is a, c, t, g, unknown, or other
aaagctggagctccccgcggtggcggccgctctataactagtggatcccccgggctgcaggaattcgcacgagaccattacctagaacatcctaatcgaaaaaaaaaaacccctacatcctgccatacatccatccgccgccgccgccgccgccatctcctcccactctcttcccactccgacgaaaccctattcagtatccatctctccatccatggcgtggcgcggccccgccacccgggccgtcctcgccgccgtccgccgcccggcagcggccgcgcgcctccacgccccgcgccgccgcgtcccgcccgccttcgccaccacctcctccccgctcccgtccgcgcggcctctggcggcgttgatggggtccccggngacggtggccgccgtgatggcgcgtctcacggcacatcccggcgccagcgcgcgcgcgtgctgcaagctttcccagggtacttgaatctgttgtgtagatcccatcctttcgaaaggataaatgatgtgtcttttgggggaataaaagctattatggcatttcttccacagaaaagttcgaagaaattactcaacaatagctagtttcctcgataggatttcgagaaaacatataaatttaacgttacatggcatgtttttggcgcttaaaacctttagtgacgaactatttttacgctggtttcccatgagtaaaaaaagaaaaaaaaaaccttatcgaaaccgtcaacctccagggggggcccggaacc

SEQ ID NO: 49661 - protein, 83 aa, Zea mays
  misc_feature: Ceres CLONE 1460807-F
  misc_feature (56)..(56): Xaa is any aa, unknown, or other
MAWRGPATRAVLAAVRRPAAAARLHAPRRRVPPAFATTSSPLPSARPLAALMGSPXTVAAVMARLTAHPGASARACCKLSQGT

SEQ ID NO: 49662 - DNA, 793 bp, Zea mays
  misc_feature: Ceres CLONE 1460809-F
  misc_feature (402)..(402): n is a, c, t, g, unknown, or other
  misc_feature (411)..(411): n is a, c, t, g, unknown, or other
tggagctccccgcggtggcggccgctctagaactagtggatcccccgggctgcaggaattcgcacgagaccattacctagaacatcctaatcgaaaatcttacacatctggacaacaggcagcttctcatcaaatcagaccctggtgaagttgttaaacctggtaagccccctttttttcttatagatctcaattctcacttctgcaactgtatttgtaatccttgtctgctaaatttgagcagaccaattcaaggcgattaatgatgaggggatgccaatttaccagaggcctttcatgaaggggaagctgtacatccatttcacggtggagttccctgactcgttggcaccagagcagtgcaaggctctcgagacagtacttccacaaagcctttcatcnagcccacanacatggagatagatgaatgcgaggagacgactatgcatggatgtgacaacatcaaggagaaaatgcccaggaagcaagctcaccctgccccagagggttaacaagaaggacaaaaaatgcccgggcgaacccaaaaaggggcggggcgccaaacgtaagcaaattttctccaggggattggggggggggggggcccttaaaaggggggaggtatcctgggttttccccccccccaacggggaaaaaaaaagtaaaacccccccccagggggggaaggtctcttttttcgggggcacaaaaaaaagggcccccgggagagggggggctcttttaactcttgtgggggggaatttccaaagaagggggctccaataataggggg

SEQ ID NO: 49663 - DNA, 765 bp, Zea mays
  misc_feature: Ceres CLONE 1460814-F
  misc_feature: Encodes the peptide sequence at SEQ ID NO. 49664
tggagctccccgcggtggcggccgctctagaactagtggatcccccgggctgcaggaattcgcacgagaccattacctagaacatcctaatcgaaaaaccatcacagtacgcacgcacgcaccagcccagcagcagaagcgcccctcggccctcgctcccacaacaagctcaagccagccttctctctctctctgctccaatggcgcgcttccagctcgcagccgtggccatggccatgctcttcgccgcggcggcggcgcaggccccgaccgccaccccgacgccggctcccaaggcgtcccccccgccggcgacgccgccgccgacccccgcgccggagtctccgcccgtgccgcccccgaccatgtcttctccggcacccccgcccgccaccaaggtcccggtcacggcaccccatgcccctaccgcggagtccaccgccaacgctccaaatgcagacgtggaatctgaggccatctcacaaaaaggtggtgaacctgcggccaccttggaggcaacacgaggcgaaaccgaagagccgaccattgcagcacctgctaatgaatatacggggcacgaagctgctccccaccaaaaccgtgcaaaaaaacaccacttttgcctaaggataccttttggcggaattttactctccatggggccctaatgaaattctcttctggaagaagccctgcaaggcttaacctttggtgtagcacctgggccctgccaatatgggccctggactgaaacttaagccccaa

SEQ ID NO: 49664 - protein, 155 aa, Zea mays
  misc_feature: Ceres CLONE 1460814-F
MARFQLAAVAMAMLFAAAAAQAPTATPTPAPKASPPPATPPPTPAPESPPVPPPTMSSPAPPPATKVPVTAPHAPTAESTANAPNADVESEAISQKGGEPAATLEATRGETEEPTIAAPANEYTGHEAAPHQNRAKKHHFCLRIPFGGILLSMGP

SEQ ID NO: 49665 - DNA, 730 bp, Zea mays
  misc_feature: Ceres CLONE 1460816-F
  misc_feature: Encodes the peptide sequence at SEQ ID NO. 49666
agtggatcccccgggctgcaggaattcgcacgagaccattacctagaacatcctaatcgaaaactccctcttcatccaccatgctgagggtcgcgggcaggcgcctctcgtccgctctcgcctggcgccccgccgccgccgcctcaggctcccggggccctctcgccggtacactacccggccgcgacgacgacgacacacgcgactgcagggcgcgtttcgccatcgaatctcccttcttcgccgctgccagagggttttcagcagagactcttgctccaagaaaccaggatgtgggcttatctgagctcccagcaactgtggcagctgtgaagaatccaagtggaaaaatcgtgtatgatgagtataaccatgacccctacccacctggagaccccagcaagcgtgcatttgcctactttgtgctgagtggtgggaggttcattttacgcatctttgctgcgacttcctcgtcttaaaatttgtcctaagcatgtcagcaagtaaggaatgtctcgcgcttgcctcactggaggtggaacctctcagcattgaacctggaaccacggggaccgtgaaggggcgtggcaagccggtcttcataggggggagaaagaagatgatatccaggtggccaacagtgttgaacgtccctcccccccgccaccaaaagcaagatgcaaagccccgccaaaaacccggaatgggtgggccgtctttgggggtcggc

SEQ ID NO: 49666 - protein, 132 aa, Zea mays
  misc_feature: Ceres CLONE 1460816-F
  misc_feature: SWISSPROT Homolog: EC 1.10.2.2 Ubiquinol--cytochrome-c reductase
MLRVAGRRLSSALAWRPAAAASGSRGPLAGTLPGRDDDDTRDCRARFAIESPFFAAARGFSAETLAPRNQDVGLSELPATVAAVKNPSGKIVYDEYNHDPYPPGDPSKRAFAYFVLSGGRFILRIFAATSSS

SEQ ID NO: 49667 - DNA, 798 bp, Zea mays
  misc_feature: Ceres CLONE 1460820-F
  misc_feature (376)..(376): n is a, c, t, g, unknown, or other
aaagctggagctccccgcggtggcggccgctctagaactagtggatcccccgggctgcaggaattcgcacgagaccattacctagaacatcctaatcgaaaagcaaatgcttggcgaaaataaaccctggaaattcgtgcaagcaaaaggatccgtgcaagcagaagaaagtatggaggttccagaatacagtctcggaggccctcgaggacatcacagctctatactatgacgaagatcgtgacgagatctacactggcaaccggcatggccttgtccatgtgtggtcgaactgaaagccgaaatagtggcggctttcacccacagcatggtgatcttcacctgtatgtgtattaacagcttgtagttgatatgncaagggggcacgaagacggcccccccagcctccaggtacggacctgatgcttcattgttgaggcaattcttatttatcccccccggcgtggcaagaagctcttccccccatagggccccctttcaaaaaacagaaacccccccccccccgaatttgttgttaggaattgacaatccgttgtgcgtttttaaataagggcagggggtgattaattttttggttgatgattgggaatggtcaattatggccctacacctcactcgcgagagtcccagagggcacggaagtcccctttggcgcgcacggaaatacccacgcgtgcggttctggcagataaagtaaaaaaagggtttgttagatatcgtgcgatcttggcgaagcgctcccgcaaccccaactacgccccctgaggaggcggaaat

SEQ ID NO: 49668 - DNA, 793 bp, Zea mays
  misc_feature: Ceres CLONE 1460822-F
  misc_feature: Encodes the peptide sequence at SEQ ID NO. 49669
  misc_feature (426)..(426): n is a, c, t, g, unknown, or other
  misc_feature (428)..(428): n is a, c, t, g, unknown, or other
  misc_feature (431)..(431): n is a, c, t, g, unknown, or other
  misc_feature (433)..(433): n is a, c, t, g, unknown, or other
  misc_feature (436)..(436): n is a, c, t, g, unknown, or other
ggagctccccgcggtggcggccgctctagaactagtggatcccccgggctgcaggaattcgcacgagaccattacctagaacatcctaatcgaaaaaagcatactattagacataccggtatatattattgttcttagtcatcgcacaagactcttgtcaacaagaccaacaacaggatgaggactgccgtgcatgctgcgctttgcattgtgcttgtgataatgtcttcaacactgtcatcttgcgaggacgatgagaaggcatctatcgcatgtgacccaggatgcaatgccgcgatctcccgtctcaaatgcttcctgatggcctattcagaaggaaaagtgttggtcatcatcatctgcgaaatgttgaccagggggggttgcatgtttcgtaataaaaaaaacggaaccttcccccccccnanaanantgnaaacaaaaaacgaaaaattgaaggcctaacccgacattccttggttcgaacaatatacccttgccatcatttcacattggcaccccaccaacggaaataactcataagggaaatcccttcaccgacagggcatcctaacttgggcccggttttacgaaacaatacacttcccgaccgcgccatcaatcaaaatagaaaaaaaccctctaccataccccctgcaactcccgagaggcggggccccgatccccattatccctctgaagggggctagcaaatcgaactactcctccgtcgactgtgtgtcgtgactcgacacacacaccctcaaatatctgctctcggtcccctgctttg

SEQ ID NO: 49669 - protein, 95 aa, Zea mays
  misc_feature: Ceres CLONE 1460822-F
  misc_feature (84)..(84): Xaa is any aa, unknown, or other
  misc_feature (85)..(85): Xaa is any aa, unknown, or other
  misc_feature (86)..(86): Xaa is any aa, unknown, or other
  misc_feature (87)..(87): Xaa is any aa, unknown, or other
MRTAVHAALCIVLVIMSSTLSSCEDDEKASIACDPGCNAAISRLKCFLMAYSEGKVLVIIICEMLTRGGCMFRNKKNGTFPPPXXXXTKNEKLKA

SEQ ID NO: 49670 - DNA, 680 bp, Zea mays
  misc_feature: Ceres CLONE 1460823-F
  misc_feature (680)..(680): n is a, c, t, g, unknown, or other
cccccgggctgcaggaattcgcacgagaccattacctagaacatcctaatcgaaaaatatcgtcacgtatccggattcctgaatccaccgttcacatcgtcatgatgcagatggaggtgctggcggactccaccatgttttccggggacgtgtgggcggagctccgcctggccgacgcccgctaggtgcagcacatcctccgcctcggacacgataggggccacttctatctgctcatcgacctcttgcgcacctcggaagagctcctcatgtccacgctcttcgcatcggcgatgccgcctcccttgacctccttgacagtcgtcgtacataacatatcctcctcccccatcctcacggactcctctttgttcatcgcctcccgccgcctggagctcttcgcgtccccgctcgcagaccaggaggccgccattttcgcctccccgcgcggcggcggacgcgtcacagccggggtcgtgatgggcttcctaaatacttcaccatcctctccaagccctggctggacgccgaggacctcctggggacggcaccctgggggcgccggagtgctttggccggattatgctagttgggcgacggccgctagggaacgaaaaaactcggaaatgggcccaggtcgtagtagctgcgtttgctcgcacaaggaatgaaaaaccctn

SEQ ID NO: 49671 - DNA, 690 bp, Zea mays
  misc_feature: Ceres CLONE 1460824-F
  misc_feature: Encodes the peptide sequence at SEQ ID NO. 49672
  misc_feature (433)..(433): n is a, c, t, g, unknown, or other
aagctggagctccccgcggtggcggccgctctagaactagtggatcccccgggctgcaggaattcgcacgagaccattacctagaacatcctaatcgaaaaatcaagccattcgtccctgtggaagtttccacactcccttcccttcccttgtacccactccaatggcgccctccctcctggccgccgtctccgcctcgcccttcctcctacccggcagcagcggcatcagccgcaggccactgggcgctgccccaacccgccgggccggactgcgcgtggccgcgcttaagtacgaccctgctaaggtggcaccgcagaacgaccgggtgctcgtccgtcttcagcagatccctgagaaatctgctggtggtgtattgctaccgaaatctgctgttaagtttgagaggtatctgatgggtgagattctatcngttggtgctgatgttagtgaaagtgaggctgggaaagaggttctcttctcagacatcaatgcttacgaagtggacccttgataccgaatgaaaagcactggcttctggccgggaatcaaaatttggtaactgaaacccaatggatttttcccctgaaaattaaagaactaacctggcccagggcccaaatgggaggggaattttcttggcccccactttgtttttaccttgaaaccccgcctccaaaaaaaagagga

SEQ ID NO: 49672 - protein, 116 aa, Zea mays
  misc_feature: Ceres CLONE 1460824-F
  misc_feature (48)..(116): Pfam Name: Cpn10 Pfam Description: Chaperonin 10 Kd subunit
MAPSLLAAVSASPFLLPGSSGISRRPLGAAPTRRAGLRVAALKYDPAKVAPQNDRVLVRLQQIPEKSAGGVLLPKSAVKFERYLMGEILSVGADVSESEAGKEVLFSDINAYEVDP

SEQ ID NO: 49673 - DNA, 910 bp, Zea mays
  misc_feature: Ceres CLONE 1460825-F
  misc_feature (19)..(19): n is a, c, t, g, unknown, or other
  misc_feature (21)..(21): n is a, c, t, g, unknown, or other
  misc_feature (36)..(36): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
ggttttgccttttttttcnanaggtataaaagacancctccgtgngggggtnnaaaagctggagctccaccgcggtggcggccgctctagaactagtggatcccccgggctgcaggaattcccacgagaccattacctagaacatcctaatcgaaaacgaggcccgtgtatcagactttgggacttgcaaagcttttagaggatgaagaatcccatattactacaatagttgctggaacatttggctaccttgctcccgagtatatggcaattgggcttagccctccgaataaggactgatgttcacggttttgggggtgttgggtccggggaaataggtccggggcaagccggccctcctggaagctttcttcattgtggagggggacttaaccctttgggcggcagggtcgggagtgattcttgggggtgcggaacaacccggggtaatggttgtatttttcccccggagccggcccctggtgttaaaacaaatgtatttaattgctcccaccccttgtgtggtgggggcgtgggttgtcctggcccgctggcgtcaaacgtctgggggggaatggactttgcgcgtgtcctcccacataaagaaatgtgtcgttgccctaacaccagcggtgctacttgcgggaggcgggagagtctgcgctcgctccggcgacaagcgccgtgctgttcttcgtttttctccccccccgcggtcggcttttctattgaggggcggatgttattggaatatcttacaaaactgactgaatttcttcacgaggggtacgccgtgggtctttgttccgcggcgggggcgatgatagtgattagggtggtggaggtggtgggggctcgcgcgggcggttgttttgttggggtggaacacatctaagattcatcgagcggg

SEQ ID NO: 49674 - DNA, 809 bp, Zea mays
  misc_feature: Ceres CLONE 1460839-F
  misc_feature: Encodes the peptide sequence at SEQ ID NO. 49675
  misc_feature (11)..(11): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (23)..(23): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tgttggcgccncntnnnttctgntcgggtgggtcccntnnctcctcnnnnccaaaactggagctccccgcggtggcggccgctctatactagtggatcccccgggctgcaggaattcgcacgagaccattacctagaacatcctaatcgaaaagtgtaggaataggagcaggagatagcgcgggcggggaggggaaggagacaagtgaactcagagaagaactagcgcggcgggcgagcattgcaagccgagctgcaggggcccggagcggagaccggaggagggagacgtcgcttgcgatgtcaccggcagcatccgccgccgaaaccgccgtcgtcgtcgtcgtcgcaagcgtcccgagccagcagcagagcagccaccgcgccgcggcgccgtccgtcccgtcgtccatacgccgtctgggagaaggagcggtaaggcggctgcagctttacaacgtcaacctcatcgtctgccacctgcctactgttgctgctgctgcatgggaaggaaaaacgaacggacagggggaaggcatggaggcggaggccgccaacttgcgagggctggcgggttcacggaggagtgcacgcccgccctacatcgccggatggtgcccgcccctattacgtggggcccccgggtccggcttccttctgccgcctgaagctgccgggtctaccaagatcctggccgcgagggggatcctttctcctccggctcggagggtgtctcccacccgccccactttctcctttttgagggggggttcacccttctaccctgcccgttagtgcgcgtccccgccg

SEQ ID NO: 49675 - protein, 164 aa, Zea mays
  misc_feature: Ceres CLONE 1460839-F
MSPAASAAETAVVVVVASVPSQQQSSHRAAAPSVPSSIRRLGEGAVRRLQLYNVNLIVCHLPTVAAAAWEGKTNGQGEGMEAEAANLRGLAGSRRSARPPYIAGWCPPLLRGAPGSGFLLPPEAAGSTKILAARGILSPPARRVSPTRPTFSFLRGGSPFYPAR

SEQ ID NO: 49676 - DNA, 700 bp, Zea mays
  misc_feature: Ceres CLONE 1460841-F
  misc_feature: Encodes the peptide sequence at SEQ ID NO. 49677
ggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagttgcgtggcatggcatgctctgagtctgaaatgatgatgattgctgatggcggcttccctgtcctcccctggccttctggggccccttctggccaacaatggttttgtgttgggtgggttgcccacgcctaacaggctaacccttggcccctgttgggtttggcccccatcccttctttaacttt

SEQ ID NO: 49677 - protein, 82 aa, Zea mays; identical to SEQ ID NO: 43085
  misc_feature: Ceres CLONE 1460841-F
  misc_feature (1)..(80): Pfam Name: Metallothio_2 Pfam Description: Metallothionein

SEQ ID NO: 49678 - DNA, 687 bp, Zea mays
  misc_feature: Ceres CLONE 1460847-F
  misc_feature: Encodes the peptide sequence at SEQ ID NO. 49679
aaagctggagctccccgcggtggcggccgctctataactagtggatcccccgggctgcaggaattcgcacgagaccattacctagaacatcctaatcgaaaagccatcagatcgggagactcactcactcgggagtcgggtcctcctcgactcagctcctccacaaacaaagccaaagccaccaccatcccaacccaaacacatcggccgaccacgggcgccgccatgtccaccgctgacgcggcgagcccggccctggcgccggacggggacgcgccggcgggcgaaggcctggccctggcccagttcgccgcgggctgcttctggagcgtggagctggtgtatcagcgcctcccaggcgtggcgcgcacggaggtggggtactcgcagggccaccgccacgcccccacctaccgcgacgtctgcggcaacggcacgggccacgccgaggtggtccgcgtgcactacgaccccaacgcctgcccctacggcgtcctcctcgacgtcttctgggccaagcacaaccccaccacgctcaacagacagggcaacgacgtcgggacacagtaccggtcgggcatctactactacacggcagagcaggagacgctggcgcgcgagtcgctggcggcgaagcagaaggagtggcaggacgcgatcgtcaccgaggtcctgccggcgcggcgg

SEQ ID NO: 49679 - protein, 154 aa, Zea mays
  misc_feature: Ceres CLONE 1460847-F
  misc_feature (24)..(154): Pfam Name: PMSR Pfam Description: Peptide methionine sulfoxide reductase
  misc_feature: SWISSPROT Homolog: EC 1.8.4.11 Peptide-methionine-(S)-S-oxide reductase
MSTADAASPALAPDGDAPAGEGLALAQFAAGCFWSVELVYQRLPGVARTEVGYSQGHRHAPTYRDVCGNGTGHAEVVRVHYDPNACPYGVLLDVFWAKHNPTTLNRQGNDVGTQYRSGIYYYTAEQETLARESLAAKQKEWQDAIVTEVLPARR

SEQ ID NO: 49680 - DNA, 728 bp, Zea mays
  misc_feature: Ceres CLONE 1460849-F
  misc_feature: Encodes the peptide sequence at SEQ ID NO. 49681
ctggagctccccgcggtggcggccgctctagaactagtggatcccccgggctgcaggaattcgcacgagaccattacctagaacatcctaatcgaaaaatcaaccgcagtacacggcgtatcattcccagcgaccacgagagactagctagccaagtgcatgcaaccagccatgcaggccgggaagacggcagtggaggcgacgaaggaggccgcggccaacgtcggggcctcggcgaacgccggcatgcagaagacccgtgccgccgtgcaaggccaggtggagaaggccacggcgcgcaacgcgtcggacaaggtcgcggccgaggagcgccagcggtagcgcgtgcgcgccgcggagctggagaagcatgacgccgtgcgcgccacgcgggccgcgaaggacgcgccattgggcgcgcggccacgtaccaagcaccgcacccgtcccagggcgcgcccgggatcagcgcccaccaggaatatggcggcggaaaatcccccccgcgggggggcacttcaaggccgggttcggaaaaacccttcccgtccttaggggcacccggaaggggggggcccaagcccggaaaaacccggttttggggggggagatttccccagggggcggggcccccggggaaataacccagagggggtctcccccgggaaacccccccccaagggagaaatatttggtgggaggaaaaaagcccccccccaaagcccccc

SEQ ID NO: 49681 - protein, 56 aa, Zea mays
  misc_feature: Ceres CLONE 1460849-F
MQAGKTAVEATKEAAANVGASANAGMQKTRAAVQGQVEKATARNASDKVAAEERQR

SEQ ID NO: 49682 - DNA, 831 bp, Zea mays
  misc_feature: Ceres CLONE 1460852-F
  misc_feature (9)..(9): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (51)..(51): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (831)..(831): n is a, c, t, g, unknown, or other
gtgggggcncgttccccccctcccagcttcgaggcttntttcnnntnnttntnnnnccaaagctggagctccaccgcggtggcggccgctctagaactagtggatcccccgggctgcaggaattcgcacgagaccattacctagaacatcctaatcgaaaaatcctccctcggcgtcaaagcggagtcggggagctcgagctcaacagggcacctggggcccaggagacctttttcagaatctggcctgacggcgtccagaggggactcatggagcgaggtcatgaacgggtccgtgaagaagggctccgacgtgcgaggtgggaacggccggatgtcgcagaagtcggtgcgcgagcagggctactgcgactcggtacggcagcggcctgtcttcgccgggtgtcggggactacatcgtcggccgggcccgggcgccggcgagggccaaccaacttaaaaaaatcatcctcgcgcagtgggatgcaaggagatttgggtgcgtgacgggtgccttggggctagggagcgcccgactgcatgccgaggactgaatgttgacccagctgcttcctggcgggggatttgtggttcgatgggagagccggactctccccgggggactcgttggcgaggggggggggggattccctgaccgggtccccttggagcggcggtggggttgagttggggataaaacattggccaccgacggacgcggaattctctacgaacactctaaaacaataagtctcacgcgatggagggattgggaacttccccggtgtggttgaatatggggcgtgctagggggagacgtgcggacctttcn

SEQ ID NO: 49683 - DNA, 701 bp, Zea mays
  misc_feature: Ceres CLONE 1460857-F
  misc_feature: Encodes the peptide sequence at SEQ ID NO. 49684
ctggagctccccgcggtggcggccgctctagaactagtggatcccccgggctgcaggaattcgcacgagaccattacctagaacatcctaatcgaaaaccaatcgcgccgccgctcgagcccctctcgcccttcgcgccgccgccgctgcaggcaaccgtcgccgccgtcgccgccgtcgccggagctaaacccctcgcctgacgccatggggcgcatgcacagccgcggaaagggtatctcgtcgtcggcgctgccgtacaagaggactcccccgagctgggtcaagaccgccgtcgctgatgtcgacgagttgatcacgaaggctgcgaagaagggtcagatgccctcgcagatcggtgttctgctccgtgaccagcacggtatcccccttgtgaagagcgttaccggaagcaagatcctccgcatcctcaaggctcatggcctggcgccggaaatcccagaggatctgtactttttgattaagaaggctgtggccattaggaagcatcttgagaggaacaggaaggacaaggactccaaattcaggctcattcttgttgagagcaggatccaccgtcttgcccgttactacaagcgcaccaagaagctcccgcccacctggaagtacgagtctaccactgccagcactctggtggcttaggagggctcttcatctggtgtgctcttaccggcttcagg

SEQ ID NO: 49684 - protein, 151 aa, Zea mays
  misc_feature: Ceres CLONE 1460857-F
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
MGRMHSRGKGISSSALPYKRTPPSWVKTAVADVDELITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 49685 - DNA, 689 bp, Zea mays
  misc_feature: Ceres CLONE 1460858-F
  misc_feature (371)..(371): n is a, c, t, g, unknown, or other
aagctggagctccccgcggtggcggccgctctagaactagtggatcccccgggctgcaggaattcgcacgagaccattacctagaacatcctaatcgaaaaatttttcgttctatcgaatcctgaaaaaaaaatgacgaggcagttctgaaacagagaagcattgattctgtccgtttgcagatcctccagatcttccacaggaaagtgtaccccgagagcgcggccctggcgcggaacctgaccaagaagagccgcaagcgcggcagcggtgcctaccacaagccggagccggcggcgtccaggctccggtgcctcaaggagcagcgcgcgccggggttcggctgctgcgccagccgggcctcgttcggnggcgccgcctctcccatcgacgacgacgaggaggagctcaacggcagcaagagcggccactggatcaagaccgacgctgaatacttggtgctggagctgtagaatgagaaataacaagagagagagagagagagagatcaggatctgttggctggtcagcatcaagcatatatagtgagtatattgagcataatgcctgcttatgtttctgtgcttgctcttcacagaaaaaaaacccccatcatacatatgtttgttcatgtgattacctgacggatgagttgtacgtgcccgtctatatttctgtataaaggggaa

SEQ ID NO: 49686 - DNA, 715 bp, Zea mays
  misc_feature: Ceres CLONE 1460862-F
  misc_feature: Encodes the peptide sequence at SEQ ID NO. 49687
ggagctccccgcggtggcggccgctctagaactagtggatcccccgggctgcaggaattcgcacgagaccattaccgagaacatactaatcgaaaaatcgaacgcacactcgcactcgcacgtacaccacactagttaccacagacgacgggcgccatgaaagtcccggtgcttctcctcctggtctccctgtgcttctcgctcgcgctcgcgtggcaaacggacacggaatcgggctcaggcaggccgtaccactacggcgaggagagtttccggcactggacgcgctcccggcaaggccggttcagggtgctggaacggttcacccacgagctgctggaggacgccgtcggcaactaccgcgtcgccgagctggaagccgcgccgcgcacgttcctgcagcccagccactacgaccgcgttcttccttcgcgggccccagaaccacagggtcctcgtcggggtaagtgcatgcttgaaaagaagcggccgcttctcggcccccaaaacctcaacggtcccgccccccccggtggggaagggtaaaaaggggaaaaaaaaaaggggatgggccccccgccctccctttccctttaaaaaattaatttgttcccccccggggaagggggaccccccggccctaacggggatttttaaacccccccccccccccccttgggggggaaaaaaaacgtttgttaaaaacataaaaaaa

SEQ ID NO: 49687 - protein, 129 aa, Zea mays
  misc_feature: Ceres CLONE 1460862-F
MKVPVLLLLVSLCFSLALAWQTDTESGSGRPYHYGEESFRHWTRSRQGRFRVLERFTHELLEDAVGNYRVAELEAAPRTFLQPSHYDRVLPSRAPEPQGPRRGKCMLEKKRPLLGPQNLNGPAPPGGEG

SEQ ID NO: 49688 - DNA, 755 bp, Zea mays
  misc_feature: Ceres CLONE 1460867-F
ctggagctccaccgcggtggcggccgctctagaactagtggatcccccgggctgcaggaattcgcacgagaccattacctagaacatcctaatcgaaaaagggggagagaaaatggtgtatttgtaccatataggaggccccatccccgtcgacatggggtcagcggaccgctacgggcgtctgactgggcgcgtcgtcggagcggcactgtgttcccttgcctcgcctgccggtgcctcgtccacctaaatcctcctggaggacggcggccagggcgtcggcggggcttgagactcaaatggcgatgcacagcgcgatgggcccctcaaggcttaggacgtgcatctcctccgactcctcatgatggagatccctctcgcaaggatacccttctcctgcctcatatgggaggtcctcctgaagaaactaatcaatatcatgacttcacctacacagtcacggaacattgtgattgttgtaaactacatcaacctcggatgtgtcttgcactcgtccggagatgaacaaagtgccgttgttgaagtaggccattttggtttcaaggaagatggataactcgcaaaaataaacaaagatcacttttcgattccgtaaagctggagggtgggccaaggttgcctttcaaacgaaaaaggaatgccagataaggaacaggtggtcctcccgattaaaagtggttggctggaaaaacctggcgggttcaaaatttactcccaatagaaaatttgtccct

SEQ ID NO: 49689 - DNA, 750 bp, Zea mays
  misc_feature: Ceres CLONE 1460868-F
aagctggagctccccgcggtggcggccgctctagaactagtggatcccccgggctgcaggaattcgcacgagaccattaactagaacatcctaatcgaaaagatccgacggccgtcgcccccgctcccgacgcatcgtagccgcccagcagccgagaaggaggacggaaggccaccgcgcaattttacgagtcgtcgcacgccccgcgccccgcgcgcggggtgtcgggcaaggtgcccccacgcgcggcggttggcgccgccgtcgtccaccgccgcccgcgtgcgcccaccgccacctgttaccgcctaaggggaacgcctccgttataacccacggcaccatccatgccgtcctccaccaccgcttcaccatccccgccaggcccaccaccaccatggcctctccttcccccgcccgcgcctccggccggcgcgtgccgcccccgtgctggacgaccgacgagaccctcgcgctcgcgcgggcctacaccgcgcgccgcctcgccgtcggccgtgagcacctgacctccgctgactgggccgccgtcgccgcggccgctccgtccaagacggccaggcagtgccgccacaaggtcgaagagctccgccgacgcctccgggtcaaccgccgccgcccggtgccgctcctcgagccatcgacctcctcgagtcccctccccgcccttcttctcaaagtccagtccgaatcacgtcccggtcttcgtgccccccgccccggcggggggta

SEQ ID NO: 49690 - DNA, 814 bp, Zea mays
  misc_feature: Ceres CLONE 1460869-F
  misc_feature: Encodes the peptide sequence at SEQ ID NO. 49691
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (738)..(738): n is a, c, t, g, unknown, or other
  misc_feature (768)..(768): n is a, c, t, g, unknown, or other
tgtgggcctggcgctcttgggtgtgagctccaccacctcgagtannnataaaactggaactccccgcggtggcggccgctctagaacagtggatcccccgggctgcaggaattcgcacgagaccattacctagaacatcctaatcgaaaatcacactcgatcgcagttgatccagtacacaattgcagagagctagaagacacaagaccatggcgtccaagcgactcctcgtgctagctctcctgctcgccgccgttttccttgccgtctcaggagcagctaacgacgaccaagcccaaccgaggaaggacggcggtcgataacaaagccgacgtgcaggactaccgttgccggccggcggcgtgctggcgctggtggggggtggcttacccccggccgagggctacccccgggcgggggggcgggctaattgttggagggcacaccgccatccggttaactggaaagggggggggttgtttgcccccccggtgggggttcctatgggcggtcttgcccggcgcccggctccggcgacgcctgaacgcaaagtgttaccgtgaaaagcccataggaaagatgcgccctgggattcctccagcgggagggggttcccactagaggttgaggagccccgaacgctcgcagccacggtcggatttatatcgcagtaagtgatggccttggggccagcaccccgaaagcgccacttagacctctgagcgcgcacgactctgnacacactccgggcgcgcctgtccgcaggtntattgtattgtaatggggggttctcgccctttctctgtcgggtgcg

SEQ ID NO: 49691 - protein, 37 aa, Zea mays
  misc_feature: Ceres CLONE 1460869-F
MASKRLLVLALLLAAVFLAVSGAANDDQAQPRKDGGR

SEQ ID NO: 49692 - DNA, 782 bp, Zea mays
  misc_feature: Ceres CLONE 1460874-F
  misc_feature: Translation starting site: 189
  misc_feature (380)..(380): n is a, c, t, g, unknown, or other
ctggagctccccgcggtggcggccgctctagaactagtggatcccccgggctgcaggaattcgcacgagaccattacctagaacatcctaatcgaaaaagtagcatccatttgattgttctatcctcttctctgttctcacccccttgcaagcaacaatcgttcaccgatcgatccagtgcgtcctgcatggaaactgccgccgtcgccgcctccagtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcaggntacatgatgacctcggacgtgctggcaagcgttgagaggcacgccaaacgcgtctcgggcggcggcggtcgacaaggccaaagcgcgtctgcgccgaccacccgcacgtcaagggtggagaccaacgtggaaaagcggggacccggggggacttcatctgcgacccagccaaaaaatggccccggacctgctcctcatgggcagccatggttaccggttcctccaaaaggggttttttgggaaggttaaaaacccttggggggaaaaaatggaaatgcccgggccccttgtgtaaaaaggcccaagggaaaaaagtgcccccccatgaaacccgcccctttaccaaaaaggtttttgggggacccttatgggtttttgtcccccctccccccccttgggggg

SEQ ID NO: 49693 - DNA, 809 bp, Zea mays
  misc_feature: Ceres CLONE 1460875-F
  misc_feature: Encodes the peptide sequence at SEQ ID NO. 49694
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (762)..(762): n is a, c, t, g, unknown, or other
tccccgcggtggcggccgctctataactagtggatcccccgggctgcaggaattcgcacgagaccattacctagaacatcctaatcgaaaaatcaagattccgacccaaatccctctccgagctcgaccaaaaaccaccttcccagtacgtacattcccaccacctcccagtgcagcgccagtctgtaacccataaccataaccataccatggtggtcctcaccaagggcgagctggagcagatcgcgctgccggccgtgcagcgcgcatcgccgccgccgccggccgccgtgccggaggacgacctggcagccggggacgccgcccccgccgacagtgcgggggttaagagagtggaggataannnattcttcaaggcaacaggacacaacgggctccccccccccatgagggggctttagtgccgccgtggccacagtgcatcgccgcaccccataccgctaaaaagaacaacggtcgacggaccggccgtttctataactctcaccagcttgactaggcgccaacggttaatttctgatgggtaaaagttctcctcccgccttgcctttaaacacacacagaaacatcttttactacacgtggcctctgccacctgacagacacgaaaccctcctctgttccccgccgcactatacaacttcaacaccacaactgtctttctaatgtcacttggcacacagatactgaagcgaatcgtagtaatagcgcttgttgcggttgtctctcacaacatcccgnagacacaacacaccacacacacactagactcacgtggagacggcgag

SEQ ID NO: 49694 - protein, 70 aa, Zea mays
  misc_feature: Ceres CLONE 1460875-F
  misc_feature (52)..(52): Xaa is any aa, unknown, or other
  misc_feature (53)..(53): Xaa is any aa, unknown, or other
MVVLTKGELEQIALPAVQRASPPPPAAVPEDDLAAGDAAPADSAGVKRVEDXXFFKATGHNGLPPPMRGL

SEQ ID NO: 49695 - DNA, 717 bp, Zea mays
  misc_feature: Ceres CLONE 1460879-F
  misc_feature: Encodes the peptide sequence at SEQ ID NO. 49696
ggagctccccgcggtggcggccgctctagaactagtggatcccccgggctgcaggaattcgcacgagaccatacctagaacatcctaatcgaaaagaacaaacaaaacatttatataaccgcgcttggatcactagctagctctcgctcgtcgcaacaagcgaagagcttggtcgttttggttatggcggtgatgaagagcaagacggtcatcgtcgccgccgttctgttggcggttgtcattctgtcctcgctgtgtccatgctacgaagccggcggctgcatcgggaagccgcccaagacgccggcgccgaaaaggccctgcttctcgccctactccgaggaccactgtgaccgccagaactgccgcttcgactgcatgtcgcacggatacagtgacggtggctggtgtgactagagggaggtgcgcaaaatgtgctgctgctaccattagttagaataataacaatagcagcgtgtagtgttgtgtgctggtgcatgtatatggatcatccatctctgtctgtctgcctgtgtggtgcaatttctgaaataaacgaatctgtttttttttgtttcgatctgctaatagcgctgtatgctctatgtccagtagtgtatctgtgttgagacgcggcggtgtgtatgcttttctctacaggattaggtcccgaggatgtcagaagcaaaacgctcgcgctcggtcatatatatcatt

SEQ ID NO: 49696 - protein, 77 aa, Zea mays
  misc_feature: Ceres CLONE 1460879-F
MAVMKSKTVIVAAVLLAVVILSSLCPCYEAGGCIGKPPKTPAPKRPCFSPYSEDHCDRQNCRFDCMSHGYSDGGWCD

SEQ ID NO: 49697 - DNA, 773 bp, Zea mays
  misc_feature: Ceres CLONE 1460883-F
  misc_feature: Encodes the peptide sequence at SEQ ID NO. 49698
  misc_feature (418)..(418): n is a, c, t, g, unknown, or other
  misc_feature (773)..(773): n is a, c, t, g, unknown, or other
aagctggagctccccgcggtggcggccgctctagaactagtggatcccccgggctgcaggaattcgcacgagaccatacctagaacatcctaatccaaaaaccaagacccactgaaccctcgccgtttcgtcgcacccaccaacacgagagatgagctccggcggcgcggacaagcccggcagtggcggcggcgcggtgaagacgccgtcggacttcctcaagtccatcaggggccgccccgtagtcgtaaagctcaactccggcgtcgactacagaggcatattggcttgtctggatggttatatgaacatcgcaatggaccaaaccgaggagtacgtgaatggccagttgaagaacaagtatggtgatgtcttcataaggggaaacaacgttctgtacattagttttttctaacancccccccccaatggcgcgtaacccgattggagtccctctgccctccccccaagtgcgagccgtgcaacttcaaagccgttagcttcgggtgcgcttcgactctgatgcatcccttctaatctctttaccccccttgtctggaaggtgattgggggtggaagagggtaagtgttccccacgggtttcgtgatctttgccagatgccttttttgatttacctggacattttgtcccccttcccgtggttgtgttattcgccggcgttgtgtttgggggtctaatatgataaataggaaagttttttcgattcctttcaatctcgagggaggggcccggtacccactttctccctatn

SEQ ID NO: 49698 - protein, 87 aa, Zea mays
  misc_feature: Ceres CLONE 1460883-F
  misc_feature (21)..(86): Pfam Name: LSM Pfam Description: LSM domain
MSSGGADKPGSGGGAVKTPSDFLKSIRGRPVVVKLNSGVDYRGILACLDGYMNIAMDQTEEYVNGQLKNKYGDVFIRGNNVLYISFF

SEQ ID NO: 49699 - DNA, 787 bp, Zea mays
  misc_feature: Ceres CLONE 1460884-F
  misc_feature: Encodes the peptide sequence at SEQ ID NO. 49700
  misc_feature (322)..(322): n is a, c, t, g, unknown, or other
  misc_feature (376)..(376): n is a, c, t, g, unknown, or other
  misc_feature (377)..(377): n is a, c, t, g, unknown, or other
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (436)..(436): n is a, c, t, g, unknown, or other
tggagctccccgcggtggcggccgctctagaactagtggatcccccgggctgcaggaattcgcacgagaccattacctagaacatcctaatcgaaaaacacacttcaattacgattattccagataagcacgatccgatgatggccccaccgatatccgccgatgccttggtggaggctgcctcggccgtcgccgcgtacccagccatcgcgccgaacagaatgctttgcaaggacgcgccggcgccggccatctctgtcgtctcgaagcagacggtccggcccgccggcgcgtcggcggcggtcggcagtggagacctcangctctcggtgtcggacatgccgatgctatcgtgccactacatccagaaggggcnntgtcttccgccccgctctccngnnntgctggcggcctccctggtgtcgtcgctcggggngggcctctcccggggggttcgggttttccccggggttcgcgggccgcctttgtacgttccaaaaaaacggttttgggaacggtgggggggggaaaaaccccccctccattttctaccccggggggggtttttctttgtcctctgggaaatttcgggggcccgggcccaattccccacccttttaaaaaaggcctttttccccctggacagaaagggaatatagggggcccccccccccccccaagggttttccacccccggtggggagaagaggtctttttttttttttttcccccacccccccggggggggagacctccttctttggttttttaacgggggggggggggg

SEQ ID NO: 49700 - protein, 172 aa, Zea mays
  misc_feature: Ceres CLONE 1460884-F
  misc_feature (61)..(61): Xaa is any aa, unknown, or other
  misc_feature (79)..(79): Xaa is any aa, unknown, or other
  misc_feature (87)..(87): Xaa is any aa, unknown, or other
  misc_feature (88)..(88): Xaa is any aa, unknown, or other
  misc_feature (99)..(99): Xaa is any aa, unknown, or other
MAPPISADALVEAASAVAAYPAIAPNRMLCKDAPAPAISVVSKQTVRPAGASAAVGSGDLXLSVSDMPMLSCHYIQKGXCLPPRSPXXLAASLVSSLGXGLSRGVRVFPGVRGPPLYVPKKRFWERWGGEKPPLHFLPRGGFFFVLWEISGARAQFPTLLKKAFFPLDRKGI

SEQ ID NO: 49701 - DNA, 804 bp, Zea mays
  misc_feature: Ceres CLONE 1460892-F
  misc_feature: Encodes the peptide sequence at SEQ ID NO. 49702
  misc_feature (326)..(326): n is a, c, t, g, unknown, or other
  misc_feature (396)..(396): n is a, c, t, g, unknown, or other
  misc_feature (615)..(615): n is a, c, t, g, unknown, or other
  misc_feature (678)..(678): n is a, c, t, g, unknown, or other
ggatcccccgggctgcaggaattcgcacgagacattacctagaaatcctaatcgaaaaactaaaaacatcatgggcctcgaactgtccgtctcggaaagggctctcagccatgggaagcccaacgagaactcgggcctaatccgctcacgcacctttctccgtcttcacgaacgaatcacgatcacgggtgccacaactccctgccgatccagtcccccggcaaattcccaaccgccgcacagcaacaccagcggtcggatcgggggagaaacggaagggcaacagcagagcgcgaactcctcagacaaatccaagggttcctaantacggacacacgcccaaactcggatggcggaaggggttcaagataggtttgtaccccccccccccaacancaaaagaaaagtttccccaccacagggggagcgcaatgaacccaatcaagaaaaaaaaaagaaccgcgcccgcttaaaattggaaggcattagggatataaaaagccaccaaacggttaccagaaggcagcgcccgttaaatactctttccgcagagctaataaaaaactctctaaaagtttggaaaaaacctgtcccaccgcggggttttgatataanctgcaacacgataaagaatcccccttgtcctggtggcccccaaaatcccaagagggtaatatntatttctttagatacgatctcttctaaaatatcgtggtactgccgagtctaaagaaaatttgtcgaacaaatgagaaggaggggggttttttgtacaacacccctccacccccctgcccttctcta

SEQ ID NO: 49702 - protein, 126 aa, Zea mays
  misc_feature: Ceres CLONE 1460892-F
  misc_feature (16)..(16): Xaa is any aa, unknown, or other
  misc_feature (89)..(89): Xaa is any aa, unknown, or other
  misc_feature (110)..(110): Xaa is any aa, unknown, or other
MAEGVQDRFVPPPPNXKRKVSPPQGERNEPNQEKKKNRARLKLEGIRDIKSHQTVTRRQRPLNTLSAELIKNSLKVWKKPVPPRGFDIXCNTIKNPPCPGGPQNPKRVIXISLDTISSKISWYCRV

SEQ ID NO: 49703 - DNA, 927 bp, Zea mays
  misc_feature: Ceres CLONE 1460893-F
  misc_feature: Encodes the peptide sequence at SEQ ID NO. 49704
  misc_feature (19)..(19): n is a, c, t, g, unknown, or other
  misc_feature (25)..(25): n is a, c, t, g, unknown, or other
  misc_feature (479)..(479): n is a, c, t, g, unknown, or other
  misc_feature (480)..(480): n is a, c, t, g, unknown, or other
  misc_feature (927)..(927): n is a, c, t, g, unknown, or other
ttttttctccccaccccanaaaaanaaaaaaaacaacccccaacaaaatggaactccccgcggtggcggccgctctataactaatgcatcccccgggctgcaggaattcgcacgagaccattacctataacatcctaatcgaaaaaaaaggagaacagacatctgacaggagcgcggtggcccgggccccggatcctggagggtaggggaagagaagagaagaggcgatggcgtcaatcgggtcctccaacatcggattccagctgctgaagaagtctggtgggaaggagggcactggccttggagcgtatgaccaagtaaggttgtaacctgtacaaactcgcgttaagaataccgagggtggtatctcgttttaaagagccaaaaccacaccctagggtttgaggttgacttttaaattgtgaccccaaaagggtttgggtaaatgaaattttatagaaaaccccacagcctctccnnaaaaataggatgaatttaaactttctataatggagggagaatgttctttcaacacaataagggaattctgagaatgggctttttttttccagggaaaattctttggcacttgtttattgttgtgatagggtgagaagacgtttcgaatgactttgttactattgttagccttgattgcacattgtctcattggataatcgtctggcattgcttatatgcatcttctactttatcgtgttgggcttcttgtaaagattgattcctctccatttacactcgcgagggggttttatatctctcagctgtgatcttcatatggggtctgtgggttctgggttgatttaccctgtgttcctttcctcttgtgctcgggataactatgcctgttctgattataaactttgattccctagcgtttgtctgtatgcgtaagggtgccttccagan

SEQ ID NO: 49704 - protein, 33 aa, Zea mays
  misc_feature: Ceres CLONE 1460893-F
MASIGSSNIGFQLLKKSGGKEGTGLGAYDQVRL

SEQ ID NO: 49705 - DNA, 752 bp, Zea mays
  misc_feature: Ceres CLONE 1460894-F
  misc_feature: Encodes the peptide sequence at SEQ ID NO. 49706
  misc_feature (369)..(369): n is a, c, t, g, unknown, or other
  misc_feature (371)..(371): n is a, c, t, g, unknown, or other
ggagctccccgcggtggcggccgctctagaactagtggatcccccgggctgcaggaattcgcacgagaccattacctagaacatcctaatcgaaaaaactactccggcgctgtcacgcgactctgcttcccgtcccgaactcgacgctggcctgatatatagcattggagtttgttggacctttggtggctagtcccgtccaaaagaatcgcaactcgcaaggcagcagagagcgaaggaggccaaggccatcgctctcctagcctcggagacttgcctttgcatacacatccccccggagggcggtgtgagggcatggctgcaaccgtgaggagggctgcttcctccgtcctctctcgcttcctcctnanaaagccttcgccttcgcctgcttctgccgccggcaataagtcccctctcctcggagcaggggctgctgctcttcacaggttcagcaccgcaccggcatccgcggccgcggccgcagaggagccgatccagcccgcggtggaggtgaagcacacccagctcctcatcaatggcaacttcgtcgacgctgcttctgggaagacgttcccgacgctggacccgcgcaccggcgaggtcatcgcgcgcgttcgcgagggcgacagcgaggacatcgaccgcgccgtggccgccgcccgcagggtcttcgacgagggcccgtggccgaggatgaccgcctacaagcggtgccgcttgctgctgccctcccggacctgatcgagcgg

SEQ ID NO: 49706 - protein, 142 aa, Zea mays
  misc_feature: Ceres CLONE 1460894-F
  misc_feature: SWISSPROT Homolog: EC 1.2.1.3 Aldehyde dehydrogenase (NAD(+))
  misc_feature (19)..(19): Xaa is any aa, unknown, or other
MAATVRRAASSVLSRFLLXKPSPSPASAAGNKSPLLGAGAAALHRFSTAPASAAAAAEEPIQPAVEVKHTQLLINGNFVDAASGKTFPTLDPRTGEVIARVREGDSEDIDRAVAAARRVFDEGPWPRMTAYKRCRLLLPSRT

SEQ ID NO: 49707 - DNA, 783 bp, Zea mays
  misc_feature: Ceres CLONE 1460899-F
  misc_feature: Encodes the peptide sequence at SEQ ID NO. 49708
  misc_feature (387)..(387): n is a, c, t, g, unknown, or other
  misc_feature (397)..(397): n is a, c, t, g, unknown, or other
  misc_feature (584)..(584): n is a, c, t, g, unknown, or other
ggagctccccgcggtggcggccgctctagaactagtggatcccccgggctgcaggaattcgcacgagaccattacctaatcctaatcgaaaagctccatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtctgcggcggtgagctgcagcgaggtgacgtcgtcagaggcgccgtgcctcggggtacgccgatggggcaaacgcggaggtaaacctttccgcggacgntgccttcaanaaggggtggccctttcatttcaacaaacccgcccctttcgttttaacgggggggaacccgaaaagggcccaacttgtcaaacttgccttccaaaaaaccattaaaaggggtccccggtttcggggcggggggggccgtcccagaatttgtggccaaataggcccgcacaaaaaattctccccggganaaaaggggcgggggggtcctccccatatagggggtggggggcccatttagagccccccccccccgttaaaatcgggacccccaaaaaatcacaccctttttttctatgggcgcaccccaaatgggagaaagggagacccttaagccccccctcccaaattgttctccagggggaaaagcgccaggaggggcggcctcaa

SEQ ID NO: 49708 - protein, 100 aa, Zea mays
  misc_feature: Ceres CLONE 1460899-F
  misc_feature (67)..(67): Xaa is any aa, unknown, or other
MAARSSSQQLVAAAVLAAALLLLAAGAGTASAAVSCSEVTSSEAPCLGVRRWGKRGGKPFRGRCLQXGVALSFQQTRPFRFNGGEPEKGPTCQTCLPKNH

SEQ ID NO: 49709 - DNA, 759 bp, Zea mays
  misc_feature: Ceres CLONE 1460902-F
  misc_feature: Encodes the peptide sequence at SEQ ID NO. 49710
ggagctccccgcggtggcggccgctctagaactagtggatcccccgggctgcaggaattcgcacgagaccattacctagtacatcctaatcgaaaacctctgcttctggcgaccaaattctgccgtctccaccgccgccgcagccagcgtcaccggagggatctgccgtctcccttgctccacgcgatgaacaccgacatcaccgcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccgtcaatggtcacgggcggcctcatccgggtcatgggaggccccacgaccccctacaagaactccgccgggcgcctaatgggaattctttcccaacgaccccaaaggttgcgcggcctccagcaacagcttcattgagggatccggttcctttccgtcttttcttttcccaaccggtttcccccggttcttttcccgagatccgggtaaactccgaaacttttctggggacccttaggccctgggtaaaaaaaaaggttttttttttcccccgtaaaaggaacccaaaaaaacctcccccctcttttttttgggggggaaaattcccccccctggggggattttaaaacccggggtttttctcccaaaaaaaaaaaaattttttttccccccgcc

SEQ ID NO: 49710 - protein, 104 aa, Zea mays
  misc_feature: Ceres CLONE 1460902-F
MNTDITASTKPEYPVVDRNPAFTKVVGNFSALDYMRLSTISAVSVTVGYLSGIKPGIRGPSMVTGGLIRVMGGPTTPYKNSAGRLMGILSQRPQRLRGLQQQLH

SEQ ID NO: 49711 - DNA, 769 bp, Zea mays
  misc_feature: Ceres CLONE 1460908-F
  misc_feature (257)..(257): n is a, c, t, g, unknown, or other
  misc_feature (259)..(259): n is a, c, t, g, unknown, or other
  misc_feature (330)..(330): n is a, c, t, g, unknown, or other
  misc_feature (400)..(400): n is a, c, t, g, unknown, or other
  misc_feature (405)..(405): n is a, c, t, g, unknown, or other
  misc_feature (413)..(413): n is a, c, t, g, unknown, or other
  misc_feature (416)..(416): n is a, c, t, g, unknown, or other
  misc_feature (420)..(420): n is a, c, t, g, unknown, or other
tccccgcggtggcggccgctctagaactagtggatcccccgggctgcaggaattcgcacgagaccattacctagaacatcctaatcgaaaaattatctagaacatcctaatcgaaaaccgcattatctctctcggtggttcccccgtccccctcgcgtgcgctctgtgccgacgactgctcggccgccgccgccctacgcgcaggcgcccaggtttccaccttcgccggcgacgagcgcccacaaggaaaacaatgnantggtgggctgctgatggtttgtactacttccggacctgaaaggagctttttacaatggcaccgggaagcancattgtgactgtagtccccgagtcggactgtggagatgacgatgggctttctgagtcgcttgggggtaanacctnttccgccnacncaanaaaaaaaccgtggcctacatcggcatcgctacccaatgttgcattgtcctccctgtgtggcttgaatgatttgctccaatgcccaggggggaccaactccatggccccccctatactccagggcccaaaatggccaccaaaatctgctctaagttgcaagcccaggggtagagaaaccattgcccaaccctgccgccaggaactcgggaaaacctcacggggcctaggctctccgtgaaagggtgcaaaaacaaccctcacgctttccggtgcaagttactcaaaagaccggggattggcccccgagattccccccttttctagaatcgcaactgtgtgcgttgtggtg

SEQ ID NO: 49712 - DNA, 1184 bp, Zea mays
  misc_feature: Ceres CLONE 1460911
  misc_feature: Encodes the peptide sequence at SEQ ID NO. 49713
agccagctatgggccgctattgctcaaaagagtaaaaaaccagaaagcgacagggcagggagccagggcctctccgctcctgctcctgcagtcctgctctctctctctctcttggcgtcgattgggcgaccgccgccacctcccccaggtcttcgctgcgcccgtcgccggtgacgagcacccaccaggttcggaaacattgctgacattcacctgtaccacagtagttcagtagagtagctgtcggactcggaacacacatgccggcgatggcaactgctcctgtgaaattttctgtggctacgaactccccctgtgtccagcctagcttgcccctgaggcgtacacctgccaccatctccttcccctgtcgtccatggtcagccgcaatgacctcatgtactggattgttgaggcgctctgacgtggttgcagctgcggggcaccacaagttgatgggatctttgaccactaacgagggactcaggtttggggtggttgtggcgcggttcaatgaggttgtgacaaatttgttactacagggtgccctggaaactttcgagcgatactctgttaaagaagaaaatataacagttgttagtgttcccggaagctttgaggttcctataacagcacaaaagcttgggaaatctggaaaatttgatgcaattctgtgcattggagctgtgattagaggtgacacaacccactatgatgctgttgcaaactcagctgcatcaggtgtactcaatgctggattatctgctggtgttccttgtgtatttggtgttctaacctgtgaagacatggatcaggcgctaaaccgcgctggtggcaaggctggaaacaagggtgctgaaactgctcttactgccattgagatggcctctctgttccggcatcacttaggctgacactttgcgtatcctggtttctatacacgaggcaagacatcatttcttcctatcaagagtttcggctaatagagcttttccgccgcggctagtataattattttcaattctgttggtccggtgctgattggttgttttctttctgagatttgaaaagctcacgagacatgtttgtaaacctggcacaatgaataattgtcaccatgaacaaaatatggtcatgaataaggttgcacacttcatgaattgagaccaaaaaaaaaaaaaaaa

SEQ ID NO: 49713 - protein, 217 aa, Zea mays
  misc_feature: Ceres CLONE 1460911
  misc_feature (72)..(215): Pfam Name: DMRL_synthase Pfam Description: 6,7-dimethyl-8-ribityllumazine synthase
  misc_feature: SWISSPROT Homolog: EC 2.5.1.9 Riboflavin synthase
MPAMATAPVKFSVATNSPCVQPSLPLRRTPATISFPCRPWSAAMTSCTGLLRRSDVVAAAGHHKLMGSLTTNEGLRFGVVVARFNEVVTNLLLQGALETFERYSVKEENITVVSVPGSFEVPITAQKLGKSGKFDAILCIGAVIRGDTTHYDAVANSAASGVLNAGLSAGVPCVFGVLTCEDMDQALNRAGGKAGNKGAETALTAIEMASLFRHHLG

SEQ ID NO: 49714 - DNA, 761 bp, Zea mays
  misc_feature: Ceres CLONE 1460913-F
  misc_feature (524)..(524): n is a, c, t, g, unknown, or other
  misc_feature (635)..(635): n is a, c, t, g, unknown, or other
  misc_feature (671)..(671): n is a, c, t, g, unknown, or other
ggagctccccgcggtggcggccgctctagaactagtggatcccccgggctgcaggaattcgcacgagaccattacctagaacatcctaatcgaaaaatacctttctcggccttttggctaagatcaagtgtagtatctgttcttatcagtttaatatctgatatgtggaccatgtgttcactttgatattaaatttattttttgtgggggagggctcgctacagtggcttgctactggggccctcaagcgtcgctcggccgttgcactataggctgagcctggcgcgccccaaccaatgcaatttcagctttaagtatgtctttagactatacgaaatgtatggttccatatcaataaatttggtcgtaagtaatgaagaagctaatatcgcccatatttagtcatcaagcagcatgccggtctagcagcatgtccctgtgctgcccggacctggtggaggccgctctcgccacgagcaggagagacccgccggttcaggtacaggcaaacgacaacaccatgnacgcctatgacgggtcgggcagagaccataacatctgagagctttcgtctactgtataaataaaccattatcagctaaaactccattgaatcgtcttagataggtactgcntggaaaagtgccataccaaataaaaatcattgatangtataatgtgtgagggtcgaacgtgtcacgggcgatagaagcagcaagctaagctgtcacagcttttcatcgaacaccttgtatgcatga

SEQ ID NO: 49715 - DNA, 742 bp, Zea mays
  misc_feature: Ceres CLONE 1460916-F
  misc_feature: Encodes the peptide sequence at SEQ ID NO. 49716
  misc_feature (649)..(649): n is a, c, t, g, unknown, or other
  misc_feature (673)..(673): n is a, c, t, g, unknown, or other
aagctggagctccccgcggtggcggccgctctagaactagtggatcccccgggctgcaggaattcgcacgagaccattacctagaacatcctaatcgaaaaattccgcctccacccccgaactccaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctgggcacaggtactgcctcctcggccagctctccaaggaggtcggatggaactacgccgacaccatcagggagctggnagaaaagaggaaggagaaggccanggtctcctacgacaggagaaaagcactggcccagctccgcgtcaaggccgagaagcagccgaaggagat

SEQ ID NO: 49716 - protein, 192 aa, Zea mays
  misc_feature: Ceres CLONE 1460916-F
  misc_feature (11)..(127): Pfam Name: Ribosomal_L13 Pfam Description: Ribosomal protein L13
  misc_feature (162)..(162): Xaa is any aa, unknown, or other
  misc_feature (170)..(170): Xaa is any aa, unknown, or other
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVIPDALKVLRLQPGHRYCLLGQLSKEVGWNYADTIRELXEKRKEKAXVSYDRRKALAQLRVKAEKQPKE

SEQ ID NO: 49717 - DNA, 745 bp, Zea mays
  misc_feature: Ceres CLONE 1460920-F
  misc_feature: Encodes the peptide sequence at SEQ ID NO. 49718
  misc_feature (579)..(579): n is a, c, t, g, unknown, or other
  misc_feature (610)..(610): n is a, c, t, g, unknown, or other
  misc_feature (611)..(611): n is a, c, t, g, unknown, or other
  misc_feature (679)..(679): n is a, c, t, g, unknown, or other
tggagctccccgcggtggcggccgctctagaactagtggatcccccgggctgcaggaattcgcacgagaccattacctagaacatcataatcgaaaaatcatcactgccatctctctctgactctgtgtccgtctctaaactctagtctgtgcgaatctgctgccagcagcgaggaacagaacagtagccaatttgccatctcacagttgcgttcctccgattccccgtcccccgatggacctgtctcccagctcgtcggcgccatccgcgccgccggtgccgtgcgagtggtccggcgccgggctcggctccgcggcgtgcggcctcgcctgcagggtgctctgcgccgtcgccacctgcgtcttcgcggccgtggggtcgctggtcggggcggtgacggggtccatggtggggctggcgaccgagagcgggatgctgcgcggcgccggcatcggggccatctccggcgccgtcttctccatcgaggtcgccgagtcgtcccgcgacctctggcactcgggcgactccggcgtctggaccctcctctacatggtggacatcatctccagtctcttgancggcaggctggtccgggagaaggtggggccnngctgtcagagcgccgtgcagagccagatcagcgccatcagctcgccgttcgagagacgagcgacctgntcgagaccgcagcgtgaagggcctccccgagcccgcgtgcgcggctgcccgaacagtggtccgaaa

SEQ ID NO: 49718 - protein, 170 aa, Zea mays
  misc_feature: Ceres CLONE 1460920-F
  misc_feature (115)..(115): Xaa is any aa, unknown, or other
  misc_feature (126)..(126): Xaa is any aa, unknown, or other
  misc_feature (148)..(148): Xaa is any aa, unknown, or other
MDLSPSSSAPSAPPVPCEWSGAGLGSAACGLACRVLCAVATCVFAAVGSLVGAVTGSMVGLATESGMLRGAGIGAISGAVFSIEVAESSRDLWHSGDSGVWTLLYMVDIISSLLXGRLVREKVGPXCQSAVQSQISAISSPFERRATXSRPQREGPPRARVRGCPNSGPK

SEQ ID NO: 49719 - DNA, 765 bp, Zea mays
  misc_feature: Ceres CLONE 1460931-F
  misc_feature: Encodes the peptide sequence at SEQ ID NO. 49720
  misc_feature (319)..(319): n is a, c, t, g, unknown, or other
ctggagctccccgcggtggcggccgctctagaactagtggatcccccgggctgcaggaattcgcacgagaccattacctagaacatcctaatcgaaaaagagtccagaccatagcctgcagccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaactacaaggtgttctaccccaccatgtacgccatcgagtcggagaacaaggacgccnagctctttcactgcgtgcagagggggcaccagaactctctagagtggatgcccgtttttctcggcatactgctgctggggggtctgcaacaccgaacatcggcgccggtctggccgcttctaactcgtcccgaggttcttctactcaaggaatacccacccgggtttcggaaaaccgtctccaaatggggggctcaacatttgggggtgttgggctaaatatttgcaagatttttttgggaaaaccttggtcccagggaaaagcccaaacttttgggttaaaaggaacccccgggggggtaacccccaaatttccctgggggggaaaaaaaaattttgtaaaacacaccgttgggggtttaaagagagaaaatcccttttttttttgtgggggggggaaaaaaaaaaaaaaggggggcccgcccttatatggggggaataaaaaaa

SEQ ID NO: 49720 - protein, 128 aa, Zea mays
  misc_feature: Ceres CLONE 1460931-F
  misc_feature (9)..(128): Pfam Name: MAPEG Pfam Description: MAPEG family
  misc_feature: SWISSPROT Homolog: EC 2.5.1.18 Glutathione transferase
  misc_feature (57)..(57): Xaa is any aa, unknown, or other
MAVSIELTKEYGYVVLVLVAYVFLNLWMGFQVGKARRNYKVFYPTMYAIESENKDAXLFHCVQRGHQNSLEWMPVFLGILLLGGLQHRTSAPVWPLLTRPEVLLLKEYPPGFRKTVSKWGAQHLGVLG

SEQ ID NO: 49721 - DNA, 745 bp, Zea mays
  misc_feature: Ceres CLONE 1460938-F
  misc_feature (400)..(400): n is a, c, t, g, unknown, or other
  misc_feature (412)..(412): n is a, c, t, g, unknown, or other
  misc_feature (413)..(413): n is a, c, t, g, unknown, or other
  misc_feature (618)..(618): n is a, c, t, g, unknown, or other
accgctggagctccccgcggtggcggccgctctagaactagtggatcccccgggctgcaggaattcgcacgagaccattacctagaacatcctaatcgaaaaaagaacccccatctctcgattcctccaacaaattcccctttcccttactccccatccccacccacccacgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgagacaacgtcaagaagagcgccgaccaggccgtcgaccgctacatcgagaatgacatcgacccgagcggggggggaggctctctaccacntctgcatcgaanncacaatcttctcctacttcatcaatctgccctgggagcgcgcccacctcgcccacctcgaggaaatggagaggaccggtgggaataactaaatccgctgccccgcccctcgccgggagggcgggaagaccgggtgactttcaggggggccattcggggggaagggcacggggttccttcggctgatgagccactggggccagggnacttcggggcgtggggggttggaccccgacgagaagaaacggcccagtttaagcggcgggctcctcgcggggggggcaaacgcagatgcgggagaccggggggcaggtactcgcgataaaaaaggct

SEQ ID NO: 49722 - DNA, 731 bp, Zea mays
  misc_feature: Ceres CLONE 1460953-F
  misc_feature: Encodes the peptide sequence at SEQ ID NO. 49723
ggagctccccgcggtggcggccgctctagaactagtggatcccccgggctgcaggaattcgcacgagaccattacctagaacatcctaatcgaaaaatcacactcgatcgcagtttgcagaaagctagaagacacaagaacatggcgtccaagcgactcctcgtgctagtagctctcctgctcgccgccgttttccttgccgtctcaggagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggcggctgccggtgctgctcgcgcgccgacgaggtcccggagcccatgtaccgcccggagcccaccgaggtccacaactgaagccgagccacacatcgatctacaaagatgcatggacgacgactcttatcttagctaattaataagcactacatccatgcatgtccacaatagggccctagccctactatactatacgtcgtcagcagaaaagctggttttgatttcataatagatgcacctatatgtgtgtgtacatgtacgccgttgtcttaaaaaaaaaaaaaaaagctatcgatacgtcgaactcgagggggggc

SEQ ID NO: 49723 - protein, 116 aa, Zea mays; identical to SEQ ID NO: 40624
  misc_feature: Ceres CLONE 1460953-F
  misc_feature (1)..(93): Pfam Name: GRP Pfam Description: Glycine rich protein family

SEQ ID NO: 49724 - DNA, 868 bp, Zea mays
  misc_feature: Ceres CLONE 1460954-F
  misc_feature: Encodes the peptide sequence at SEQ ID NO. 49725
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
tgtatattgttcttcatgattgtggtttggtgggtgnagaggcnnnnccgaaagcggagactccccgcggaggcggccgctctagatatagtggatcccccgggctgcaggaattcgcacgagaccattacctagaacatcctaatcgaaaacttttatcagtagtagtcatcactgagtagactgcagagcaggagaagatgttcacttacgtgctcgcggccgccgccgtgcttatcgtgttcctctacctcatcggctgcgtcgcgcaccgctccttgcgagagctgcaaattcgccatggcgggagcggcggcctcctctatctgcagctcgggcgcaggcggactttggcggtgtcggacctgttcaggaaccacgacctcgccttcgcctcccgcccgcagagcgtgtcgttcgcgccatatggcaggagctggctccggggcaagagcaccacagtccacctcctctcccggcggccgcggggagttctttcgccgctcttggcgggccgccgaaggtattcaggggtttaatcgggatactcgtccgccgcccatgatatggcttgtcgatagccccgttgtaatcttcaagggaccctccttgttaccttctactacccaggcgcggtgtgggtttccttcgggcgaagccctcctggggggctgtctgggagccaaccagcaagggaggtgtacttcctaagtagcgcccccagagtaaaggtttctgttagaaatgagtccagacggggtctattatataaatgaaaggtccgccccaaaattggccctaaggtttagcgagtaaaggtctgggcttttccctgaaaattgggctgccccgcgctaaaagagagtgg

SEQ ID NO: 49725 - protein, 112 aa, Zea mays
  misc_feature: Ceres CLONE 1460954-F
MFTYVLAAAAVLIVFLYLIGCVAHRSLRELQIRHGGSGGLLYLQLGRRRTLAVSDLFRNHDLAFASRPQSVSFAPYGRSWLRGKSTTVHLLSRRPRGVLSPLLAGRRRYSGV

SEQ ID NO: 49726 - DNA, 729 bp, Zea mays
  misc_feature: Ceres CLONE 1460955-F
  misc_feature: Encodes the peptide sequence at SEQ ID NO. 49727
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
tggagctccccgcggtggcggccgctctagaactagtggatcccccgggctgcaggaattcgcacgagaccattacctagaacatcctaatcgaaaagacgagcaacagaactagtagtacaggtcgcaacaaccccccaccgtgagggacgcgaccaaacacacgcccctcttcgcacctcccaccaaccccgacgagcggcgatgaccggcacggtgtccaagctggcggcgccccgtccggcggcaccgccgctccggccggcgtccctccgcaccgccgccctcgccttcgccccttccccgcgccgagtccgcgtttccgtcgccgggcgagccaggagccccatcattgcgatggcttcggccaaggaaggaagcggtgcaccgaccaagaggactgcgcttcatgatctctacgagctccagggcctgtccccgtggtacgacaacctatgccgccctgtcacagacttgctgcccattatcgccagcggcgtccgtggagtcaccagcaacccaacgattttccaaaaggccatttcatcgtccagcgcatatgatgatctagcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 49727 - protein, 73 aa, Zea mays
  misc_feature: Ceres CLONE 1460955-F
  misc_feature: SWISSPROT Homolog: EC 2.2.1.2 Transaldolase
MASAKEGSGAPTKRTALHDLYELQGLSPWYDNLCRPVTDLLPIIASGVRGVTSNPTIFQKAISSSSAYDDLAR

SEQ ID NO: 49728 - DNA, 751 bp, Zea mays
  misc_feature: Ceres CLONE 1460956-F
  misc_feature: Encodes the peptide sequence at SEQ ID NO. 49729
  misc_feature (352)..(352): n is a, c, t, g, unknown, or other
  misc_feature (457)..(457): n is a, c, t, g, unknown, or other
  misc_feature (464)..(464): n is a, c, t, g, unknown, or other
ggagctccccgcggtggcggccgctctagaactagtggatcccccgggctgcaggaattcgcacgagaccattacctagaacatcctaatcgaaagtggaattaaaaaccgcagaaaaggaatcaatccgaccatccataaaaaggacggcgacgcggtcaccactgcggcaccgccgccgccgccatcctcgacccctgaagtgaagaggcaacccgaggacgcctctcccatccacgcgcgaatcctaccgccctcccactcccaaaaacctagccgcgcgcgccacctgcatcccatggcggcaaccgcggccgtggcggggaccgggtcgtccctctcctcgcgccgnagtcgcagcgttgtctcctcgtccttccgcgcagctgcctcgcgcttccgctcgccgagatgcgtgctcgggagcaagcaactgcgggtggcgcatgaagggagncgatgancggccccaaatccagaacgcgtggccccaaaaggcccgaaccggattcaaggctggccccctgtcagggagctgccggactccagataaaaatcttcccggccggttaacctccctcccctaagaaattgggcctaaccggggataaaatcggaaaatcccgaacaagccttttgtaaggaaaatttttggcccctccaaaaaacgggaaaagatgtggtgttttttatccccccccattgtccttggaaaaaaaacccgggggggttcctcaagggggagggggcc

SEQ ID NO: 49729 - protein, 54 aa, Zea mays
  misc_feature: Ceres CLONE 1460956-F
  misc_feature (53)..(53): Xaa is any aa, unknown, or other
MAATAAVAGTGSSLSSRRSRSVVSSSFRAAASRFRSPRCVLGSKQLRVAHEGXR

SEQ ID NO: 49730 - DNA, 769 bp, Zea mays
  misc_feature: Ceres CLONE 1460957-F
  misc_feature: Encodes the peptide sequence at SEQ ID NO. 49731
  misc_feature (409)..(409): n is a, c, t, g, unknown, or other
tggagctccccgcggtggcggccgctctagaactagtggatcccccgggctgcaggaattcgcacgagaccattacctagaacatcctaatcgaaaaacgagccttgcttcttcacgtaccctcctcctcacacattttccctctcacctctcaatccatggacaccctccctgttctgatcccccccgatgctcgctgtgggtgccgtttgctgccccaacgccgttccgcgccccctccactccggccatgagctcctcccagtgaatccctctagtcccctgctcatctcccatgatggccgcagggagctctggatccatggccgtcggcctctgggcgtgagcagcccttggatgtgtcccctgccacagactacctccacggtgtctttttcccaagcatgcnggcccgctccctgcttcctccattcgttgcccctggttcagggccgggctaacctccggtcactcttcccctggaaaaagagggcgaagccccgtgccttactccatcttacccattggaaagaaaaaactcctctccgccaaacccaaaaaaaccctgtttagggccccctcttttcctttatcggagaaaaaccccaccccggaaccccccccctctataagcctcaacccaactgggggtccccacccccgaaaggccccccccccttgcccccccaaaaagtacgtttccctcaccctccccaaaaaaaaagacctaccccgggaaaaaatatagtgggacacccaaatttatttc

SEQ ID NO: 49731 - protein, 127 aa, Zea mays
  misc_feature: Ceres CLONE 1460957-F
  misc_feature (74)..(74): Xaa is any aa, unknown, or other
MLAVGAVCCPNAVPRPLHSGHELLPVNPSSPLLISHDGRRELWIHGRRPLGVSSPWMCPLPQTTSTVSFSQACXPAPCFLHSLPLVQGRANLRSLFPWKKRAKPRALLHLTHWKEKTPLRQTQKNPV

SEQ ID NO: 49732 - DNA, 764 bp, Zea mays
  misc_feature: Ceres CLONE 1460958-F
  misc_feature: Encodes the peptide sequence at SEQ ID NO. 49733
ggagctccccgcggtggcggccgctctagaactagtggatcccccgggctgcaggaattcgcacgagaccattacctagaacatcctaatcgaaaattatctgtcgtgctcaccaggttgtcgaggatgggtatgaattttttgctgacagacagcttgtcaccatattctcggcccccaattattgtggtgaatttgataatgctggtgcaatgatgagtgtcgatgaaactttgatgtgctcattccaaattctgaaacctgctgagagaaaaaacaaatttatggggtccaacaaaatgtgatagtgaaagccattttgcttccagcagctctagcctgttaaggttctccctgtggatgcatcgagacaacagcatgctggcgccaagtttgagggcagcattgggctactatcagagaaaccaaataatcccataccctaactgttcatctgggaggtactcatcatgacaagtgcctgaaatttttcctcttttccggtaaccttgggccaaaactttatgtagctgtaaatttattgattatggagggatgaaatttccccaattgacccggaagaatttcccttttccccccgccggaaaaattttgaaccttccgggaagtttttggtttgaaagttttccctatttaaaaaaacgtgttttgtgttgtaaaaaaaaaaaaaaaaaaagtttttctcttcccccgccccccccgggggggggggcccggagaacaaaatttccccccaatataag

SEQ ID NO: 49733 - protein, 30 aa, Zea mays
  misc_feature: Ceres CLONE 1460958-F
  misc_feature: SWISSPROT Homolog: EC 3.1.3.16 Phosphoprotein phosphatase
MMSVDETLMCSFQILKPAERKNKFMGSNKM

SEQ ID NO: 49734 - DNA, 649 bp, Zea mays
  misc_feature: Ceres CLONE 1461015-F
  misc_feature: Encodes the peptide sequence at SEQ ID NO. 49735
  misc_feature (314)..(314): n is a, c, t, g, unknown, or other
  misc_feature (315)..(315): n is a, c, t, g, unknown, or other
  misc_feature (426)..(426): n is a, c, t, g, unknown, or other
  misc_feature (466)..(466): n is a, c, t, g, unknown, or other
ggagctccccgcggtggcggccgctctagaactagtggatcccccgggctgcaggaattcgcacgagaccattacctagaacatcctaatcgaaaaacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatcnntcgcacgctcctccctcaccccgtcgtcggcacctaccaatacgccatgtggtacaaagagcaggagaagctttccacagatactaaatgggatgtcctcccagttgctgncgcttgtcgcagtttgattttcccatgatgggggtgtatnatctgtcatggtcatttccttggtcagtttttagtccacccattttccccctttccatatgcaataaccggaatctgggccttggcaaacattatttggaggctagttaaaattggaaccttttggcccttaaatttggtaaaaaaagaaaatttttcggaacaaaaaaaaaaaaaaaaggct

SEQ ID NO: 49735 - protein, 89 aa, Zea mays
  misc_feature: Ceres CLONE 1461015-F
  misc_feature (44)..(44): Xaa is any aa, unknown, or other
  misc_feature (81)..(81): Xaa is any aa, unknown, or other
MGKTPVRMKAVVYALSPFQQKVMPGLWKDITTKIHHKVTENWIXRTLLPHPVVGTYQYAMWYKEQEKLSTDTKWDVLPVAXACRSLIFP

SEQ ID NO: 49736 - DNA, 661 bp, Zea mays
  misc_feature: Ceres CLONE 1461032-F
  misc_feature: Encodes the peptide sequence at SEQ ID NO. 49737
  misc_feature (627)..(627): n is a, c, t, g, unknown, or other
  misc_feature (652)..(652): n is a, c, t, g, unknown, or other
  misc_feature (661)..(661): n is a, c, t, g, unknown, or other
aaagctggagctccccgcggtggcggccgctctagaactagtggatcccccgggctgcaggaattcgcacgagaccattacctagaacatcctaatcgaaaaaataccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcaagcggtgggcggcgggcagtgcccggccctggggtgcgcggcggacctcaacgccgggtgcccgccctcgcancgcgtgcggggcgggggggcccccntttttttcn

SEQ ID NO: 49737 - protein, 171 aa, Zea mays
  misc_feature: Ceres CLONE 1461032-F
  misc_feature (34)..(168): Pfam Name: Thaumatin Pfam Description: Thaumatin family
  misc_feature (160)..(160): Xaa is any aa, unknown, or other
  misc_feature (169)..(169): Xaa is any aa, unknown, or other
MAGTAKTPVLGFLLALALVATSTPAAATTLTLHNLCPYPVWPLVSPNTGFPAISENTGRLDGGGRGLVSFRFPDSFWAGRVVARTGCSSGHSRCETGSAAPATVVQLVVHAEGQDLASYSVSLVDGFNVPAVVSPQAVGGGQCPALGCAADLNAGCPPSXRVRGGGAPXFF

SEQ ID NO: 49738 - DNA, 646 bp, Zea mays
  misc_feature: Ceres CLONE 1461035-F
  misc_feature: Translation starting site: 257
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (500)..(500): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactggggctccccccgggtgggcggccgctctagaactagtggatcccccgggctgcaggaattcgcacgagaccattacctagaacatcctaatcgaaaagagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccacccaccagctctcatcatgggtgtcgcaccatccaaggggcacgcccgagggcgggttcgagggcgccgccggagctgaaaaacggcgggtgcaaagtgcggcggcaactggcagtgcggacccttgcaactgcnggcaagtgagctagggtgctccaccctgcaagccgggccggaggaaactagctaaatttttataggctaaataaagtttaacgggcctcccctgggtggggttttccagtccaacccagtccttttaattggccgggcccagggcg

SEQ ID NO: 49739 - DNA, 644 bp, Zea mays
  misc_feature: Ceres CLONE 1461038-F
  misc_feature: Encodes the peptide sequence at SEQ ID NO. 49740
ctctataactagtggatcccccgggctgcatgaattcgcacgagaccattacctagaacatcctaatcgaaaaaaaaaacccccacccagctcacctcggcgatggcatcggcggcggccgtggagtgggaggcggcggcgcggaaggtgctggtggcgcgcaagccctgcttcgggctacctacggcctgcccaacctgcctccccgtgctcctctacctccgcatggcgcaggttcccttcgacatccacgtcgacacctccttccccgatgccgatcacataccatatgttgaatttggggattgcgtggctttcaacaacgagaaaggaggcgtaattgattatctcaaggatgagaaaattgctgacttgaactcaaatcacccaaatatttcatccaccactgtgctagatacaaaggccatggtttcgtcctggcttgctaatgctttgctgtatgaacctctgggtggttagtgctggaagcattgcaaatgatatctacttctctgacctcccttggcccattggaaagatactccattggaaataaaactagacatgtgaaagcagctacttgggtataacaaagctcaatggctgctgaaaaagaagaggagatttccttgaaggcaagtgct

SEQ ID NO: 49740 - protein, 125 aa, Zea mays
  misc_feature: Ceres CLONE 1461038-F
MASAAAVEWEAAARKVLVARKPCFGLPTACPTCLPVLLYLRMAQVPFDIHVDTSFPDADHIPYVEFGDCVAFNNEKGGVIDYLKDEKIADLNSNHPNISSTTVLDTKAMVSSWLANALLYEPLGG

SEQ ID NO: 49741 - DNA, 666 bp, Zea mays
  misc_feature: Ceres CLONE 1461041-F
  misc_feature: Encodes the peptide sequence at SEQ ID NO. 49742
caaagctggagctccccgcggtggcggccgctctagaactagtggatcccccgggctgcaggaattcgcacgagaccattacctagaacatcctaatcgaaaacataagagatggtgtcctctcagagaaagttacagtgccatcggttcgtgaagccgtgacaaaaatcctcaagcccaatcctgagctcgctgactcgatctataagaagtgtacgggcctgagcaactggtacggtgtaatcccagcactctggccaaacgcaaagtatgtgtacggtatcatgacagggtccatggaaccgtatttaaagaaactgaggcactatgctgggcacttgcctctgataagcgcagattacggcgcatctgaaggatgggttggtgctaatataaaccccacacttccacctgaacaggtgacatacgctgttctccctcagaccggttattttgagttcattcctttggaggtggagaatagtgcctcctccattcactacttagaatcagaaccagttggcctgactgaagttgaggttggcaaaacctacgaagtcgtgataactaccttcggaggtctataccgctaccggctaggagatatcgtgaaggtaacgggcttccacaacgcaacaccggagctccggttcatctgccgcagaa

SEQ ID NO: 49742 - protein, 127 aa, Zea mays
  misc_feature: Ceres CLONE 1461041-F
MTGSMEPYLKKLRHYAGHLPLISADYGASEGWVGANINPTLPPEQVTYAVLPQTGYFEFIPLEVENSASSIHYLESEPVGLTEVEVGKTYEVVITTFGGLYRYRLGDIVKVTGFHNATPELRFICRR

SEQ ID NO: 49743 - DNA, 642 bp, Zea mays
  misc_feature: Ceres CLONE 1461080-F
  misc_feature: Encodes the peptide sequence at SEQ ID NO. 49744
tctgaactagtggatcccccgggctgcaggaattcgcacgagaccattacctagaacatcctaatcgaaaagtgtccagtcgagtctcagcaaggaagatgtgggggagaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttcaaggacggcaagactctccccacccgcaaaggtatatcactccaattagatcagtggaagatattgaaggacaacatcaaagccataaatgacgccatcgaggaaaatacatgatgggagccgccaagcagtcacgtgacgggcgagcttttgcttcttctctggtttgaggcctgatgtacggaagtagtttttgttgcccatatgctgccgggttgcttttgtccatttgcccacctgctgttgtaggtggccgcatgcccgaaaagtttgggtttctgccccgtgctactagtaaactttaaacgtccggaccggatgaccttaacttcctcccttattttcg

SEQ ID NO: 49744 - protein, 103 aa, Zea mays
  misc_feature: Ceres CLONE 1461080-F
  misc_feature (10)..(99): Pfam Name: PC4 Pfam Description: Transcriptional Coactivator p15 (PC4)
MWGRGKKRFGGGGSGEPAAKRQAARDDGPSESAEDGTVVAEISKNKKVSVRSWKGRVFVDLREFYFKDGKTLPTRKGISLQLDQWKILKDNIKAINDAIEENT

SEQ ID NO: 49745 - DNA, 750 bp, Zea mays
  misc_feature: Ceres CLONE 1461128-F2
  misc_feature: Pfam Name: CN_hydrolase Pfam Description: Carbon-nitrogen hydrolase
  misc_feature: SWISSPROT Homolog: EC 3.6.1.29 Bis(5'-adenosyl)-triphosphatase
  misc_feature (83)..(83): n is a, c, t, g, unknown, or other
  misc_feature (84)..(84): n is a, c, t, g, unknown, or other
aacagacaacagcaaacaggcggacatctccccccccgaggccttcccgaccttcccccaaaatacaacccccggtgggggcnnatacgcaattactagtggatcccccgggttgcaggatatccacgagaccattacctagaacatcctaatcgaaaacttgttggtgggtccatagctgaacgttctggcaacaacttatacaatacatgctgtgtctttggttcagatggccagctgaagggtaaacatagaaagatccatcttttcgacattgacattccaggaaagatcactttcacggaatcaaagactcttactgctgggcagagccctactgttgtagacataaatgttgggcgcattggtattggtctatgctatgacatccgtttccaggaactaacaatgatatatgctgcaagaagtgcttatttgttgtgctatcttggtgtattcaacatgactactggaccactgaattgggagatgctgcaaacggcgagggctgaagaaaatcacctgtctgacgcaagattgacccacccctcacgactacaatcgcccctttacctaccttgtgcgactccgccacacttccgtgggaaccttttgaacgacgctcgatccacccataactttaccccaccccccccccctcacctttcctctatttacccccccctcctttgcccccacccccccctcttgttaggaccccaaggtaggcgccgtcgttcccgcgcatcg

SEQ ID NO: 49746 - DNA, 750 bp, Zea mays; identical to SEQ ID NO: 49745
  misc_feature: Ceres CLONE 1461128-F
  misc_feature: Encodes the peptide sequence at SEQ ID NO. 49747
  misc_feature (83)..(83): n is a, c, t, g, unknown, or other
  misc_feature (84)..(84): n is a, c, t, g, unknown, or other

SEQ ID NO: 49747 - protein, 46 aa, Zea mays
  misc_feature: Ceres CLONE 1461128-F
  misc_feature (28)..(28): Xaa is any aa, unknown, or other
TDNSKQADISPPEAFPTFPQNTTPGGGXYAITSGSPGLQDIHETIT

SEQ ID NO: 49748 - DNA, 659 bp, Zea mays
  misc_feature: Ceres CLONE 1461176-F
  misc_feature: Encodes the peptide sequence at SEQ ID NO. 49749
  misc_feature (458)..(458): n is a, c, t, g, unknown, or other
aaagctggagctccccgcggtggcggccgctctagaactagtggatcccccgggctgcaggaattcgcacgagaccattacctagaacatcctaatcgaaaaacacacggtcgctcactttctctcgcctcctgtcccccccgcgtgcgcgcagcgctctctctctctccctcactctcttttgaggagtgaggacgactggggcgaacgtcgccgccgccgccctacatcaggtgcccaggtcgttgttcggcccttcgccagctctttttcgggcacttcgccggcgacgaacacccaccagttgctgatgcaaggctttcaaaagattaacagtctcacttgatgcaaaagcaacacaatcacactaaaggtttggattagacatttcagagcatgggttcgcggtttccatcccaccagctaagcaatggcttgtatgtctcgggccgacctgnagcacctaaagagaagtccccagtcatttgctcctcggctatgccgtacactggtggggacataaagaaatctggggagcttggaaagatgtttgatctccatagaaaatctggtccattggggtatccaacttcaagaatactttcttttgggggtgctgcctccaactctgggcccgtttctaatgctggcggtcgctc

SEQ ID NO: 49749 - protein, 87 aa, Zea mays
  misc_feature: Ceres CLONE 1461176-F
  misc_feature (21)..(21): Xaa is any aa, unknown, or other
MGSRFPSHQLSNGLYVSGRPXAPKEKSPVICSSAMPYTGGDIKKSGELGKMFDLHRKSGPLGYPTSRILSFGGAASNSGPVSNAGGR

SEQ ID NO: 49750 - DNA, 692 bp, Zea mays
  misc_feature: Ceres CLONE 1461199-F
  misc_feature: Encodes the peptide sequence at SEQ ID NO. 49751
aagctggagctccccgcggtggcggccgctctagaactagtggatcccccgggctgcaggaattcgcacgagaccattacctagaacatcctaatcgaaaaatcgcgtctaaacccttgtctccttcttatccccacctccctcgcggatcactcgccgccgccgccggccgcagccatcgccgtgatgctgtccctgtcgagggcgatcgggaggcggctcttctcgtccgccgaggccgcgtcgacggctgcggtgaggacggcccacaacccgctcgaggagttcttccaggtcgagcggagcaccgaggagggcaagcctcctccccactacggtcgcagctggaatgcttctgaactgcgactaaaatcttgggatgaccttcagaaattgtggtatgttcttctaaacgaaaagaacatgctaatgacacagcgtcaaatgctgcattcacagagcatgaggttccccaatccagaacgaatttccaaggtaaagaaatcaatgtgcccggataaagcaggtcttgactgatgagggctataagcggacccccgatcccaaggagatcttccgaaattgaagccggatgataaaatgccccggtgaattcaactccaaagggcatttcctcccctttggaaccttttggatgggtcacttaattaaaaaaaaatactcccttgccc

SEQ ID NO: 49751 - protein, 116 aa, Zea mays
  misc_feature: Ceres CLONE 1461199-F
  misc_feature (31)..(116): Pfam Name: MRP-L47 Pfam Description: Mitochondrial 39-S ribosomal protein L47 (MRP-L47)
MLSLSRAIGRRLFSSAEAASTAAVRTAHNPLEEFFQVERSTEEGKPPPHYGRSWNASELRLKSWDDLQKLWYVLLNEKNMLMTQRQMLHSQSMRFPNPERISKVKKSMCPDKAGLD

SEQ ID NO: 49752 - DNA, 650 bp, Zea mays
  misc_feature: Ceres CLONE 1461211-F
  misc_feature: Encodes the peptide sequence at SEQ ID NO. 49753
  misc_feature (633)..(633): n is a, c, t, g, unknown, or other
gcggtggcggccgctctagaactagtggatcccccgggctgcaggaattcgcacgagaccattacctagaacatcctaatcgaaaaaaatcaaatcggagcggcggagcaaaacgatccctcccctcgcttccattcgaatcatctcaaacggagcactaatcgggaagctaatgccgcgcgaatcgcgagatctgtagcgccactcggcttcacaggcggcgcggcgggcatggaagcgcagaacggctccggcgtaggggcgcccgtggtgctcaacgtgtacgaccttacgcccatgaacaactacctctactggttcggcctcggtattttccactccggaatcgaagtccacggcatggagtacggatatggagcacacgagtttccaacaagtggggtatttgaggtggaaccaaagagctgtcctggtttcacctacagaagatctgtgtggatgggcacaactgacttgtctagagcagagttccgctcgttcattgaaaatcttgcaggaaagtacaatggcaacacataccatttgatttcaaagaaactgcaccattttacagatgatgtctgtaagaacttgaccagaaaatcaatcccctgggtgggtgaaatcgctagncagagtggggtcatttt

SEQ ID NO: 49753 - protein, 139 aa, Zea mays
  misc_feature: Ceres CLONE 1461211-F
  misc_feature (11)..(137): Pfam Name: DUF862 Pfam Description: PPPDE putative peptidase domain
  misc_feature (134)..(134): Xaa is any aa, unknown, or other
MEAQNGSGVGAPVVLNVYDLTPMNNYLYWFGLGIFHSGIEVHGMEYGYGAHEFPTSGVFEVEPKSCPGFTYRRSVWMGTTDLSRAEFRSFIENLAGKYNGNTYHLISKKLHHFTDDVCKNLTRKSIPWVGEIAXQSGVI

SEQ ID NO: 49754 - DNA, 667 bp, Zea mays
  misc_feature: Ceres CLONE 1461227-F
  misc_feature: Encodes the peptide sequence at SEQ ID NO. 49755
aaagctggagctccccgcggtggcggccgctctagaactagtggatcccccgggctgcaggaattcgcacgagaccattacctagaacatcctaatcgaaaaacaggcagtgagtgggcagcagccactcgctctccccacctcgtctctcttccactcatcccctccctcgccccttcgcctcgcctctcttcttcggatcgagcagcagtactgcactgcatgccgccgatacaaatcccatcctctccctcctctactgcacctgcaccacagtagctagctagctatctttgctacggcggctctgtaatctggtccactagcgctccattcgaccccacccacagccatggctgccgtgaccgcggcggccgtctctctgccctcctcctcctcctcccctgccgccgccaaccccaaggcgtccgcgtccgcgtccccgtcgtctccatgcggccacctccagttcccgcggcggcacggcggcccgcgcgcggtgcggctgcgcgtgcaggtgccccccaccgagaccgcggaggcggaagccggtcaagaagctggagaaggtgtccaagaggcaggaagagggggttcgtcccctaacaagtacaagccccaaggaagcccgtaccgttgggaaggggcctggctcaacacccaggaa

SEQ ID NO: 49755 - protein, 105 aa, Zea mays
  misc_feature: Ceres CLONE 1461227-F
MAAVTAAAVSLPSSSSSPAAANPKASASASPSSPCGHLQFPRRHGGPRAVRLRVQVPPTETAEAEAGQEAGEGVQEAGRGGSSPNKYKPQGSPYRWEGAWLNTQE

SEQ ID NO: 49756 - DNA, 637 bp, Zea mays
  misc_feature: Ceres CLONE 1461235-F
  misc_feature: Encodes the peptide sequence at SEQ ID NO. 49757
gcggtggcggccgctctagaactagtggatcccccgggctgcaggaattcgcacgagaccattacctagaacatcctaatcgaaaaacgaccacgaccgcttcaacgccctcgatcccgaacgcccatatcccggacgcgaccgctgaaccctatgatactctggccatctgctgccggccccggagatcccccgccatggcctcccccgagggcacaacgagggtcttcaactgtccccttatggacgacctcgctgacgccgccgacttcgcgacagcccccgcggacatgatttttctagacagcccccccgtcgctgcactccaggcgccagagcagtctgtcgttgccacgactgttcccaaccaatgtatggaaatcaatgagtctgtgagactgtggtcaccacatggtcatccaaccaatactggtcccaggtcatagagtactacagaatcaagcacaaacccatccctggacaatattccaagggacaagctgaacgaaagattcttggaattgagtgccattttgcacccagggcaaactcctacaatggacaaaacacctatattgactgatgctattcgtgcactatgcgaattgcctagagaaccaatacagctcaagtattc

SEQ ID NO: 49757 - protein, 82 aa, Zea mays
  misc_feature: Ceres CLONE 1461235-F
MASPEGTTRVFNCPLMDDLADAADFATAPADMIFLDSPPVAALQAPEQSVVATTVPNQCMEINESVRLWSPHGHPTNTGPRS

SEQ ID NO: 49758 - DNA, 636 bp, Zea mays
  misc_feature: Ceres CLONE 1461254-F
  misc_feature: Encodes the peptide sequence at SEQ ID NO. 49759
  misc_feature (428)..(428): n is a, c, t, g, unknown, or other
  misc_feature (562)..(562): n is a, c, t, g, unknown, or other
cgcggtggcggccgctctagaactagtggatcccccgggctgcaggaattcgcacgagaccattacctagaacatcctaatcgaaaagtccactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcangccggccggaggaagctagctaattataaagcttaataaagtatagcggcgtcgctgtgtgtgtttcgagtcagtcagtcaattgcgtgccatggcatgctctgagtctgagatgatgatgatggctgatggcngcgtcgtgtcctcccctggcctcctggggcgcttctggcgagcagtgtgttgtgtttgtgtgggtgccgcacgc

SEQ ID NO: 49759 - protein, 82 aa, Zea mays; identical to SEQ ID NO: 43085
  misc_feature: Ceres CLONE 1461254-F
  misc_feature (1)..(80): Pfam Name: Metallothio_2 Pfam Description: Metallothionein

SEQ ID NO: 49760 - DNA, 611 bp, Zea mays
  misc_feature: Ceres CLONE 1461266-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaannnnnnnnnnnnnnnttttnnnnnnnnnnnnnnnncccaaactgggactccccgcggtggcggccgctctagaactagtggatcccccgggctgcaggaattcgcacgagaccattacctagaacatcctaatcgaaaaaatccaaaccgccgcggccacggccgcagccttccatagttctgtcagaattccccttctcatccctgatccctccaactcccaccccaatacatcctggccgacgcccatcagccggcgggacgcacacacgaagtcgaaccttcgaaccctagtcccttggcccaagcccgccctttgcggggatcgtcccccgccgcgcggggagctcttgccctcgaacccttttaagtcctccgtcccaaaacccgggtggggatccaaaaaatggggatcccccccccccctccaaaagcggaaaaccaatttgcttttttacccgagaaaaaaaaaaggggcacttgcctttttggaaggaaaataaaac

SEQ ID NO: 49761 - DNA, 1027 bp, Zea mays
  misc_feature: Ceres CLONE 1461271-R
attgggtaccgggccccccctcgaggtcgacggtatcgataagcttttttttttttttttttggttggccacatacatcatccaaaaaactttattattgaattacaactaataagcaatctaaaagagggcaccaccaatgatgtgttgttggtaggaggccgctgggtctgtcaaagcaagttggacaaagggcaacaattgttgtagatgtaagagggttgcggggttagcctcaaactgctggtagaaaggcagcaactgttgctgtgtaaagaaggaagcacggtttgctgcatctagctggctaaatggtagtagtatttgctgctgcaaataatcagcggggttcagtgcggccaattggttaaatggaagaacatgttgttgctgagagtaggcagaagccagctcgctaaatggtaaaagttgttggtgcaaattaaaacagcaagggttcagtggtagacagttgggttgaattggaagaaaattgttgttgtctgaaaagtaaggagaaaaggttttcccaggagataatatggcttgaatcagaagggaagcacgaagtttgctgccaacttgatggagacccccggaatgggttttgtaaacccaggtaatcttgacgcccccaaaaaaattgggggtttcgcccagtattttttatgaaaaaacacctatgggggcccaataaaaaagggaaaagacttttttttgcctttgccaaaattgtctcttatttattaagcacctataatattgtgttcgaaaagaaaaactgtggtattattaaacaactttttgaaaagcgttataaattttcgatgggaagagggtcacggtggtgccagaaaaatatctaatttgttatatggacgctcttctcagttcatcttagaggtataataactctcccatcctttaacttaaaactatgatgttattgatgatttggggttgctcaatagtcgtgttgaaaaggatttatagtataatatattgtccagacgtaattgtatctcag

SEQ ID NO: 49762 - DNA, 803 bp, Zea mays
  misc_feature: Ceres CLONE 1461273
  misc_feature: Encodes the peptide sequence at SEQ ID NO. 49763
ctcgtcgcagcaaccgtcctcgctccctgcctccctcagttccgctcttcgtctttgggggccattgcccgtgcgtcacccgagcccgtgcccggaatctttgtagaagcgtctggaggactcccacccggctgccagccatggctgagaatctggcgcccgagaagcgccactccttcgtgcacaacgggcagaaggtgttcgagtgggaccagacgctggaggaggtcaacatgtacatcgagctcccgaagggtgtgccaaccaagctatttcactgcaacatccaggctagccacgttgagcatgacctgacacacccagtgaagactgactcgtcgttctggacaatagaagatggtgagatgcatatcacactgcaaaaaagagagaaggggaaaacatggtcatctccaatacaagggcaagggattttggatccatatgctgcagatcaagagcaaaagcggcttatgctccaaaggtttcaggaagagaaccctgggttcgacttttcacaggctcagttcagtggaacctgccctgacccaagaaccttcatgggagggatacgctccgagtgaagcaccctacctgcctatgtacgtttctactatatcctcggcatcttgatagatgcagcaggcgtgcttattatgtctgtaaatcggttggtgtctgttatggagataattgtcatggaaataattgtgatgtgtgaccatttgtgtgcaagcacattttgcgtgcttaattctagtttatagttgtgatctttattcaggaaaaaaaaaaaaaaaaaa

SEQ ID NO: 49763 - protein, 147 aa, Zea mays
  misc_feature: Ceres CLONE 1461273
  misc_feature (19)..(82): Pfam Name: CS Pfam Description: CS domain
MAENLAPEKRHSFVHNGQKVFEWDQTLEEVNMYIELPKGVPTKLFHCNIQASHVEHDLTHPVKTDSSFWTIEDGEMHITLQKREKGKTWSSPIQGQGILDPYAADQEQKRLMLQRFQEENPGFDFSQAQFSGTCPDPRTFMGGIRSE

SEQ ID NO: 49764 - DNA, 661 bp, Zea mays
  misc_feature: Ceres CLONE 1461274-F
  misc_feature: Encodes the peptide sequence at SEQ ID NO. 49765
  misc_feature (571)..(571): n is a, c, t, g, unknown, or other
aagctggagctccccgcggtggcggccgctctagaactagtggatcccccgggctgcaggaattcgcacgagaccattacctagaacatcctaatcgaaaaacctgaccgattcgcgagactgatgggacggcgtcacagcggcggcggcggccgcggcggcggaagaggaagagggcgagggcgagggcgtgggcgagatgaggaagaagatcttcctctgcacaaggctgcaaggtctggtgatgcggcagcagtggagtcggtgagcgagtccaaccctctcgccgtcaattcaagggatcgcctctcacgcacaccactccacctggctgcatgggctgggcatgttgatgttgtgagatgcctttgcaagcacaaagctgatgtgggagctgcagcaatggacgacactgcagcacttcattttgcttcccagaaaggccatgtagaagtggctcgtgagctgctggcatctggggcctctgtgaaagccaagaaccggaaaggcttcacggcgctgcactttgctgctcagaattctcacctggatcttgtgaagtaccttgtgnaagaaggtgttgacgtcacagcaaagaccaaaggtggccagacagctctacatgtcgctgaggatgatgaagtgcgtgcgttcctgaaga

SEQ ID NO: 49765 - protein, 179 aa, Zea mays
  misc_feature: Ceres CLONE 1461274-F
  misc_feature (128)..(160): Pfam Name: Ank Pfam Description: Ankyrin repeat
  misc_feature (62)..(94): Pfam Name: Ank Pfam Description: Ankyrin repeat
  misc_feature (95)..(127): Pfam Name: Ank Pfam Description: Ankyrin repeat
  misc_feature: SWISSPROT Homolog: EC 2.7.11.1 Non-specific serine/threonine protein kinase
  misc_feature (150)..(150): Xaa is any aa, unknown, or other
MGRRHSGGGGRGGGRGRGRGRGRGRDEEEDLPLHKAARSGDAAAVESVSESNPLAVNSRDRLSRTPLHLAAWAGHVDVVRCLCKHKADVGAAAMDDTAALHFASQKGHVEVARELLASGASVKAKNRKGFTALHFAAQNSHLDLVKYLVXEGVDVTAKTKGGQTALHVAEDDEVRAFLK

SEQ ID NO: 49766 - DNA, 669 bp, Zea mays
  misc_feature: Ceres CLONE 1461279-F
  misc_feature: Encodes the peptide sequence at SEQ ID NO. 49767
  misc_feature (374)..(374): n is a, c, t, g, unknown, or other
  misc_feature (399)..(399): n is a, c, t, g, unknown, or other
  misc_feature (400)..(400): n is a, c, t, g, unknown, or other
  misc_feature (411)..(411): n is a, c, t, g, unknown, or other
  misc_feature (520)..(520): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaggatctggatccggactcgactcgaagccaaaaccaactcgctctctctcgctctcgcacacggtagacggtacgtcccgctcccgcgcgcggccggccacgcgactggtcaggcgcgaggcgagcgttcacgcgccccgcgcctgctggttgcggacggagggaatatccacgatcagagcggggccagccagcgcgggcgctgcggtcgacgacggtctctgtgcgcgcgcgatggtggcccgcgcgaggggtgtgtcgggggtgaaggcngagggtctgctgcggggcgcgtgcnncgccctggccncggcggccgcgctgctggtggggctcaccacgcaaacggagacggtgctgctcgtccggaagaggccaccgtcaaagacgtcccagcgctctgggtgctggcaatggcngcccgcgtcgggggcggcttacacctgctgcaactgctcaagtgcctctacctcggcccgccgcgcagcggcaagggctctgggctgnacgtgcctcctgctccaaaaggcgtgcgcgtacgcaactttcgcaacaaaggggtggcggc

SEQ ID NO: 49767 - protein, 111 aa, Zea mays
  misc_feature: Ceres CLONE 1461279-F
  misc_feature (22)..(22): Xaa is any aa, unknown, or other
  misc_feature (26)..(26): Xaa is any aa, unknown, or other
  misc_feature (62)..(62): Xaa is any aa, unknown, or other
  misc_feature (91)..(91): Xaa is any aa, unknown, or other
MVARARGVSGVKAEGLLRGACXALAXAAALLVGLTTQTETVLLVRKRPPSKTSQRSGCWQWXPASGAAYTCCNCSSASTSARRAAARALGXTCLLLQKACAYATFATKGWR

SEQ ID NO: 49768 - DNA, 657 bp, Zea mays
  misc_feature: Ceres CLONE 1461288-F
  misc_feature: Encodes the peptide sequence at SEQ ID NO. 49769
  misc_feature (471)..(471): n is a, c, t, g, unknown, or other
  misc_feature (488)..(488): n is a, c, t, g, unknown, or other
  misc_feature (507)..(507): n is a, c, t, g, unknown, or other
  misc_feature (557)..(557): n is a, c, t, g, unknown, or other
  misc_feature (609)..(609): n is a, c, t, g, unknown, or other
aagctggagctccccgcggtggcggccgctctagaactagtggatcccccgggctgcaggaattcgcacgagaccattacctagaacatcctaatcgaaaaagctcctctgcttctggcgaccaaattctgccgtctccaccgccgccgcagccagcgtcaccggagggatctgccgtctcccttgctccacgcgatgaacaccgacatcaccgcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccgtcgatggtcacgggcggcctcatcggggtcatgggagggttcatgtacgcctaccagaactccgccgggcgcctaatgggattctttcccacgacngcgaagttgcgcgctancagcacaagcttcattgangatcaagctccattccgtctctcttttcgcaaccgttcgccggttccttncctgaatccgggtaaacttcagtactttatctgggaactctatgggcttggntaaataaaaatggtatgttgttgcccggttttaagatccaaagaacac

SEQ ID NO: 49769 - protein, 138 aa, Zea mays
  misc_feature: Ceres CLONE 1461288-F
  misc_feature (98)..(98): Xaa is any aa, unknown, or other
  misc_feature (104)..(104): Xaa is any aa, unknown, or other
  misc_feature (121)..(121): Xaa is any aa, unknown, or other
MNTDITASTKPEYPVVDRNPAFTKVVGNFSALDYMRLSTISAVSVTVGYLSGIKPGIRGPSMVTGGLIGVMGGFMYAYQNSAGRLMGFFPTTAKLRAXSTSFIXDQAPFRLSFRNRSPVPXLNPGKLQYFIWELYGLG

SEQ ID NO: 49770 - DNA, 695 bp, Zea mays
  misc_feature: Ceres CLONE 1461290-F
  misc_feature: Encodes the peptide sequence at SEQ ID NO. 49771
  misc_feature (418)..(418): n is a, c, t, g, unknown, or other
  misc_feature (558)..(558): n is a, c, t, g, unknown, or other
  misc_feature (592)..(592): n is a, c, t, g, unknown, or other
  misc_feature (633)..(633): n is a, c, t, g, unknown, or other
aaagctggagctcaccgcggtggcggccgctctagaactagtggatcccccgggctgcaggaattcgcacgagaccattacctagaacatcctaatcgaaaaacaccccaagaacgtgatcctgctggcgtgcgacgccttcggcgtgctcccgccggtgagcaagctggacctggcgcagaccatgtaccacttcatcagcggatacaccgccctggtcgccggcacggaggacggcatcaaggagccacaggccaccttctccgcctgcttcggcgcggccttcatcatgctccacccgaccaagaacgccgccatgctcgccgagaagatgcagaagtacggcgccacagggtggctcgtcaacaccggttggtctggcggcagggagggggtgggttagaggattgaggttttntaccccactaagatgatgggacgcatccactcaggcgagcttctcacccccaactaccaaaaaaccccacgtcttcggcctgggagatctggattgaaaataagggggtggcgttgggaaatcctcgacccaatctaaancttggattgataaaggccgcgtacaagggaaacnctcctgaaggctcggcaggccctccttcaaaaacaactccnaaggatgttaggcatccttcccccatcccgggaaaaactcctaccccgagcccccagcggtc

SEQ ID NO: 49771 - protein, 72 aa, Zea mays
  misc_feature: Ceres CLONE 1461290-F
  misc_feature: SWISSPROT Homolog: EC 4.1.1.49 Phosphoenolpyruvate carboxykinase (ATP)
MYHFISGYTALVAGTEDGIKEPQATFSACFGAAFIMLHPTKNAAMLAEKMQKYGATGWLVNTGWSGGREGVG

SEQ ID NO: 49772 - DNA, 806 bp, Zea mays
  misc_feature: Ceres CLONE 1461293-F
  misc_feature: Encodes the peptide sequence at SEQ ID NO. 49773
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (29)..(29): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (391)..(391): n is a, c, t, g, unknown, or other
  misc_feature (408)..(408): n is a, c, t, g, unknown, or other
  misc_feature (489)..(489): n is a, c, t, g, unknown, or other
  misc_feature (495)..(495): n is a, c, t, g, unknown, or other
  misc_feature (498)..(498): n is a, c, t, g, unknown, or other
  misc_feature (533)..(533): n is a, c, t, g, unknown, or other
  misc_feature (551)..(551): n is a, c, t, g, unknown, or other
  misc_feature (560)..(560): n is a, c, t, g, unknown, or other
  misc_feature (566)..(566): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (673)..(673): n is a, c, t, g, unknown, or other
  misc_feature (798)..(798): n is a, c, t, g, unknown, or other
gggtggttgccntnnnnnnnntggctctnccttctncnnnnngtggatnnnggggggagggggatccccgcggtggcggccgctctaaaatagtggatcccccgggctgcaggaattcgcacgagaccattacctagaacatcctaatcgaaaagtatttctaaacagagttcaattcattaaaaaccaatgacaatgcaagcaactcttgttatcctggttttcgccggtttactatcagttaagacgactttagcagcacagcacgtgataggcgggagccaaggctgggaacgatccgttaactttaattcttggtcgtccgataaatctttcaaagtcggcgatgggcttgtttttaagtattccggactacccagggtttgtaganctcgaaagccaaaccgncttaatagaccctgtgacggggggagggcgggggaagttccttgaggcttctggaagaggaggttcgtccccccctccccnaaaacnagntaactcattaatttccactaggtggggacccccgnggccatttgccaagtcgngggcgtgangggttnaaagttagaggggtggtcgtcctggctggagttccaccgnnnggttggcaggctgcgggagtttggggatttgagagtcttgcggaattcagtatttcggggttttncaggcaacgcgggtgcaaaatattcgcagattccgaggtgaccgagcctccaggtcttcccccggttccaagattcccacgtccaagggggtctacacatccctcccaccaccagaagaagaagntaccgacc

SEQ ID NO: 49773 - protein, 87 aa, Zea mays
  misc_feature: Ceres CLONE 1461293-F
  misc_feature (68)..(68): Xaa is any aa, unknown, or other
MTMQATLVILVFAGLLSVKTTLAAQHVIGGSQGWERSVNFNSWSSDKSFKVGDGLVFKYSGLPRVCRXRKPNRLNRPCDGGRAGEVP

SEQ ID NO: 49774 - DNA, 1081 bp, Zea mays
  misc_feature: Ceres CLONE 1461294-R
  misc_feature: Translation starting site: 121
  misc_feature (937)..(937): n is a, c, t, g, unknown, or other
ttgggtccgcgccccccctcgaggtcgacggtatcgataagcttttttttttttttttttgtctaatatttttcttatttataacttttccacaaaccaatacattaaggtaacctttaaatgggcctaacatattggcgctggcctctaagagtaaatgagatttctgatggaagcaaacagagttgtactcttggtcggatcaccgagctcaacaccgtgaacaacgccgtcagtaaaacgctccatcacatcaactcccttctccttcatcagcttcgccacatctctctgcctatctattatcggatttcctcctcctccactcttaaccttcttccattcctaccgttctaataattttatactcaacggtccattttcccacctgtcagaataacaaatcgtcgtgaatcccggttagattctcaaagggtataaaaaactcctcacaaaacgctctctggttattaaggcttgaaaaaacctttttcgttgttccaaccctctattctccgtaaattgaaaccggcttccacagcactatcttaaataatcagcaaggggggagtaataaaccctatgtccgcacgcggtaagcatctaggcggggatatttctggctccccgtcctaatgggccagtaaatttttattacacccccaccggtctatatagaggcaccaataggaattaacatgaccatgactagcttggtgaggtctctccttgtattagagacagcaccgccttttaataaaaattcacaggcgcacggaatgaacttttgtatcccccaattttggtattacgcgtaaatgtgtactagagatgaaaaagctcatataaagctggtatatcttgtccgggtagtgtcctatatacgcacatgcgaagtgagataatccgttatcttctcattaaacgccaccgctgntctcgatgatggccaattcctgtcccggtccaccacttttatataatccccgggtctataaagctgttgttcataagtatctcgggataagtaatttgagcattttacgcctttattcgagctactcgaatgcttatatgctag

SEQ ID NO: 49775 - DNA, 645 bp, Zea mays
  misc_feature: Ceres CLONE 1461297-F
  misc_feature: Encodes the peptide sequence at SEQ ID NO. 49776
  misc_feature (334)..(334): n is a, c, t, g, unknown, or other
  misc_feature (358)..(358): n is a, c, t, g, unknown, or other
ggagctccccgcggtggcggccgctctagaactagtggatcccccgggctgcaggaattcgcacgagaccattacctagaacatcctaatcgaaaagttactcctccgtcctccctccgcgtttacacccgccgccactcctgccttggcgccgtagctagcaaaggcgatatccatggcgagccctgcacggatcgagctggacaagctgagcgtggagcagctcaaggggctcaaggagcagacggatctggaggtcaacctcctccaggacagccctcacaagatccgcaccgcccgccaccgactcgagaacgcctcccgcgcgctccangacctatccctccgcccccaaggnaagaagatgctcgtgccgcttacggcgtccctctacgttccgggtccctggacaacccgaaaaaggtcctcctcaatgtcggccccgtttacttcattcaaaaaacctggcctcaggggaaaaaaacctggtaaaggaaaattattttttggagcccaattttgagaaatgggggaagggggccccaaaaaaaaaccccttccaaaaaattgggtttctttatcaaaccccctgaagggcgggcccccggccccaatttttagaagaggggggcccccccccctcct

SEQ ID NO: 49776 - protein, 115 aa, Zea mays
  misc_feature: Ceres CLONE 1461297-F
  misc_feature (53)..(53): Xaa is any aa, unknown, or other
MASPARIELDKLSVEQLKGLKEQTDLEVNLLQDSPHKIRTARHRLENASRALXDLSLRPQGKKMLVPLTASLYVPGPWTTRKRSSSMSAPFTSFKKPGLRGKKPGKGKLFFGAQF

SEQ ID NO: 49777 - DNA, 609 bp, Zea mays
  misc_feature: Ceres CLONE 1461299-F
  misc_feature: Encodes the peptide sequence at SEQ ID NO. 49778
ggagctccccgcggtggcggccgctctagaactagtggatcccccgggctgcaggaattcgcacgagaccattacctagaacatcctaatcgaaaagtgattagcaaaaccggccgtttggttggggacagaccacggctaccgaacagccgggttccacgaccaacccaaccgcgggggaaaggggaaaaccccacggcccggagcaacccttgggaaagtcgtcgacgccgttgagttcgaggcgaccggcggctcgccgccccgccacagcgccgctgcgatttcttctgatccctgtggctcagcgcggagggttaaatggcaaatagagcaagatggatgatgaagtacgaaaagggtcttgttgatatacttcatgagaacaatacttcacattatcgtacccaaaacggttggagaacggaggggtggaggaaaatcgttagggatttcaatgtacgtacccccgaacaaagtttagtaaatgcaaatccaggacatgagactcaattgaggaaagattatagttgataaatctatcctcaacgtgatggtgtctcatgggacagagtgcatccatgggtagaacaccgatgaaactgggat

SEQ ID NO: 49778 - protein, 70 aa, Zea mays
  misc_feature: Ceres CLONE 1461299-F
MANRARWMMKYEKGLVDILHENNTSHYRTQNGWRTEGWRKIVRDFNVRTPEQSLVNANPGHETQLRKDYS

SEQ ID NO: 49779 - DNA, 668 bp, Zea mays
  misc_feature: Ceres CLONE 1461303-F
  misc_feature: Encodes the peptide sequence at SEQ ID NO. 49780
  misc_feature (457)..(457): n is a, c, t, g, unknown, or other
  misc_feature (604)..(604): n is a, c, t, g, unknown, or other
  misc_feature (640)..(640): n is a, c, t, g, unknown, or other
  misc_feature (645)..(645): n is a, c, t, g, unknown, or other
  misc_feature (666)..(666): n is a, c, t, g, unknown, or other
aagctggagctccccgcggtggcggccgctctagaactagtggatcccccgggctgcaggaattcgcacgagaccattacctagaacatcctaatcgaaaaaggattcattttctcccacgcgcgtctctctcccctgcttccatggctgccgtaccctttgctcctcccagccagccgaggtctcttccgaagcaccgccggccatctcgagggagatctggcgcccggccaccctcacctcatccacttcctggcgttcgtcctcggctccctcacgccgtgtgctcctccctggtactcgagatcgcccatggagcccagccccatgcggcgctccgctcgctcttgtctggtggctggtgcgcgcaggcgccgggctcagggagccccggcaagagctggcgttgtggcgggccaccgacagcgatggaggtgcttgctgccactccttgtangcgtcgccttccttgtcgagatcacctccctttgccgcctcgacatggcgaagaacgccgaagtggtcgagagctagaccagctccttttaccactgctcctcccattggggtgaagccgtgggtcggggcgtggtcccgaagtcangcagcgatggcgaagatgaaaagatccgatggtgcnagcancgttcgagaaggaagatgtcntc

SEQ ID NO: 49780 - protein, 73 aa, Zea mays
  misc_feature: Ceres CLONE 1461303-F
  misc_feature (49)..(49): Xaa is any aa, unknown, or other
MEPSPMRRSARSCLVAGARRRRAQGAPARAGVVAGHRQRWRCLLPLLVXVAFLVEITSLCRLDMAKNAEVVES

SEQ ID NO: 49781 - DNA, 648 bp, Zea mays
  misc_feature: Ceres CLONE 1461305-F
  misc_feature: Encodes the peptide sequence at SEQ ID NO. 49782
gtggcggccgctctagaactagtggatcccccgggctgcaggaattcgcacgagaccattacctagaacatcctaatcgaaaaactcttcgtcctcctcgatcgtcccaacaaccgcaatggcgcagcagaggcttctcgctctcctcctggtggcggccctcctcgcgctctccttctcgcaagggcaggtggaagcgcggaaggtgcaggtgcggcgcgcgcccctcggcggcggcggccgcctgcttccggaggcgatgatggcgtacacgacgacggactacgggccccccacggccaacaccaacacccacggcggcatggtcccgtcgccggacgacccctcctcgccgccgacgcactgaccggccagtcgatctcaccggcaacaactgtgttgttctttgggattggagctttggaagagaagattggaggagaggatcggaagaagctggtcttgttcttctcccttattgggcgcgcgtgttgtgttgtgcgctgctgtgtctgtgtagtccagctgtagctgctgctgtgcttagctgattgaagttggaactgtagtgggtccacagtattatgcatgttttgtttgttgagacgtcaaaaaaaaaaaaaaaaagcttatcgataccgtcgacct

SEQ ID NO: 49782 - protein, 82 aa, Zea mays; identical to SEQ ID NO: 44249
  misc_feature: Ceres CLONE 1461305-F

SEQ ID NO: 49783 - DNA, 703 bp, Zea mays
  misc_feature: Ceres CLONE 1461308-F
  misc_feature (369)..(369): n is a, c, t, g, unknown, or other
  misc_feature (370)..(370): n is a, c, t, g, unknown, or other
  misc_feature (496)..(496): n is a, c, t, g, unknown, or other
ccccgcggtggcggccgctctagaactagtggatcccccgggctgcaggaattcgcacgagaccattacctagaacatcctaatcgaaaacttcaagtttaggaaaggaagcaccggagcaggcgatacggcgccgacgacaatggcagcaacaagggcttccccagtgcttctcttgctgctcaccgtccagctcagcttgctcttccgcctccccgactccccctccaccctcgccctcgccctcgccgcggaaccagagcaacagaacgccaagcagcatcgccagcccgcgctgctggtgcagtcgacgtgcaactccaccagcttctacgacctctgcatcgccgcgctcgccgccgaccccgnncagctcacccgccgacgtcccgggccctcggcgcattcgccgtgtccgcccgccgcaaacaacgcctccggaacggccgcctttcctcgggaaagcccagggaagccggggccacccccaaaaggnggacggggggcttcttccgggcctggccccggaaagaacaccccccccccgccaaccgccctttgtaaaggggcgcccggtccctttcccaaaaaagggctcaaaaaaaccccctttctggaaaagaaaccccccccggggaaaaccccccgcgggggggccccacacgtttcccgggccccggcaaaaaaacacacttggggggaa

SEQ ID NO: 49784 - DNA, 661 bp, Zea mays
  misc_feature: Ceres CLONE 1461317-F
  misc_feature: Encodes the peptide sequence at SEQ ID NO. 49785
  misc_feature (661)..(661): n is a, c, t, g, unknown, or other
ggagctccccgcggtggcggccgctctagaactagtggatcccccgggctgcaggaattcgcacgagaccattacctaaaacatcctaatcgaaaagtagctgtagactgtatttctgttcctccccactcactcgtgcgcttcctcgccgcgcggttccttctccctgatcctccttgggcttcgcggttcatggcgatgtgggagggccgccgctaggcagctgggcgaccgggccctccggtcaggggacgcgcacacgtctacaggcacataaagatagtcggggtgttctacaatgccggggagtatgccgacaaggaccccaacttcgtccgctgcgtcgagggtgcactcggcatccgcggctggctcgagtcgcagggtcatcattacattgtcaccgatgacaaggaatgccccaactgtgaactggagaagcacattgaggacatgcatgtcctgattaccaccccattccacccagcttatgtcactgcagagaggataaagaaggcgaagaatcttgagcttcttctcacgtcagaatcggctccgatcatatagatcttccagcagctgctgctgcaggcttaactgtggctgaagtcatggaaacaacactgtctctgtgacacataatgactcttgccattctgan

SEQ ID NO: 49785 - protein, 37 aa, Zea mays
  misc_feature: Ceres CLONE 1461317-F
  misc_feature: SWISSPROT Homolog: EC 1.2.1.2 Formate dehydrogenase
MHVLITTPFHPAYVTAERIKKAKNLELLLTSESAPII

SEQ ID NO: 49786 - DNA, 660 bp, Zea mays
  misc_feature: Ceres CLONE 1461321-F
  misc_feature: Encodes the peptide sequence at SEQ ID NO. 49787
aaagctggagctccccgcggtggcggccgctctagaactagtggatcccccgggctgcaggaattcgcacgagaccattacctagaacatcctaatcgaaaaaatcagccatcgccaccacttccctccgcggctccgccttccgccgggaacacgccgctgtctcgaccccttgtcctcctccttcagcaagatggcggagattgagataaaaacagcacctgctgacttccgcttccctacaacaaaccaaacaaggcattgttttactcgctatgtcgagtaccacaggtgtttgaatgccaaaggggatgatgctggtgtttgcgaaaaatttgccaagtactaccggtccctttgccctggagaatgggttgagaaatggaccgagcacagggagcatgggacgtttccgggacctctctgaatgtaccgcccgagacctccagttggaccagtcaacaagttggccaggcagtcctactgttccattcggcattcctacttccagaatcggaaatgcattttgtcccttgcgcttcaggcagtcaccacaaaactgttagtgatgcctctcgtatgcagctctaataattcggctacgattgccccacatgcagccttagtttgtgtgtggactgtggacatcattttgcaacg

SEQ ID NO: 49787 - protein, 77 aa, Zea mays
  misc_feature: Ceres CLONE 1461321-F
  misc_feature (4)..(76): Pfam Name: COX6B Pfam Description: Cytochrome oxidase c subunit VIb
  misc_feature: SWISSPROT Homolog: EC 1.9.3.1 Cytochrome-c oxidase
MAEIEIKTAPADFRFPTTNQTRHCFTRYVEYHRCLNAKGDDAGVCEKFAKYYRSLCPGEWVEKWTEHREHGTFPGPL

SEQ ID NO: 49788 - DNA, 769 bp, Zea mays
  misc_feature: Ceres CLONE 1461325-F
  misc_feature: Encodes the peptide sequence at SEQ ID NO. 49789
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (400)..(400): n is a, c, t, g, unknown, or other
  misc_feature (407)..(407): n is a, c, t, g, unknown, or other
  misc_feature (419)..(419): n is a, c, t, g, unknown, or other
  misc_feature (475)..(475): n is a, c, t, g, unknown, or other
  misc_feature (517)..(517): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagctgggactccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgncagtgcngcaacggctgcngaggggtgcagcagatgtacccggacatggctgagcaggtgaccaccaccacccangctctcatcatggggtgtcgcacccatcaaaggggcacgccnaagggcgggtttcgaggcggcccgccggaactgaaaaacggcgggttggcaaatggggcggcaaattggcaatggggaccccctggaattggggggaaaggggagctagggtggtcccccccttggaaggccggcccggaggaacccttccttattttttttaaaccctaaaaaaaagtttaaccggccccccccttgggggggttttccaaggcccccccccccccttttttttggggggggccggggggc

SEQ ID NO: 49789 - protein, 109 aa, Zea mays
  misc_feature: Ceres CLONE 1461325-F
  misc_feature (1)..(72): Pfam Name: Metallothio_2 Pfam Description: Metallothionein
  misc_feature (14)..(14): Xaa is any aa, unknown, or other
  misc_feature (17)..(17): Xaa is any aa, unknown, or other
  misc_feature (21)..(21): Xaa is any aa, unknown, or other
  misc_feature (39)..(39): Xaa is any aa, unknown, or other
MSCCGGNCGCGSGXQCXNGCXGVQQMYPDMAEQVTTTTXALIMGCRTHQRGTPKGGFRGGPPELKNGGLANGAANWQWGPPGIGGKGELGWSPPWKAGPEEPFLIFFKP

SEQ ID NO: 49790 - DNA, 683 bp, Zea mays
  misc_feature: Ceres CLONE 1461331-F
  misc_feature: Encodes the peptide sequence at SEQ ID NO. 49791
  misc_feature (344)..(344): n is a, c, t, g, unknown, or other
  misc_feature (397)..(397): n is a, c, t, g, unknown, or other
  misc_feature (531)..(531): n is a, c, t, g, unknown, or other
tgtggatcccccgggctgcaggaattcgcacgagaccattacctagaacatcctaatcgaaaaactcaaaccaccaatgttagatccgtacccccgcaccctcgccgcagccatggcggaagaagccgccgccgccgcctccgcgtccgccaccaacttcaaggttgacctgggccacctcatggactacgacccctcacaccacctcgccgccggcgccgcgtcctcccgggcggagctgcggaacgagtgcctgcggaaggccacggagctcgagcaggccgtcgcaaacgccctcttctcgctgcccgccaccgagtggcgcgatggccctgttgtccccntcccgccggccacccacccgcctgccccgcgaggagggatttttaccaggggncaaagccctcctaccgggtggggagtaggttcgcaaaggggcggaagggggtttatccggggacgaaagaggaaaaaggggggggctgggggaatggaggcaagaactaatgcccctggggaaggggaggggcntgggcgtatagaaccggggtaaagggaagggagggggagacggttgccgccgcgcgggggagagagcgagaagtaggcacgagaggaagggcttggaggggatcgcaccacgcttttgggcccaaaagacaaggcggtacccatgagagagg

SEQ ID NO: 49791 - protein, 146 aa, Zea mays
  misc_feature: Ceres CLONE 1461331-F
  misc_feature (78)..(78): Xaa is any aa, unknown, or other
  misc_feature (140)..(140): Xaa is any aa, unknown, or other
MAEEAAAAASASATNFKVDLGHLMDYDPSHHLAAGAASSRAELRNECLRKATELEQAVANALFSLPATEWRDGPVVPXPPATHPPAPRGGIFTRGQSPPTGWGVGSQRGGRGFIRGRKRKKGGAGGMEARTNAPGEGEGXGRIEPG

SEQ ID NO: 49792 - DNA, 657 bp, Zea mays
  misc_feature: Ceres CLONE 1461332-F
  misc_feature: Encodes the peptide sequence at SEQ ID NO. 49793
  misc_feature (497)..(497): n is a, c, t, g, unknown, or other
tacccgcggtggcggccgctctagaactagtggatcccccgggctgcaggaattcgcacgagaccattacctagaacatcctaatcgaaaatcgccgtcctggtgctccgccgcccctccctttgtactcgcgctggagctgcagatccaccgcgacctggcgaccaattcctcctcccgctgaagaattggcgaccttggcctccgcccccgcggcgcggaggagtcaactgtggtagcaaccaccgcggaggctgcaagccttcggtaagggaggaaagttgacttgttggaagccggtccagggccgcgatgacgtcgaccgccgccggcgcgtcgtcgtcggcggcgaagagcgagtcctacctgcgggccgacaagatcgacctcgagagcctggacatccagctggaggagcagctgggcaagacctgggagaagcacaaggggtcgtacaaccaggggcccaggggaggactggggagatcgacctcgcnaagctcgagattcgctacgtcatagcgcagggcacctaccggacggtgtatcgcgggcacttatgatgggcaaggacgtcccaataaaaatttttgggatggggggggaaaatggcctttccctccaaaaactgaaacctgcccccctggggaggcattt

SEQ ID NO: 49793 - protein, 69 aa, Zea mays
  misc_feature: Ceres CLONE 1461332-F
  misc_feature (62)..(62): Xaa is any aa, unknown, or other
MTSTAAGASSSAAKSESYLRADKIDLESLDIQLEEQLGKTWEKHKGSYNQGPRGGLGRSTSXSSRFATS

SEQ ID NO: 49794 - DNA, 657 bp, Zea mays
  misc_feature: Ceres CLONE 1461333-F
  misc_feature: Encodes the peptide sequence at SEQ ID NO. 49795
  misc_feature (412)..(412): n is a, c, t, g, unknown, or other
ggagctccccgcggtggcggccgctctagaactagtggatcccccgggctgcaggaattcgcacgagaccattacctagaacatcctaatcgaaaactagctcatttctttcattctctccagccgaaacatctggccggtggcgtttctctttgccgcacagccgccctatggcatgctgttgtccttcgctccctcgtttgtttttggttctagcatctacagtcgaccatcttttctcggttggtactttacgcatggccatctttgctttggtgttgcacctactctctgtttctattttctttcacttcttcaacaattttctagccaacgtgttctctgtacacgtccgcttgcaatggaggtgcgtgctgcatacatgcgcatgctccttttctctctggttggngttttttttccttttttttctttcccctttcttttcctcagctgcgcaagacataccggcccgcagggagatttgctccctggcgaaacgcgcccgagtgccctcgtacggccgtttcctgcgcgcagggcgggacccccgcgactctcccgccggcgagtgcgtcccctaggtggggcacgccgccgtcggtggtccccttgcagccgtaagaaaaaaaaaacttcgactgtaccaccttttca

SEQ ID NO: 49795 - protein, 137 aa, Zea mays
  misc_feature: Ceres CLONE 1461333-F
  misc_feature (81)..(81): Xaa is any aa, unknown, or other
MACCCPSLPRLFLVLASTVDHLFSVGTLRMAIFALVLHLLSVSIFFHFFNNFLANVFSVHVRLQWRCVLHTCACSFSLWLXFFFLFFLSPFFSSAAQDIPARREICSLAKRARVPSYGRFLRAGRDPRDSPAGECVP

SEQ ID NO: 49796 - DNA, 639 bp, Zea mays
  misc_feature: Ceres CLONE 1461335-F
  misc_feature (323)..(323): n is a, c, t, g, unknown, or other
  misc_feature (333)..(333): n is a, c, t, g, unknown, or other
  misc_feature (385)..(385): n is a, c, t, g, unknown, or other
  misc_feature (403)..(403): n is a, c, t, g, unknown, or other
  misc_feature (409)..(409): n is a, c, t, g, unknown, or other
  misc_feature (501)..(501): n is a, c, t, g, unknown, or other
ggagctccccgcggtggcggccgctctagaactagtggatcccccgggctgcaggaattcgcacgagaccattacctagaacatcctaatcgaaaagccgattacgagtgccgtgtgtgccccgctccagtaagccaacagctcattcctcctcaccacgctgctcgttactaaccaagcaatcaatttcctcctctttccattctcccagccacaaatcgatcggaaacgcacgcccctttctcttcgccttttcgcgtcgtccagatctcagtcgttcttcgctccatgagctaggaatccgaggtgtcctctaggctaancgaagttggnccggcgcggctaggatggggttgatatccgggatgatgatgggggtcattgntgggcgtcgccatcatgnccggcntggaaccgcgtcatggcccgacccagcacgaagcgcatcgcccaggctgcggaaatcaaggggcttgggcctctcagcagggacaacctcangaagctggggggggaaaacctcccggagtggaaattccttccccgaatttgaaacgggtaaaggggttaaaaaacatctgaaccaaattttggccctttggtttgaaaaacctgcaaaaaataggggttaaggaatcc

SEQ ID NO: 49797 - DNA, 695 bp, Zea mays
  misc_feature: Ceres CLONE 1461336-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (326)..(326): n is a, c, t, g, unknown, or other
  misc_feature (356)..(356): n is a, c, t, g, unknown, or other
  misc_feature (449)..(449): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctgggactccccgcggtggcggccgctctagaatagtggatcccccgggctgcaggaattcgcacgagaccattacctagaacatcctaatcgaaaaacaaggagaaacaaattcttctattttagctctagctcgctcgccatcccctgcccggctgctgccccccacggaaacgacggcagaggaagctaccagagtcgatcgatcgatcgagatcnagagagagagagagagagcatggctggcangagtttcctgattcggtccccccagggagaagagtccaacgccggccgtcagagaaggctgtactgcttgggagcaaagaacgccccaataanctggtactgggggttgccagttcccaacgtttgtttggggtgcccggggccctttccttggggaaaaggggaaatcttctattaacttgggaaaagaccttttttttattctccccccccggaattgggggggttttctcccaacgggggggaaaaaaaccttttttcggggagggcccgcagaaaaaaaccccctcggggaaaattttagaaaactccacttttttggccaaaaaaaatttccct

SEQ ID NO: 49798 - DNA, 614 bp, Zea mays
  misc_feature: Ceres CLONE 1461338-F
  misc_feature (510)..(510): n is a, c, t, g, unknown, or other
  misc_feature (543)..(543): n is a, c, t, g, unknown, or other
  misc_feature (583)..(583): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
ggagctccccgcggtggcggccgctctagaatagtggatcccccgggctgcaggaattcgcacgagaccattacctagaacatcctaatcgaaaaacgattggagtttctcctcggcagcccacccagctctgtggttcttcgggtcggaggaacaggcgaacagcaagagcttctgatgatgaaggcgatccccgtggctctcctgctcctcgtcctggttgctgccccctcctcgttcagcatctcgccaagtcagcagacggcggcccgctgcctgacggcgtgtgcgacggcaagtgccgcagccggtgctcgctgaataccgccggacggtgcatgggcctgtgcatgatgtgccccgacagtcgcagtgttgcgtgtcgtcgtggacgtacgccagcatgacgattgctcctgctaccgaacatgaagtcccccagaccagcgctcaagtgcccctatgcctaccgctctgacgtaggaggatgaccacggattcgctcgcgancctgccagcttctagtcttgtactgctagttancgcctcgagcgtcggatgtctcgaccgttcctctccgganaannngttagatctttccattatccgnnnna

SEQ ID NO: 49799 - DNA, 684 bp, Zea mays
  misc_feature: Ceres CLONE 1461339-F
  misc_feature (445)..(445): n is a, c, t, g, unknown, or other
tggagctcaccgcggtggcggccgctctagaactagtggatcccccgggctgcaggaattcgcacgagaccattactaaaacattctaattcaaaaaacgtccgactgttggaaccttgatacatcgccttgtgctctcccccccggcccatgtttcccggcgcgaaggactgcaccagaaaagcgaacattgcctacggatgaaggaaagcctgcggcccagaaacaaagtcgtcttagaaatacatgaatgacgggctccaattaccagaggcaagaatcatcctctcctagagcaaggaactgtacgcgaagaaactcagtggggaacctccgagtgacttggcgatccgcgtgaagtatctctcgggtgacatttaggaccttgctggttcggggacgagagactacacgaactggaagattatccccaggtatcttctcntggaggatcagcaaccaatgaggaattcggggaaagcttctgaagttaattcacgaatggagggcggggaaaatctttgcttatcccccaaactccgccctttaggggataaaaagggctaggttatacccatcagaggaacccggttgtccaataaccgcagggcaaggccgccctaatcaaagcattagttgaaaacttttcctttttaagggcgtttttgataaaaacttcccccg

SEQ ID NO: 49800 - DNA, 668 bp, Zea mays
  misc_feature: Ceres CLONE 1461343-F
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (35)..(35): n is a, c, t, g, unknown, or other
  misc_feature (408)..(408): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (420)..(420): n is a, c, t, g, unknown, or other
  misc_feature (426)..(426): n is a, c, t, g, unknown, or other
  misc_feature (653)..(653): n is a, c, t, g, unknown, or other
nnttctatnnntattctattgggtacgggcccctntcgagccactgcagtggtaaagggttaaactagtggtagcttccttctgcgaagatttggtgcatttgactttgcgaaaccaggttcgggtaaaggtttgaaaattgaggacctggatttcactgatgaggagatggacatgtatgtggatctccacccgatcacaaatacatcaccttacacagtggttgagacgatgtcactgggaaaaacaccaatccttttccgggaacttggtttgagggcccttttggttgtgccaaagaccccacagaggcgtcccatagtcgggattctcacaagggatgattttctgcctgagcacattcccagttttttcccccccccccctcgcgggggggggggggggggncannnncccttnaacaanaaaatctttctgcttcacaaccaattggggataatcggggggccaccccaagtaaattgccaagggggaggggtaaccggttttccattgggaacccccccccccctgcccccccaatgttgtggtgggggggaaatttgtaaccaaagcgcccctttttcgggagaaaaaaaaagggtggggggttgttttggcggcggggaaaaaatccaattatgaagcgccgnggggggaaaaaacac

SEQ ID NO: 49801 - DNA, 633 bp, Zea mays
  misc_feature: Ceres CLONE 1461346-F
  misc_feature: Encodes the peptide sequence at SEQ ID NO. 49802
gccgtggtaaaggagccctaattttccggcgctacttccaatagtcgccctctcaacttttgttgggtccgtctgtggattgtccccggcctcctttccgtcgcgtccaaatcatcctcataccccgcagcatctccacgccgccacacctcgtcgcgtcgcgtcgtctccgccgagaagatggtcggaccaggcctctacaccgagatcggcaagaagaccagggatctgctgtacaaggactaccagacagaccacaagttcaccctcactacctacagctccaatggcgtcgctgtcactgctactagcacaaagaaagctgacctgatcttcagtgagatccattcacagataaagagaaagaacatgaccgtagatgtgaaagcaaactcagagtcaaatatcattactacagttactgtcaatgagattgcgacaccaggactgaagactatcttaagctttgctgttcctgatcaggagatctggaaaggttgagcttcagtatttgcatgattatgctggagttaatgcaggggttaggtctggaagccaattcctgtagccaaccttctctgcgggttttgggagctgaggggtctccggggttggtggcaagagatcttcatt

SEQ ID NO: 49802 - protein, 106 aa, Zea mays
  misc_feature: Ceres CLONE 1461346-F
MVGPGLYTEIGKKTRDLLYKDYQTDHKFTLTTYSSNGVAVTATSTKKADLIFSEIHSQIKRKNMTVDVKANSESNIITTVTVNEIATPGLKTILSFAVPDQEIWKG

SEQ ID NO: 49803 - DNA, 671 bp, Zea mays
  misc_feature: Ceres CLONE 1461350-F
  misc_feature (671)..(671): n is a, c, t, g, unknown, or other
cgattgggtaccgggccccccctcgagccctgcagtggtaaaggggtcgccgccgcgtctcgtcgcatcgcctccttttcccccgcccgcgcccggacggcggcctcgcctcgccagaagaacccaggctgcagccgaaacccccggtctccgtcatccgaccccgcctcgacggcccagatccacttgccgccgctgccctcgtgctcctcactccctcgcctcctccggggccgcggctccgcggcgaagacagctgcgagcggggcggccatttctaggcggaagcgcgggcggctgggctagcagattgattggtttgagtggttgggtcggctctaggaaacgccccgccgcggcgatggggtgcttccattccacggcgaagcggcaacaccctgtctacgaggaccccgtgcacctcgcctcccagaccgcctgaagaattccagctagcactatttaagaatcagaggaaagaacatcttttcgccaatcggatatttgaccttttcgatgtcaagaacaggggtgtcattgattttggtgactttgtccgagctctaaatgtgtttcatccaaatatcccaatggaagacaaagtcgatttctcgttcaagctatacgatatggatggcacacggtttattgaacgaaaggacacgcgcggn

SEQ ID NO: 49804 - DNA, 575 bp, Zea mays
  misc_feature: Ceres CLONE 1461354-F
  misc_feature (1)..(1): n is a, c, t, g, unknown, or other
  misc_feature (181)..(181): n is a, c, t, g, unknown, or other
  misc_feature (188)..(188): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
ncgattgggtaccgggccccccctcgagccctgcagtggtaaagggtgcgctgcggccgggtcggatctgagacgagacgagtcccctccccccacctcgcctcacccaaccggaacgaacaagttaccatctcatcccaaccccgcctcgaccggatctcgtcggactcggatccgcccngaccatnccccgtggcccggccggaaaaaatataaaaaaaaaaaaggggggggttttcttgaaaaacttttttccctttttccctttggaaaaattggggagaaaaaaaggaaaaaccccccgaaaaaatctttttgggaaaaaggggggccaaaaaaaaaagcctttttttaaaaccgcgcgcgtgggggggggaccccccccccccaagggggggtgtgttgttttgaaaaacccccccccaaaaaaaaaaaaannntgggggggggtttgtttttgggggaaaaaaaaccccacacccgcgggggggggggggggtgttttttaaaaaaaaaaaaaatgataattttggtgggggggaggggcgccccccccccccccctttttgtttttg

SEQ ID NO: 49805 - DNA, 655 bp, Zea mays
  misc_feature: Ceres CLONE 1461358-F
  misc_feature: Encodes the peptide sequence at SEQ ID NO. 49806
cgattgggtaccgggcccccctcgagcactgcagtggtaaagggggcgtctaggcctgtgactggctgcctgccttttcttctatcgtccgccctacgtctcagtctctgatggcgctcttgtggagctacacgacgaccattacggaagccctcgccgggtgcgcgatccaagctcggcgagcttcttccctgccgccttcgagcgggcgggcatcacccgatttctacatggcctacatcgtgttcacctcctctttgtaacggatgaggcctgtctacggaacaaaactgaatcgttcccaccacggccttccttgatgtctgctggcctatcttgcgtgtgatgtacaagttcggagctggtatggccgttgtctcgagtgatatcatcggccatattgcgaggttggagctgagcttgcttcagatctgtccctgatggacacttgcaccgcatgtatcatgaatagcttcagaaccatacggcgaaatgttcctcaagatgcacttatggtcttctgtgtctcacgacgaccatggatttcctaggtgagtcgctccgtatcctgcttgagcgtccggactggaccatgacatcggcttgcactgcatcatgcaccacgaccctgaataagtttcatgggtggcttgaa

SEQ ID NO: 49806 - protein, 39 aa, Zea mays
  misc_feature: Ceres CLONE 1461358-F
MDFLGESLRILLERPDWTMTSACTASCTTTLNKFHGWLE

SEQ ID NO: 49807 - DNA, 637 bp, Zea mays
  misc_feature: Ceres CLONE 1461375-F
  misc_feature: Encodes the peptide sequence at SEQ ID NO. 49808
  misc_feature (148)..(148): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (515)..(515): n is a, c, t, g, unknown, or other
cgattgggtaccgggcccccctcgagccctgcagtggtaaaggtgcccctgagccggaggaggaggaggcggccacggcggcgtacgcggggcagtggccgcgctggctgcagccgctgctttcggcgcgcttcttcgcgcactgcangacgcacggcgactcgcaccgcagcggcgagtgcaacatgttctgcctggactgctcccccnnncggtgcggcgcgggcccccgccccctgtgctcactgtggctgggggaggcccaccgcgaccacacaaccatccggatcgggggctcttcttacacgaagtcaatcgggggggctaaaatccagggttaagggaattcgccgggggggaaacctaattatttaaaagggccccggtttttttttccaaaaaaaagggcccccaaacaaaaaccttgaaataaagggcccctttgggccctccaacacttggaaaagggggggcccccgagacccccctaaaaaattcccttttttggccccccnaaaaaaaaaggggggggggggtgtccccaaaaaccccccaaagggcaaaaattggggcccccccgcccgcccttcgtggggaaaagggggggggaaaaaaaaaaacacctttttttctctcc

SEQ ID NO: 49808 - protein, 112 aa, Zea mays
  misc_feature: Ceres CLONE 1461375-F
  misc_feature (49)..(49): Xaa is any aa, unknown, or other
  misc_feature (70)..(70): Xaa is any aa, unknown, or other
IGYRAPLEPCSGKGAPEPEEEEAATAAYAGQWPRWLQPLLSARFFAHCXTHGDSHRSGECNMFCLDCSPXRCGAGPRPLCSLWLGEAHRDHTTIRIGGSSYTKSIGGAKIQG

SEQ ID NO: 49809 - DNA, 656 bp, Zea mays
  misc_feature: Ceres CLONE 1461377-F
  misc_feature: Encodes the peptide sequence at SEQ ID NO. 49810
  misc_feature (530)..(530): n is a, c, t, g, unknown, or other
cgattgggtaccgggccccccctcgagccactgcagtggtaaagggcggcctccacggctccacgtgacctcccagacctagacctagttgtccttcctgttcaacctgcatagcggcggcgcgtcctgccttcagagacagagggagagagagcgcttgatctccgcacgcatggcatgggaggagcaggcgctagaagaggaggattacggggaggacatgtcggcttcggagtcggaggatgacgtcgaggtgcggcacatgccgacggttatggtgccaaagcatatcaataagcggtccctgaataacaaggcgctgtctgttaccctcgacaacaaagcgctcagggatttcgtgactgggttcctcaagcggaagacaaagagaagaaaggaggcgcataagattttgcaggagaaggagaggaagactatgatacatgaccgcacgaggaggaaagaagagaaggagattgctctgtatggtagagtactgacatcgcataagaacgatggtgctggattanataacgaacatatcggcgatgatggtgaggatatggaaaatgacaaacctttgtctgatatcaaacctacgaagatgatgggaccagaactgtagtcaccaccagtgaaattctcctgaggagatg

SEQ ID NO: 49810 - protein, 150 aa, Zea mays
  misc_feature: Ceres CLONE 1461377-F
  misc_feature (120)..(120): Xaa is any aa, unknown, or other
MAWEEQALEEEDYGEDMSASESEDDVEVRHMPTVMVPKHINKRSLNNKALSVTLDNKALRDFVTGFLKRKTKRRKEAHKILQEKERKTMIHDRTRRKEEKEIALYGRVLTSHKNDGAGLXNEHIGDDGEDMENDKPLSDIKPTKMMGPEL

SEQ ID NO: 49811 - DNA, 690 bp, Zea mays
  misc_feature: Ceres CLONE 1461394-F
  misc_feature: Encodes the peptide sequence at SEQ ID NO. 49812
aagctggagctccccgcggtggcggccgctctagaactagtggatcccccgggctgcaggaattcgcacgagaccattacctagaacatcctaatcgaaaaacttcagttgcgggtgcggccactttctcccctttcctcagaccccaggccccagcccggcaagcagacatgggcaaccgtgcgtcgcgccaccaccgccaagccgccgagcagcaaccggcgacgccgaccctgccgaagccccagccccagatccagccgccgcctccgcctccgccgacgcaaacgcagcagtaccagcaggcgccgccgcagtcgcagcaaaagccgaaaccggcggcggacgtgggggcggtggggcgcgtgctggggcggcccatggaggacgtgcgcgcgacctacactttcggccgcgagctcgggcggggccagttcggggtcacctacctcgtcacgcactcggagaccgggcagcgcttcgcctgcaagtccatcgccacgcggaagctcgtccaccgcgacgacattgaggacgtgcgccgggaggtgcagatcatgcaccacctcacgggccaccgcaacatcgtcgagctccggggagcatacgaggacaggcactcggtcaaccttgttatggagctctgcgagggcggggagctcttcgaccgcatcatagccaagggccact

SEQ ID NO: 49812 - protein, 173 aa, Zea mays
  misc_feature: Ceres CLONE 1461394-F
  misc_feature: SWISSPROT Homolog: EC 2.7.11.1 Non-specific serine/threonine protein kinase
MGNRASRHHRQAAEQQPATPTLPKPQPQIQPPPPPPPTQTQQYQQAPPQSQQKPKPAADVGAVGRVLGRPMEDVRATYTFGRELGRGQFGVTYLVTHSETGQRFACKSIATRKLVHRDDIEDVRREVQIMHHLTGHRNIVELRGAYEDRHSVNLVMELCEGGELFDRIIAKGH

SEQ ID NO: 49813 - DNA, 687 bp, Zea mays
  misc_feature: Ceres CLONE 1461396-F
  misc_feature: Encodes the peptide sequence at SEQ ID NO. 49814
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
cgctcttttctagtggatcccccgggctgcaggaattcgcacgagaccattacctagaacatcctaatcgaaaaaagcagcagccgtccgtggaagaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctggcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacannncacaagatcactgggccctgaagggacaagcagagttcatcgacatggtggagaccgtatacgggggcgcccggaaagccgggggtcttgtggatgctcccaagggactaccccaccaagacccgtactaaaaaaggggggattccccttttgcaatcttttgggaatgtttccccgcccgttattcccgaagggggaccccaaagggtttttgggcaccccccaaaaatcaaggtgggggggggggggggggtttttaccgggttggggggccccaaagaaaaaattaa

SEQ ID NO: 49814 - protein, 142 aa, Zea mays
  misc_feature: Ceres CLONE 1461396-F
  misc_feature (4)..(136): Pfam Name: DIM1 Pfam Description: Mitosis protein DIM1
  misc_feature (99)..(99): Xaa is any aa, unknown, or other
  misc_feature (100)..(100): Xaa is any aa, unknown, or other
MSYLLPHLHSGWAVDQAILAEEERLVIIRFGHDWDETCMQMDEVLAAVAETIKNFAVIYLVDITEVPDFNTMYELYDPSTVMFFFRNKHIMIDLGTGNXXQDHWALKGQAEFIDMVETVYGGARKAGGLVDAPKGLPHQDPY

SEQ ID NO: 49815 - DNA, 713 bp, Zea mays
  misc_feature: Ceres CLONE 1461398-F
  misc_feature: Encodes the peptide sequence at SEQ ID NO. 49816
  misc_feature (713)..(713): n is a, c, t, g, unknown, or other
aaagctggagctccccgcggtggcggccgctctagaactagtggatcccccgggctgcaggaattcgcacgagaccattacctagaacatcctaatcgaaaaagttattactcaaaatccatgccattaaaaaggacttcaactccaagcggaacacttctactcccgttgttaaacggcactaccaacgaaacaacgaggaagaaggccgggagaggaaatcctttggcggcgcgcgcacgcgcggcagacacgtccacatccactgcagcgacgagccagccggtccgcggtcagcagcttggcagcagccccactctggctcccccctccgccatcactgcgcttgtgcgcgcgcacccacccccgcggcccgctcatcacccgcccggtcccgccgcctatttaacgccgcccccaccggggcactcggccctctccgtctcagaacgccccagccttccacctcgaactccgcggcgcccagcgccctcggtaaccgccccccgccccgccacagagacaggtcgacgagacagacaaaggccggccgccatgggagaggacaagaaggcgggcaacaaggacgccgccggcggcgacaagaagaaggacgccggcgccggggccgcgccgcagcccatcgtgctgaaggtcgacttgcactgcgccggctgcgccaacaaggtccgcaaggccatcaagcacgcccn

SEQ ID NO: 49816 - protein, 52 aa, Zea mays
  misc_feature: Ceres CLONE 1461398-F
MGEDKKAGNKDAAGGDKKKDAGAGAAPQPIVLKVDLHCAGCANKVRKAIKHA

SEQ ID NO: 49817 - DNA, 718 bp, Zea mays
  misc_feature: Ceres CLONE 1461406-F
  misc_feature: Encodes the peptide sequence at SEQ ID NO. 49818
ctccccgcggtggcggccgctctagaactagtggatcccccgggctgcaggaattcgcacgagaccattacctagaacatcctaatcgaaaaaaaccggccctgactccctgaggtttgacggaggttgggttggatgggtggcccttcctctccccgtcgggagaacgacggcgaggggagtggcgggagatctccggctccggcgacatggaaggagcgcccgaggtccttcgacgagaagaccaggacggcgtgttggcgtaaggcagcggtgctgtcgggacggcacccggaacgctggcggcaggacgccgtgggcaacgtggtctgccgccgtttctggggctgccacggatgcctctgctacgagtacgaccacatcgtccctttctccgaaggagagaatctactgttgagaactgccagatcctcccgactagggttgaaccgtttcaaatctgaataagcatgggtaagcgcaagcagaaatgcaaggttttttcctgcgaatttttgtttactggaaaggggctaaaattaattggaaatgcttgggaccggggaactccctttctccccggaaaaccattggccttgccaaaaaaaaacccaaggggtcccgggggggggaaacccaaaaaatccctggggttctctcccatttttattctctttcccaaagggaattggggttttttttcccaaaggatatattg

SEQ ID NO: 49818 - protein, 110 aa, Zea mays
  misc_feature: Ceres CLONE 1461406-F
MGGPSSPRRENDGEGSGGRSPAPATWKERPRSFDEKTRTACWRKAAVLSGRHPERWRQDAVGNVVCRRFWGCHGCLCYEYDHIVPFSEGENLLLRTARSSRLGLNRFKSE

SEQ ID NO: 49819 - DNA, 704 bp, Zea mays
  misc_feature: Ceres CLONE 1461407-F
  misc_feature: Encodes the peptide sequence at SEQ ID NO. 49820
  misc_feature (356)..(356): n is a, c, t, g, unknown, or other
  misc_feature (357)..(357): n is a, c, t, g, unknown, or other
  misc_feature (404)..(404): n is a, c, t, g, unknown, or other
  misc_feature (419)..(419): n is a, c, t, g, unknown, or other
  misc_feature (451)..(451): n is a, c, t, g, unknown, or other
aaagctggagctccccgcggtggcggccgctctagaactagtggatcccccgggctgcaggaattcgcacgagaccattacctagaacatcctaatcgaaaaaaaacatctcctttgtatcggcctcggcaatcctgaccggatcaacaaagacgtagctaccccctcccgcgtccgtcgaattcgcctccgccgcctgctcgatccggtgggaattcgccgctgccgggttgttttcgctggggtgattaaggctcgggattcgagatctacgcgagtcgcgggcaagcagccatgagcgaggtgttcgagggctacgagcggcagttactgcgaggcctcccgctcgctctccnngcagtgcactgctgcctccgccttcgatggggagaagagaagcaaangctgtccaagatccnatccgggcgtgagaagctgaatcgctgattcntaagatggactggaggcagggacctacaggctaccattagggctggttgcttgcaagctgagggaattaaatctgacctcacaccgccaaagggacctaaaaaggttccccgcccaatgtttggggggtccccgggagagccccgggaacggaagggggaaacccccgggggctatttgtaagggggggatttgtgaaacccctgaaaaacggtttcccccccgggaaaataaaagaagcccaaaaatttttg

SEQ ID NO: 49820 - protein, 50 aa, Zea mays
  misc_feature: Ceres CLONE 1461407-F
  misc_feature (21)..(21): Xaa is any aa, unknown, or other
  misc_feature (37)..(37): Xaa is any aa, unknown, or other
  misc_feature (42)..(42): Xaa is any aa, unknown, or other
MSEVFEGYERQLLRGLPLALXAVHCCLRLRWGEEKQXLSKIXSGREKLNR

SEQ ID NO: 49821 - DNA, 722 bp, Zea mays
  misc_feature: Ceres CLONE 1461408-F
  misc_feature: Encodes the peptide sequence at SEQ ID NO. 49822
caaagctggagctccccgcggtggcggccgctctagaactagtggatcccccgggctgcaggaattcgcacgagaccattacctagaacatcctaatctaaaaattatatacatccatcggcatagcacgtgcgaggatgcgacagcgagcagcggtgtcgatttttagggcattgtgatttgttgagaaattcgtagggtatacgaaaacctctccgccgaactcctgcagatcctaattaacctccaccagctgcaccaattgccgctggcgatggatggtagcggacgagctctcgattgccgcagcttctggaaggccggcgcgtacgaagcccccactgctccgaccagggagttccaagatgtccttgagacgggagacttcgaccgcgcgcgcgtgcaccccaagttcctccacaccaacgccacctcccacaagtgggctttcggaggttcgtgatgccttcggatggttcaatcttattggtgttaccttattagggcaaccgttagggcaaagaagagaaagagaaatccttttagcttgtgtgttcacgctagtcacaacattgttttacatgtccttaatgagtcatatacatgtagtccaatgtacttaattcgaactttatttttgtccaaagtccactacataacattctttggtattttgtcataaggtttctccaagccaataaaaaatatgtgaagatccttcc

SEQ ID NO: 49822 - protein, 62 aa, Zea mays
  misc_feature: Ceres CLONE 1461408-F
MDGSGRALDCRSFWKAGAYEAPTAPTREFQDVLETGDFDRARVHPKFLHTNATSHKWAFGGS

SEQ ID NO: 49823 - DNA, 738 bp, Zea mays
  misc_feature: Ceres CLONE 1461410-F
  misc_feature: Translation starting site: 171
  misc_feature (332)..(332): n is a, c, t, g, unknown, or other
ccaagctggagctccccgcggtggcggccgctctagaactagtggatcccccgggctgcaggaattcgcacgagaccattacctagaacatcccaatcgaaaagtttttggataaagcactctcttctctcctggagcagagcctcacagctccgtcgtcaatcctagcaatggcttcctcagtcgtcacttcttttcaacccaggtctgcatttttgggagataggaacgtgttcaaggtctcaaacactccgtatgcacaagtgggttactcaaggaagaccattgagtgtaaggaatcaaggatagggaaagcacccatcgctgtaccnaccaatgtaaccattgcattggaaggtcaagacttgaaagtcaaaggtcactaggagagctcgcttttacttaccaccgcgaagttgagctcatcaaagaagatgcttgtgttctggagggtaaaaagaacgtggaaactaaaaaagcttaccaatgcccgggctccttgggaccctaaggaaaaaagggtatggggaaattcaaagggtttttaaaaaaactgaaccctgggggagttgtgtccccggcccccgggaaggggaaaaaagggttttaaaccccggttttttccccccgggtaaaaggaaaaacccgaaaattcccggggggggggggaaaaaaacccgggtcccgggggggggggaaaaaaaaaaaaaaaaggggtttttttgcgcccagaaaaaa

SEQ ID NO: 49824 - DNA, 693 bp, Zea mays
  misc_feature: Ceres CLONE 1461413-F
  misc_feature: Encodes the peptide sequence at SEQ ID NO. 49825
ggagctccccgcggtggcggccgctctagaactagtggatcccccgggctgcaggaattcgcacgagaccattacctagaacatcctaatcgaaaagttgcgacttctagcatatcatcggcatcgcctgctctgctggtgaagagcgaaggggccaagaccacacgccttccaaggtccacacctaccccaagagccgcccgccccatcagccgccacgatgtgcaccctggagcagcgcggccgcgtcttcgtcctcacccttaccggcgacggcgagcaccgcctgggccacgccctcatctcctcgctccgatccgccgtcgcctccgccgtgtctggcgcggccaaggcggggcccggggccgcgctcgtcaccgtcggcgagggccgcttcttctccaacggcctcgacatcgggtgggcgggaacctcccgcgcgcgcctaggcgagctcgtcgacgcgctccgcccgctcgttgccgacctcctcgcgctccccatgcccaccgtcgccgccgtcaccggccacgcctccgcgggcggctgcctcctcgcgctctgccacgactaccgcatcatgcgcggggaccgcggagtgctctacatgagcgaggtcgacatcggcctcccccttccgccctacttcatggccgtgctccgcgccaagatcagcgccgccaacgcgctccc

SEQ ID NO: 49825 - protein, 157 aa, Zea mays
  misc_feature: Ceres CLONE 1461413-F
  misc_feature (11)..(157): Pfam Name: ECH Pfam Description: Enoyl-CoA hydratase/isomerase family
  misc_feature: SWISSPROT Homolog: EC 5.3.3.8 Dodecenoyl-CoA isomerase
  misc_feature: The sequence is a functional homolog of SEQ ID NO 4 in US patent 7135618
MCTLEQRGRVFVLTLTGDGEHRLGHALISSLRSAVASAVSGAAKAGPGAALVTVGEGRFFSNGLDIGWAGTSRARLGELVDALRPLVADLLALPMPTVAAVTGHASAGGCLLALCHDYRIMRGDRGVLYMSEVDIGLPLPPYFMAVLRAKISAANAL

SEQ ID NO: 49826 - DNA, 698 bp, Zea mays
  misc_feature: Ceres CLONE 1461416-F
  misc_feature: Encodes the peptide sequence at SEQ ID NO. 49827
  misc_feature (698)..(698): n is a, c, t, g, unknown, or other
caaagctggagctccccgcggtggcggccgctctagaactagtggatcccccgggctgcaggaattcgcacgagaccattacctagaacatcctaatcgaaaaataccctagccgccacacctaacgacccacacgagcaccaagccgaggggaggggcgatggcgagaggtgtggtgtcgacgaagggcggcacggccgcgggcaagaagaaggggtcggtagccttcacgatcgactgcaccaagcccgtggaggacaagatcatggagatcgcctcgctcgagaagttcctgcaggagcgcatcaaggtcgccggcggcaaggccggcaacctcggcgactccgtcaccatctcccgcgagaagaccaaggtcaccgtaacctgcgacgggcccttctccaagaggtatctgaagtacttgaccaagaagtacttgaagaagcacaaggtgcgagattggctccgtgtgattgcagccaacaaggaccacagcgtctatgagctgcggtacttcaacattgctgagaacgagggcgaggaagaagattagactgcattgcacattgctgagaacgagggcgaggaagaagattagactgcattgcacttatatctcagttttgaactcattggatttgatacttgtacccgtagttttgcaaatgcccccatgttatgctctggtgaattttggn

SEQ ID NO: 49827 - protein, 130 aa, Zea mays
  misc_feature: Ceres CLONE 1461416-F
  misc_feature (16)..(130): Pfam Name: Ribosomal_L22e Pfam Description: Ribosomal L22e protein family
MARGVVSTKGGTAAGKKKGSVAFTIDCTKPVEDKIMEIASLEKFLQERIKVAGGKAGNLGDSVTISREKTKVTVTCDGPFSKRYLKYLTKKYLKKHKVRDWLRVIAANKDHSVYELRYFNIAENEGEEED

SEQ ID NO: 49828 - DNA, 679 bp, Zea mays
  misc_feature: Ceres CLONE 1461420-F
  misc_feature: Translation starting site: 538
aaagctggagctccccgcggtggcggccgctctagaactagtggatcccccgggctgcaggaattcgcacgagaccattacctagaacatcctaatcggaaaatcctattccttccaccctgctctcctcgtccactgtctcggtgtctcctctgctcccccaccaaagcaagattcactcgcccggccggccgccatggccagatcagcgccggggctgccgccgcagccctacgccgccgcggtcgccggccgccgctcctcctcctcacccgcggcgtcttgcatcttggcggtcctcttcctcctcctagccgcctgcgtcgcggcggtgcctgctgttccgtgctcttccgcccgcgcgcgccggctatccccgtgacggccgtgcagcctcccccgccttccccgtggccaacggcaccgtccccttcaccttccagcagctggcttccgtgcgcaaccccaaccgttccccgctcgcgcactacgacagctccctccacgtccccctacgccggcggcgaggtcggctccatgtacatcccggcaggccagatcgacggcggccgcacgcagtacatggccaccagcttcaccgtccccgccttccccgtctcggccacgggcgccgccgcgcagccaacaccatctcccgtcccgggcgtccggcccgtcc

SEQ ID NO: 49829 - DNA, 739 bp, Zea mays
  misc_feature: Ceres CLONE 1461423-F
  misc_feature: Encodes the peptide sequence at SEQ ID NO. 49830
  misc_feature (342)..(342): n is a, c, t, g, unknown, or other
  misc_feature (372)..(372): n is a, c, t, g, unknown, or other
  misc_feature (384)..(384): n is a, c, t, g, unknown, or other
  misc_feature (410)..(410): n is a, c, t, g, unknown, or other
  misc_feature (415)..(415): n is a, c, t, g, unknown, or other
  misc_feature (522)..(522): n is a, c, t, g, unknown, or other
  misc_feature (583)..(583): n is a, c, t, g, unknown, or other
tcaccgcggtggcggccgctctagaactagtggatcccccgggctgcaggaattcgcacgagaccattacctagaacatcctaatcgaaaacccagaacaagaagcagacccagggagaagtgaccaagtgtctcaagcaacctcccgtcctccccgccgccgcttccttgtttctctcctccaatccacacccacccaccactctcctcttctcttctctcgaaaaaagaaccagctagcgagcaatccatatccccgccatgtccgcgtcgccggagttctacaagccagcgccgccggcgttctcgccgccgacgctcctcctgcactgggcagggacngacgacagcgcctgcgtcgcgaccatgtgncaggaggatcangactactgctgccggaaccccaacgncggcnaaaagcaagtgaaaccgccggggaacgtgccgccggccccccggaaccgccgggcgtccgcgggttgccggagcccccttgtcaaagccaaaatgctcaccctgcgnttggaaaaactggaaaatttttttggggggccgggcccggggcttttcgggggcggggccngcccaaaaaaaaaacccccaaaggggggccttccccggccccaaaaaaaaacccaaaaaacttggaaaaaaacttttccggaaggagggggcccaaaaggaaaaaaaaaaaaaaacccgttttattgggtgggggcaatagttttttttaaaaaaa

SEQ ID NO: 49830 - protein, 159 aa, Zea mays
  misc_feature: Ceres CLONE 1461423-F
  misc_feature (37)..(37): Xaa is any aa, unknown, or other
  misc_feature (41)..(41): Xaa is any aa, unknown, or other
  misc_feature (50)..(50): Xaa is any aa, unknown, or other
  misc_feature (52)..(52): Xaa is any aa, unknown, or other
  misc_feature (108)..(108): Xaa is any aa, unknown, or other
MSASPEFYKPAPPAFSPPTLLLHWAGTDDSACVATMXQEDXDYCCRNPNXGXKQVKPPGNVPPAPRNRRASAGCRSPLVKAKMLTLRLEKLENFFGGPGPGLFGGGAXPKKKPPKGGLPRPQKKTQKTWKKTFPEGGGPKGKKKKNPFYWVGAIVFFKK

SEQ ID NO: 49831 - DNA, 679 bp, Zea mays
  misc_feature: Ceres CLONE 1461424-F
  misc_feature: Encodes the peptide sequence at SEQ ID NO. 49832
  misc_feature (679)..(679): n is a, c, t, g, unknown, or other
gcggtggcggccgctctagaactagtggatcccccgggctgcaggaattcgcacgagaccattacctagaacatcctaatcgaaaagttgcgacttctagcatatcatcggcatcgcctgctctgctggtgaagagcgaaggggccaagaccacacgccttccaaggtccacacctaccccaagagccgcccgccccatcagccgccacgatgtgcaccctggagcagcgcggccgcgtcttcgtcctcacccttaccggcgacggcgagcaccgcctgggccacgccctcatctcctcgctccgatccgccgtcgcctccgccgtgtctggcgcggccaaggcggggcccggggccgcgctcgtcaccgtcggcgagggccgcttcttctccaacggcctccacatcgggtgggcgggaacctcccgcgcgcgcctaggcgagctcgtcgacgcgctccgcccgctcgttgccgacctcctcgcgctccccatgcccaccgtcgccgccgtcaccggccacgcctccgcgggcggctgcctcctcgcgctctgccacgactaccgcatcatgcgcggggaccgcggagtgctctacatgagcgaggtcgacatcggcctcccccttccgccctacttcatggccgtgctccgcgccaagatcagcgccgccaacgcgn

SEQ ID NO: 49832 - protein, 156 aa, Zea mays
  misc_feature: Ceres CLONE 1461424-F
  misc_feature (11)..(156): Pfam Name: ECH Pfam Description: Enoyl-CoA hydratase/isomerase family
  misc_feature: SWISSPROT Homolog: EC 5.3.3.8 Dodecenoyl-CoA isomerase
MCTLEQRGRVFVLTLTGDGEHRLGHALISSLRSAVASAVSGAAKAGPGAALVTVGEGRFFSNGLHIGWAGTSRARLGELVDALRPLVADLLALPMPTVAAVTGHASAGGCLLALCHDYRIMRGDRGVLYMSEVDIGLPLPPYFMAVLRAKISAANA

SEQ ID NO: 49833 - DNA, 683 bp, Zea mays
  misc_feature: Ceres CLONE 1461425-F
  misc_feature: Encodes the peptide sequence at SEQ ID NO. 49834
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
tggcggccgctctagaactagtggatcccccgggctgcaggaattcgcacgagaccattacctagaacatcctaatcgaaaattttttggcagaatacccccctgcctcttattcggcccccgctcgcccctgcagtgccatccgctgctcttctccgttcgaccgcccgcccgcccgcccgcccctcctctctctctgtctcgccgcccggggagaaggagggctccgccgctcccggggaagagcgcgccattgccgccgccgcgctgactggggaagatggttgtccaggagttcacagttgatcacaacaagccccttgttttccaggttggccatcttgaggaacggtaccaggaatgggttcaccaaccgatcgtcagcaaggacggtccacgctttttcggaaatgatgtcctggagttcttgactccacaatgtgctggcactctgaatgctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 49834 - protein, 60 aa, Zea mays
  misc_feature: Ceres CLONE 1461425-F
MVVQEFTVDHNKPLVFQVGHLEERYQEWVHQPIVSKDGPRFFGNDVLEFLTPQCAGTLNA

SEQ ID NO: 49835 - DNA, 704 bp, Zea mays
  misc_feature: Ceres CLONE 1461438-F
  misc_feature: Encodes the peptide sequence at SEQ ID NO. 49836
aaagctggagctccccgcggtggcggccgctctagaactagtggatcccccgggctgcaggaattcgcacgagaccattacctagaacatcctaatcgaaaaatcgccatggatttctcttaggctcacccgtccgctcggctcgcttccttccccactctctctgatcccgtcgcacttccctcctcgctgcagcccctctattattgcgattaccgtttcctcactgccctttcctttttcggtcggcagcaatcaccggggcaagcgaaccctcgatttgcgtccccgctctctgctagcgcccctaaaagaggagcgaagcgatgtctatgccggagacgggtcaggccgcggagagggatgaccaccaccaggcccggaggggaagcactgatgcagggcatctggcccccccccgtaccgaaaggccgataaacccgccctgccccatcaagcaaggttctctaccttggggatctgttggaaacagcattccaataagggaccctcctcaaaaacttggaacatccccccatatcttggatccgttgcaaaagccccggggaccccggattttccccgctgaatttttattttcccaagaagattgcgaagtgactttgtattcccccaaaacccggatttgtgtaaaaaccattcccaaaagaaggcctttgggtcttccaaaaaaagaagcctta

SEQ ID NO: 49836 - protein, 126 aa, Zea mays
  misc_feature: Ceres CLONE 1461438-F
MSMPETGQAAERDDHHQARRGSTDAGHLAPPRTERPINPPCPIKQGSLPWGSVGNSIPIRDPPQKLGTSPHILDPLQKPRGPRIFPAEFLFSQEDCEVTLYSPKTRICVKTIPKRRPLGLPKKEAL

SEQ ID NO: 49837 - DNA, 688 bp, Zea mays
  misc_feature: Ceres CLONE 1461440-F
  misc_feature: Encodes the peptide sequence at SEQ ID NO. 49838
  misc_feature (360)..(360): n is a, c, t, g, unknown, or other
ctccccgcggtggcggccgctctagaactagtggatcccccgggctgcaggaattcgcacgagaccattacctagaacatcctaatcgaaaacttatcccccgcctcctccggtcctcccgccgctgttgctcacttctgagtcccgacgcacgagctcccaagagctagccatggcgtccaccaccctctcctccgccttcaccctcctctcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgncgggttcaccctcgaggaggcccgcagcctcgtcgaccacctccaggagcgggtcggcgtcaccgccgcggtcttcgcgccggccgccgtcgtcccgccccccgggcgggcggcgggcccgcggcctaggaagggggccccctccaaaaaaacggagttcgactggatgatccaagaggggcccagacatcgcggggacccccccctatcagggggggtgggcgcgttcaccacccttctctgctcagggagggccaaggacctttatcgagggtcccccccaagaaaggtcaaaaaagcgcctcccacaaaggaccaaggcccaaga

SEQ ID NO: 49838 - protein, 172 aa, Zea mays
  misc_feature: Ceres CLONE 1461440-F
  misc_feature (63)..(63): Xaa is any aa, unknown, or other
MASTTLSSAFTLLSRPSTSPCPAASLPRSSHAAPHIRRGRRAVAVACTATESPKILELGDAIXGFTLEEARSLVDHLQERVGVTAAVFAPAAVVPPPGRAAGPRPRKGAPSKKTEFDWMIQEGPRHRGDPPLSGGVGAFTTLLCSGRAKDLYRGSPPRKVKKAPPTKDQGPR

SEQ ID NO: 49839 - DNA, 702 bp, Zea mays
  misc_feature: Ceres CLONE 1461444-F
  misc_feature: Translation starting site: 194
  misc_feature (377)..(377): n is a, c, t, g, unknown, or other
atagctggagctccccgcggtggcggccgctctagaactagtggatcccccgggctgcaggaattcgcacgagaccattacctagaacatcctaatcgaaaacgccccgctccttgcctccgatccccaattcctccttcggatctcgcattcagcgcagcgcaggtgtgaaggaagggggacgcggaggaagatggggctcgcgttcggggaagctcttcagccggctcttcgccaagaggagatgcggatcctcatggtcggcctcgacgccgccggtaaaacaccatcctctacaagctcaagctcggcgagatcgtcaccaccatccccaccatcggtttcaatgttgaaactggtgagtacaagaacattancttcactgtctgggatgtcggggggtcaggacaagatcagacctctttggaggcattacttccagaacacccagggtcttatttttggtgtgggacagcaatgacccgtgaccgtgttggtgaagcccagagatgacttccccagggatgctgaacgaggatgacctacgtgaggctgggctgcttggttttgccaacaagcaaaatctctcccatgccatgaatgctgctgaaattacggaaaagctggaattaacctccctgcgccggcgacactgggtacatccagagactttgggccaaacctggggaggggcctgtttga

SEQ ID NO: 49840 - DNA, 670 bp, Zea mays
  misc_feature: Ceres CLONE 1461446-F
  misc_feature: Encodes the peptide sequence at SEQ ID NO. 49841
ggagctccccgcggtggcggccgctctagaactagtggatcccccgggctgcaggaattcgcacgagaccattacctagaacatcctaatcgaaaaccttaggaagttgtcactcaccaaggccaaaagttaccttgaggatgtgatcgcccacaagcaggccatcccgttccgcaggtattgtggtggtgttgggcgcactgctcaggctaagtctcgccactcaaatggtcagggacgctggcctgtcaagtctgctaaattcattctagaccttctcaagaatgcagagagcaatgctgaggtgaaaagacttgatgtggataccctctatgtgtcgcacattcaagttaatcaggctcagaaacagcgacgcaggacataccgtgctcatggacgcatcaacccttacatgtcctccccatgccacatagagctcatcttgtcggagaaggaagaaccagtgaagaaagaagccgagtctcagatcgcaaccagaaaggcttagagaaggggctctatcttctgtgattggcttagtacaagttttggctgattatttgttgtctcatactgtttacctgagtattgtttgcaagtgctttatcactggtcgaactgtgcatgccattcactggtctagaatatttgtcgtggattggttcatttt

SEQ ID NO: 49841 - protein, 31 aa, Zea mays
  misc_feature: Ceres CLONE 1461446-F
MSSPCHIELILSEKEEPVKKEAESQIATRKA

SEQ ID NO: 49842 - DNA, 681 bp, Zea mays
  misc_feature: Ceres CLONE 1461451-F
  misc_feature: Encodes the peptide sequence at SEQ ID NO. 49843
  misc_feature (325)..(325): n is a, c, t, g, unknown, or other
  misc_feature (350)..(350): n is a, c, t, g, unknown, or other
  misc_feature (386)..(386): n is a, c, t, g, unknown, or other
  misc_feature (392)..(392): n is a, c, t, g, unknown, or other
  misc_feature (435)..(435): n is a, c, t, g, unknown, or other
  misc_feature (480)..(480): n is a, c, t, g, unknown, or other
ctggagctccccgcggtggcggccgctctagaactagtggatcccccgggctgcaggaattcgcacgagaccattacctagaacatcctaatcgaaaaaatcccgatcagtcgccgcccaagcctagcagatccgccggcgagcgcgcgggggcaatgggtgtcgtctcggcagcggcggacgcgattgtcgcgtttttctccctcacatcgtcgtcgcggcgcgctactcgacgcgcagtccgtcctccgcataccctctaccgggcgccgctcctgggactcaagcgctggtacgccgccgagtttggcgactacctcatggnccagccccccggcttcttccgtggncttgttttgctcgagctcgccttccatgggcgctcngcgtcnccacactctacggcatcctcacccgccgccgctgggctgccanccactccctcatggggcggcgtggcaccctcaccctcatgtctgncattcttggtgagatgttagggtcaggcaaatcaacacccaggttgcttcagatgtatgtcccttatgctgtttttgctgccattgctattcgacgtggactttgctcatgctctggacccactactgctggttcatcacttgggcctctgcccggaagaggggggctaaatcagccgtgacactggaagattttcggttt

SEQ ID NO: 49843 - protein, 114 aa, Zea mays
  misc_feature: Ceres CLONE 1461451-F
  misc_feature (57)..(57): Xaa is any aa, unknown, or other
  misc_feature (94)..(94): Xaa is any aa, unknown, or other
  misc_feature (109)..(109): Xaa is any aa, unknown, or other
MGVVSAAADAIVAFFSLTSSSRRATRRAVRPPHTLYRAPLLGLKRWYAAEFGDYLMXQPPGFFRGLVLLELAFHGRSASPHSTASSPAAAGLPXTPSWGGVAPSPSCLXFLVRC

SEQ ID NO: 49844 - DNA, 699 bp, Zea mays
  misc_feature: Ceres CLONE 1461454-F
  misc_feature: Encodes the peptide sequence at SEQ ID NO. 49845
ggagctccccgcggtggcggccgctctagaactagtggatcccccgggctgcaggaattcgcacgagaccattacctagaacatcctaatcgaaaaaaccacgagccaagcgcgacggatcccaatccatcttctcctcatccccaccacgaccaaaaaaaatccggtcgccgatgccgtctgctgcctgacatcggtcagccagggtagatcgcgcaggcaggcagccccacacacatacgaaacccaatcctgcttcgatcccgtcggccggcgatggagggccggcggccgggcgcgcccgtggcgggcctgcccatcggcttccgcttccgccccaccgacgaggagctgctgctgcactacctccgccgcaaggcgctggcctgcccgctccccgccggcgtcatccccgacgccgacctcgcgcgcctccacccgtgggacctcctccccgccgccgcaccagggggatccggagccgacgccgacggggagcgcttcttcttccaccgcccggggagcagtgtgggccaagggggggggcggccccggccagggcggccggccccggcgtctgggaggccgccgggaaaggaaaaccttcgtcctgtcccccgcgctgcaagacgccccgtcgggacccaagcgaaacccttgtattttgcccccgcttggggcccacgcccgaaccaaagc

SEQ ID NO: 49845 - protein, 141 aa, Zea mays
  misc_feature: Ceres CLONE 1461454-F
  misc_feature (13)..(139): Pfam Name: NAM Pfam Description: No apical meristem (NAM) protein
MEGRRPGAPVAGLPIGFRFRPTDEELLLHYLRRKALACPLPAGVIPDADLARLHPWDLLPAAAPGGSGADADGERFFFHRPGSSVGQGGGRPRPGRPAPASGRPPGKENLRPVPRAARRPVGTQAKPLYFAPAWGPRPNQS

SEQ ID NO: 49846 - DNA, 700 bp, Zea mays
  misc_feature: Ceres CLONE 1461455-F
  misc_feature: Encodes the peptide sequence at SEQ ID NO. 49847
  misc_feature (139)..(139): n is a, c, t, g, unknown, or other
  misc_feature (145)..(145): n is a, c, t, g, unknown, or other
  misc_feature (402)..(402): n is a, c, t, g, unknown, or other
aaagctggagctcaccgcggtggcggccgctctagaactagtggatcccccgggctgcaggaattcgcacgagaccattacctagaacatcctagtcgaaaagactacagagaaccggaggactgaggaggaggagganacctcncgcctgcgcggctgcgcccaccatggacgaggaggagttccggcgcatgctcgacctcttcccggtcgtccgctcccgagactactgctgctccgatcttggaacatccagcagaggaaccaaacagcgatcacgagttctggagccaactaagggggataataaggactcgtccggtggacaagatatgtttatgcagaaattgaagatggttgtttttcaccccccccggaggggggggggggggggttcttctncaaaaactttccaacaccccccttgacaaaccttgttcccccaggggctggaatttggagggcgggctaaaaagttcccttgaccgcatttgaaagcctgttgatgcaaccctagggctgcctcgcccctctaggggtcggggggcttgcccagcgattctgggaaaatctttgcacccccgttgaaaattttgaacccccgccacctttttttgacccccggcccaacgttgcctaggcgccattccgacacccccctccgtcggggctccgcccctccgcccagacgccccctccc

SEQ ID NO: 49847 - protein, 86 aa, Zea mays
  misc_feature: Ceres CLONE 1461455-F
  misc_feature (79)..(79): Xaa is any aa, unknown, or other
MDEEEFRRMLDLFPVVRSRDYCCSDLGTSSRGTKQRSRVLEPTKGDNKDSSGGQDMFMQKLKMVVFHPPRRGGGGGSSXKTFQHPP

SEQ ID NO: 49848 - DNA, 818 bp, Zea mays
  misc_feature: Ceres CLONE 1461460-F
  misc_feature: Encodes the peptide sequence at SEQ ID NO. 49849
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (806)..(806): n is a, c, t, g, unknown, or other
gttatgtcacgccctcccccctgccatttaatnnnnnnnnnnnnggggtttnnnnttaaagctggtactccccgcggtggcggccgctctagaactagtggatcccccgggctgcaggaattcgcacgagaccattacctagaacatcctaatcgaaaattccaagcgagggttttgctgctgctccagccggacccaggacaagaagcggcgcgatggcggtgggcgacctggcgttcaaggcgctgacggctgggctgggcgtcgccacgctctacctcgccgccaccttctccgtcaacgtctaccgcggcctctcgtggcactccgagcagtccaagctagaataggcgaaaaccgaagattgaaaaagacccccaagcagtttttagagagcaaacgacaggcgaggaattttttgttgaatgtcttatccttccggcggcgaggggggcttttcgcctcgcccccctataacctttcccccacccccccccagcggcacccctcaaacttatcccgaccctttcatattaccaccccccggaaacccggcccgggcgaaaggactaattcccgccttgcccggcaacacattcccggacttgggagtcattttttcccacaacactcctcgaactgcgcctggtggaataagaacaaaaaacaataagaaggttgatcctaattcaccctccacccctccaaacgggggggccccccgctaccccctatttctcgccacctaagatcaagccgttactcgccccgtgcgtctcaacggtccgcactccacctttcacagncgtccccacacc

SEQ ID NO: 49849 - protein, 44 aa, Zea mays
  misc_feature: Ceres CLONE 1461460-F
MAVGDLAFKALTAGLGVATLYLAATFSVNVYRGLSWHSEQSKLE

SEQ ID NO: 49850 - DNA, 699 bp, Zea mays
  misc_feature: Ceres CLONE 1461463-F
  misc_feature: Encodes the peptide sequence at SEQ ID NO. 49851
tccccgcggtggcggccgctctagaactagtggatcccccgggctgcaggaattcgcacgagaccattacctagaacatactaatcgaaaattgacataggttcctgtgtctacatagacttcaatgggagcagccataatattgaattggacagctttgaagcaccaaaagcagatctgctaatgccattctctgcgaagcttgtggatggtatcaaccaaaatgactctaggaggagggcactggtgatgttctgttttgcgtattttaatgtgatagcaagaaccgctgtcatgctttcaattgacccccttgggtttgatgtcctcgccaaagtgcctcatggagacatccttaataatccacaatacgatgggagggagttcacggttacaattaaggaccccccctcacgatgctgaaaacttctgccgcatgctggttgggttagaggacgaggttttgcctaccgggaaaaactgtaggggatacggttgacaacccacttggaagggttcacattcgaggaaccagccaaggaagttaacgactctgccacatggtggttcaaattaaagggaatttcggagccgcagggagaagttatagccggcttggttaaaaggttcacgtggcgcaaaaacccactggacaaacctatttatccgctgcgctctgggaatttttggaaatcatgg

SEQ ID NO: 49851 - protein, 79 aa, Zea mays
  misc_feature: Ceres CLONE 1461463-F
MPFSAKLVDGINQNDSRRRALVMFCFAYFNVIARTAVMLSIDPLGFDVLAKVPHGDILNNPQYDGREFTVTIKDPPSRC

SEQ ID NO: 49852 - DNA, 683 bp, Zea mays
  misc_feature: Ceres CLONE 1461467-F
  misc_feature (634)..(634): n is a, c, t, g, unknown, or other
aagctggagctccccgcggtggcggccgctctagaactagtggatcccccgggctgcaggaattcgcacgagaccattacctagaacatcctaatcgaaaaagttattactcaaaatccatgccattaaaaaggacttcaactccaagcggaacacttctactcccgttgttaaacggcactaccaacgaaacaacgaggaagaaggccgggagaggaaatcctttggcggcgcgcgcacgcgcggcagacacgtccacatccactgcagcgacgagccagccggtccgcggtcagcagcttggcagcagccccactctggctcccccctccgccatcactgcgcttgtgcgcgcgcacccacccccgcggcccgctcatcacccgcccggtcccgccgcctatttaacgccgcccccaccggggcactcggccctctccgtctcagaacgccccagccttccacctcgaactccgcggcgcccagcgccctcggtaaccgcccccgccccgccacagagacaggtcgacgagacagactaaggccggccgccatgggagaagacagaaggcgggaacaaagaaggccgcgggcgccacaataagaaggacccgggcgccggggcgcgccgcancccatcgtgctaaaggcaacttgactgcgccggctgcgccaaaaggtcc

SEQ ID NO: 49853 - DNA, 680 bp, Zea mays
  misc_feature: Ceres CLONE 1461468-F
  misc_feature: Translation starting site: 161
ggagctccccgcggtggcggccgctctagaactagtggatcccccgggctgcaggaattcgcacgagaccattacctagaacatcctaatcgaaaaagctggagggcaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtaaaacgcgcgcgcgtgcgcctgtgctgcctgatccggatgcgcgcctaattaatctgccgcatatgcgcgcctttctgggttttactttgcaggtgggcggagctggagagcggggcgacaaccatcgcgttcacgccgctgcaccagcgggagacggacgagctgtcgggggcggtgcagctgccggactcgtcggccgccggccggggctccgtggaagtctgcttcgcctacgcggacgtcgacgccgcgtacaagcgcgccgtggacaacggggcggtggccgtgagcgcccccgaagacaagccctggggccagaagtccggcttcgtgcgggacatggacggcaacatcgtgcgcatcgcgagctacgtgccgaaagtaatccc

SEQ ID NO: 49854 - DNA, 674 bp, Zea mays
  misc_feature: Ceres CLONE 1461471-F
  misc_feature: Encodes the peptide sequence at SEQ ID NO. 49855
ggagctccccgcggtggcggccgctctagaactagtggatcccccgggctgcaggaattcgcacgagaccattacctagaacatcctaatcgaaaaaaacgttagccttttccaatcagggagagagctcaaacatgggactcgaacccgtcgctctcctgctcacggtcctcgtcgccgcgccgatcacggtcctcctcctcctcctcttcctcgtcgccggcaacaagaggaccgctcgtgctgcttctcccacgccgcgccaccactagaggctgccgctgccgccgtcgacgcgtggcctcccactgatgggccacctgcacctgctgggctcgctgccgaaccgcgcgctgacgtctctggcgagagcgcacggcaccgtgctactgcgccgactgagccgcgtgcccaccatggtcatgtcactcgctgacaccgccatagaagagatagcgacacgggacctggagtgctggaaccggcccgcgagaaaaaagtcgtggcgcctcttctacggccgcgaagatggatttcgcccccctcgatccagaactaggggccagaagtgcccgggtctggggacttccaactcccgccatggaaattaaagtttggggtccttcccccccagtcccaaaaaacaaagaagcccccccgggattggatcaaaa

SEQ ID NO: 49855 - protein, 99 aa, Zea mays
  misc_feature: Ceres CLONE 1461471-F
  misc_feature: SWISSPROT Homolog: EC 1.14.13.68 4-hydroxyphenylacetaldehyde oxime monooxygenase
MGHLHLLGSLPNRALTSLARAHGTVLLRRLSRVPTMVMSLADTAIEEIATRDLECWNRPARKKSWRLFYGREDGFRPPRSRTRGQKCPGLGTSNSRHGN

SEQ ID NO: 49856 - DNA, 678 bp, Zea mays
  misc_feature: Ceres CLONE 1461480-F
  misc_feature: Encodes the peptide sequence at SEQ ID NO. 49857
  misc_feature (403)..(403): n is a, c, t, g, unknown, or other
  misc_feature (513)..(513): n is a, c, t, g, unknown, or other
  misc_feature (587)..(587): n is a, c, t, g, unknown, or other
  misc_feature (653)..(653): n is a, c, t, g, unknown, or other
ggagctccccgcggtggcggccgctctagaactagtggatcccccgggctgcaggaattcgcacgagaccattacctagaacatcctaatcgaaaaaaaaaatcccagacgccacgccacccaacacatacaaacacacgcacgcgcgcgcgcgcgcctcccgctgttccgcaaaacaaaggaaacgaaggagaggaggccatggcgccgagaacgtcaaagaaaaccatggcaccggcggcggccgctgccacggggctcgcgctcagcgtcggcggcagcggcggggccggcggcccgcactacagaggcgtgaggaagcggccgtggggccggtacgcggcggaaatccgcgacccggcgaagaagagccgggtgtggctcggcacctacgacacggccngaagacgccgcgcgggcctacgacgccgccgcgcgcgagtaccgcggcgccaaggccaagaccaacttcccttacccctcgtgcgtgcccctctccgcagccggttgccngagcagcaaccgcagcaccgtcgagtccttcagcagcgacgcgcaagcgcccatgcagggcatgccgctcccgncgtccctcgagctggacctgttcacccgcgcggcgggccgcgccacgggaacgggcgctgcccccntaaccttccctttcgggaagctccc

SEQ ID NO: 49857 - protein, 159 aa, Zea mays
  misc_feature: Ceres CLONE 1461480-F
  misc_feature (33)..(86): Pfam Name: AP2 Pfam Description: AP2 domain
  misc_feature (68)..(68): Xaa is any aa, unknown, or other
  misc_feature (129)..(129): Xaa is any aa, unknown, or other
  misc_feature (151)..(151): Xaa is any aa, unknown, or other
MAPRTSKKTMAPAAAAATGLALSVGGSGGAGGPHYRGVRKRPWGRYAAEIRDPAKKSRVWLGTYDTAXRRRAGLRRRRARVPRRQGQDQLPLPLVRAPLRSRLPEQQPQHRRVLQQRRASAHAGHAAPXVPRAGPVHPRGGPRHGNGRCPXNLPFREAP

SEQ ID NO: 49858 - DNA, 672 bp, Zea mays
  misc_feature: Ceres CLONE 1461481-F
  misc_feature: Encodes the peptide sequence at SEQ ID NO. 49859
  misc_feature (620)..(620): n is a, c, t, g, unknown, or other
ggagctccccgcggtggcggccgctctagaactagtggatcccccgggctgcaggaattcgcacgagaccattacctagaacatcctaatcgaaaaatttcctctccctccctctccccatgccactctccttactccctctctctagctccccatgcagcagcagcccccctcccatggagctggcgaccgagccctcccaagctccactctcaccttggcaagctctcccatggtgtctccccctcctctacggcagtaaggtgtaggaccgagagatgacgatcgtgcaagtgatgtggtgccaaccacaagatgcagttggtggacgatctgaagagatgatggacttatccagtggatgctcgccaagcgagtacccacccagcaaacactatctaagtgtcaaaataaaggaccgagagatgacgatcgtgcaagtgatgtggtgccaaccacaagatgcagttggtggacgatctgaagagatgatggacttatctagtggatgctcgccaagcgagtacaccaccccagcaaacactatctaagtgtcaaaataaaggtactccttaggatgattggttgatggtgtgactgggccttcatccctgccaccnggatagacggtcgagtgggttattgctccccaggagagacccagaggagtac

SEQ ID NO: 49859 - protein, 90 aa, Zea mays
  misc_feature: Ceres CLONE 1461481-F
MTIVQVMWCQPQDAVGGRSEEMMDLSSGCSPSEYPPSKHYLSVKIKDREMTIVQVMWCQPQDAVGGRSEEMMDLSSGCSPSEYTTPANTI

SEQ ID NO: 49860 - DNA, 687 bp, Zea mays
  misc_feature: Ceres CLONE 1461488-F
  misc_feature (132)..(132): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (534)..(534): n is a, c, t, g, unknown, or other
  misc_feature (535)..(535): n is a, c, t, g, unknown, or other
  misc_feature (589)..(589): n is a, c, t, g, unknown, or other
  misc_feature (612)..(612): n is a, c, t, g, unknown, or other
ggagctccccgcggtggcggccgctctagaactagtggatcccccgggctgcaggaattcgcacgagaccattacctagaacatcctaatcgaaaaatgtgatgatactacggctcagcccaacgatttccntgtttgcaaaccctggctccaactccgattcgtcactccaccctcgtcgcgccgccgcctgccgcgtccccggccagcctcgcagccccgtggtctgctagcggctagccacagcggagagaccagaagccatggtgatcccctcaccagcaagggcagctagagtcaccctttccctcagccctaactgttgaggatgcatttctcaaacaagtatgtttctgctcaaggtcttccccacccccaacagaaacgggttggatggggtctgcaaaactttnnnaaaagaaaaaaaaacacctcttgtttaaaaaaaaaaccaaccaacgtgggggggggggtgccgtccccccccccccccccgcgccggttaaaggnnnncggggcccggcgtgggggccnnaacaaaataattatattaagtgggtgtctttaaaccctcgggggggccgtgcgngggttgggaagggccccggcgcnattccccccgcccgtccctctcatctggggggaggggaagaaagtcaccgccggctcccccacgaaaacccccca

SEQ ID NO: 49861 - DNA, 704 bp, Zea mays
  misc_feature: Ceres CLONE 1461490-F
  misc_feature: Encodes the peptide sequence at SEQ ID NO. 49862
  misc_feature (1)..(1): n is a, c, t, g, unknown, or other
  misc_feature (630)..(630): n is a, c, t, g, unknown, or other
naaagctggagctccccgcggtggcggccgctctagaactagtggatcccccgggctgcaggaattcgcacgagaccattacctagaacatcctaatcgaaaagaacagcctactccagcctccagcgcctgctacgccgtcgcccacctccctcctctcctccagcgtcgcccgctcccgatcgtccaccgccacgcacctccctcctctgtcctctcctccaccccctcctccatctctagggcccgcctccctcttccagcgcccgagcaccccctcccctctcccacgtccagagtcggtctgacgttggcccatcgcccgataggtcctctagcagccaacgttgcctgcagctgcattccagagttccagagtttcagctacaaccacgaagttccaacgtctcctgcagctgctctatttgatccctgggcgtgcctgccaatgagcaagaagaggaagcatctggatccagcgaactcgttgaaagacagcgaacaagtagtcgcctcagatttcataagaggagacgatcttgatgacctattatcgaagcttatcaggagtgtggagattgccaaggctttcaggggacgcttaccagaaaaatatggatgaagcaacanttggctatccgcgtcatgatgttcacagggttcttgagcgaatgcccgcatctgtcactgctcatcctgctcaa

SEQ ID NO: 49862 - protein, 57 aa, Zea mays
  misc_feature: Ceres CLONE 1461490-F
MSKKRKHLDPANSLKDSEQVVASDFIRGDDLDDLLSKLIRSVEIAKAFRGRLPEKYG

SEQ ID NO: 49863 - DNA, 717 bp, Zea mays
  misc_feature: Ceres CLONE 1461492-F
  misc_feature: Encodes the peptide sequence at SEQ ID NO. 49864
  misc_feature (497)..(497): n is a, c, t, g, unknown, or other
aaagctggagctccccgcggtggcggccgctctagaactagtggatcccccgggctgcaggaattcgcacgagaccattacctagaacatcctaatcgaaaaacaccaggcacgccagcctcactcactccccagaccacctcacacgcacgaagcagcagcagtggactggactagctctaggtgggcaacatgaagcttcaggccaccgccagagttgctggcctcctcttcttcctcgtcctcctcctggcgctgccttccctccgcgtctccatggctggatcagggttctgcgacggcaagtgcgcggtgaggtgctccaaggcgagccggcacgacgactgcctcaagtactgcgggatctgctgcgccacctgcaactgcgtgccgtccgggacagcgggcaacaaggacgagtgcccatgctaccgcgacatgaccaccggaacacgcacccgcaccaggcccaagtgcccctgaaatgatatcatccntccgctctgtcttgcatgcgtatatgtaatgggtgataggctgtgcatgcatgcatcatgaaacatgcctggactctggatcggcgaggcttagcaggttttccaaaagggcgggaaaaaaaaaaaccttccggggtttccaaggggggcccccaatggaagggacaactgctggcaaaaaaattcctggttaatgcccggggcccctttggccaataaa

SEQ ID NO: 49864 - protein, 96 aa, Zea mays
  misc_feature: Ceres CLONE 1461492-F
  misc_feature (6)..(96): Pfam Name: GASA Pfam Description: Gibberellin regulated protein
MKLQATARVAGLLFFLVLLLALPSLRVSMAGSGFCDGKCAVRCSKASRHDDCLKYCGICCATCNCVPSGTAGNKDECPCYRDMTTGTRTRTRPKCP

SEQ ID NO: 49865 - DNA, 683 bp, Zea mays
  misc_feature: Ceres CLONE 1461496-F
  misc_feature: Encodes the peptide sequence at SEQ ID NO. 49866
  misc_feature (501)..(501): n is a, c, t, g, unknown, or other
ctccccgcggtggcggccgctctagaactagtggatcccccgggctgcaggaattcgcacgagaccattacctagaacatcctaatcgaaaagaatcagaaaccagagcaggcactccactaatcttgtccactgactgaggtgaggatcacgacacgagtagcgactgatgtgacgactcacgtggctagggacgccgcgaagagcagcgcgaagccccgcgcgccgacggccatgggccgcagcgtgcaccccctggcggcgagcgacgcgaggaggagcgtggcggcggcgatcccctggcggtaggcgacgaagacgatggggcgcatgcccagcccgtacgccgtcttcagcgccacgtccaccagcgcgtagaacagctgcaccagcaccatccccacgctcggcccgcaccgctccagccacgccgcgccgccggccatggcgcgcgacgcgaccgagatccgcgaccgcgcgtcgagtggggagggcaggcanaaggtcgccggggaggggagacagacgcctctctgtttctcgatcgcggcgggcgcgcccagtatgttgctactcgatcggtcgatccgccgcctcggcagctaaagtagtaggagctgggagcatccatgtgcgccgtcaccgttccattttttttgatggcttgagcgatttgtatcctt

SEQ ID NO: 49866 - protein, 53 aa, Zea mays
  misc_feature: Ceres CLONE 1461496-F
  misc_feature (19)..(19): Xaa is any aa, unknown, or other
MARDATEIRDRASSGEGRXKVAGEGRQTPLCFSIAAGAPSMLLLDRSIRRLGS

SEQ ID NO: 49867 - DNA, 739 bp, Zea mays
  misc_feature: Ceres CLONE 1461501-F
  misc_feature: Encodes the peptide sequence at SEQ ID NO. 49868
  misc_feature (420)..(420): n is a, c, t, g, unknown, or other
aaagctggagctccccgcggtggcggccgctctagaactagtggatcccccgggctgcaggaattcgcacgagaccattacctagaacatcctaatcgaaaagcaactactcatcctttccatcaaaactgagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgccccccagaagatcggcgttgatgaggagatcttcgtgggcgaacctcaagaagggcgaggtcaccnaaaggcccgtaacaggggaaagcgggatgccacttttctcttccacggacaacgatttccctggaaatcccacccgaaagaacgaatccccaaattggattctttcgaggggcaattaaaattaaggggaaaaatttgtggggcgaaaaaattcccccccgaaatttttccccaaccctggtaaacttgaaaaaggttaaaattggtattaccctggccaaaggaaaataaaagtgtttgcaagttttttttttttttgtcaaaaaaaccagggggggaaaataaaaaacccttttctcgggggagaaaaaaaaaaaaa

SEQ ID NO: 49868 - protein, 122 aa, Zea mays
  misc_feature: Ceres CLONE 1461501-F
  misc_feature (62)..(62): Xaa is any aa, unknown, or other
MDSSSLKSAQLLELMRQHLATDAGKEVTKKVGLVYQLNIAPQKIGVDEEIFVGEPQEGRGHXKARNRGKRDATFLFHGQRFPWKSHPKERIPKLDSFEGQLKLRGKICGAKKFPPEIFPQPW

SEQ ID NO: 49869 - DNA, 786 bp, Zea mays
  misc_feature: Ceres CLONE 1461505-F
  misc_feature: Encodes the peptide sequence at SEQ ID NO. 49870
ggagctccccgcggtggcggccgctctaaaactagtggatcccccgggctgcaggaattcgcacgagaccattacctagaacatcctaatcgaaaaatcgtttcgcgtccgcctcagcccgccgcaaggagaggtaagttcaggagacatcttcgagaagctgaaatggctcctaaagctgctcctgccaagaagggtgatgccaagacccaggccttgaaggttgccaaggctgtgaagtctggggcagccaagaagaagacaagaagatccgcacgtctgtgacatttcacccccccacaccctgaagaaagctagggaccccaagtcccacgaatcagcccttccggaaggaacagctttgatccgtacccaaattcccagggaccccctttaccgcggggacccccccaaaaaaaaaaaatgaaaaaataacccccccctgggcccttctttggtgacccctccggggcaaaaaaaaaaaaagaataaaaggctttcccttcaaagagagttttaagctctccccgccaaaaaaaggggacccccttttattagggccccagaaagaaaaaaaaaaagttttcctgaaagctcacccccccccacaagaagtcttttggggggccacaaaaaaaggggagatttctccggggtgtgttttaaaagcctcgtgttttcccccaaaacaacatgggggggggcccctttttttgtagaaacccgaaggtttgaggagtgggccccccccccccccccctccgcgggtggcccccctcctcagag

SEQ ID NO: 49870 - protein, 39 aa, Zea mays
  misc_feature: Ceres CLONE 1461505-F
MAPKAAPAKKGDAKTQALKVAKAVKSGAAKKKTRRSARL

SEQ ID NO: 49871 - DNA, 737 bp, Zea mays
  misc_feature: Ceres CLONE 1461508-F
  misc_feature: Encodes the peptide sequence at SEQ ID NO. 49872
  misc_feature (305)..(305): n is a, c, t, g, unknown, or other
  misc_feature (314)..(314): n is a, c, t, g, unknown, or other
  misc_feature (391)..(391): n is a, c, t, g, unknown, or other
  misc_feature (646)..(646): n is a, c, t, g, unknown, or other
ggagctccccgcggtggcggccgctctagaactagtggatcccccgggctgcaggaattcgcacgagaccattacctagaacatcctaatcaaaaaaggatgacaaaatttcccactccactcgaattaaaaccctagcggcaaaaccttcgccgtcgcctgctcccgtcccgccaccacatccgcccaggagctcgccgtcggggaggctgctcgaggagccgcgctgtctctcccgcgccgcgaccttcgccctcgccgcccgcatgatctgcgcgatctccggtgaggtgccggacgagccngtggtgtcnaagaagtcgggcttctcttcgagcggcggctcatcgagcgctacattgaggaccatgggcagtgcccccatacccanggatgagcttactatggatgaaatcggggctggccaaacccaacaggggcggggagcccagggcctttggaggctgcaagcattcccagaacccctgggaattttcaaaacagaggggaggcccccccggcttccaaatttggccttggggccccccctccccccccggagaaaaaaaatttttctggggcccttcacacagggaccccccccggcggggttaaaccccctaaaaaaaaaaaaaaaaagaggggnaaaactttttttggccccggaaaaaaaaaacccccccccttttggggggggcccccccccccttgttttctccaaaaaaaaaagaaagaaa

SEQ ID NO: 49872 - protein, 73 aa, Zea mays
  misc_feature: Ceres CLONE 1461508-F
MSLLWMKSGLAKPNRGGEPRAFGGCKHSQNPWEFSKQRGGPPGFQIWPWGPPSPPGEKKFFWGPSHRDPPRRG

SEQ ID NO: 49873 - DNA, 720 bp, Zea mays
  misc_feature: Ceres CLONE 1461513-F
  misc_feature: Encodes the peptide sequence at SEQ ID NO. 49874
  misc_feature (353)..(353): n is a, c, t, g, unknown, or other
  misc_feature (354)..(354): n is a, c, t, g, unknown, or other
  misc_feature (466)..(466): n is a, c, t, g, unknown, or other
  misc_feature (506)..(506): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (606)..(606): n is a, c, t, g, unknown, or other
  misc_feature (607)..(607): n is a, c, t, g, unknown, or other
  misc_feature (686)..(686): n is a, c, t, g, unknown, or other
aaagctggagctccccgcggtggcggccgctctagaactagtggatcccccgggctgcaggaattcgcacgagaccattacctagaacatcctaatcgaaaaatccaaacaaaccgcgtgatccgtctgaccgctcgctcgctctcgccgggggtccggagctccccacctccagcgacccagtccatccgcgcgtgcagcgccgcggcgccgatggagtacgacttccgcggcggccgctcgagctcgggcccgggcccctacggcgcgcctccggggggcgcgcctggggagggctctcgctctacccgcgcgtcgggcagcctttccacggcgggggcggggcttcaggnngtctcgggggccgggccgaaccacaacgggtcgggttcggatccggttcggggccttcggtccggtggagcccggtgggtcaaacctcttttccccgccctggccccggccnaaaaggggggataaaaattggaaaaaaaccggaattcccntttaccccccccccttttttccccaagagggagaaaacccccccccccccccccccctcttttttttagaaaaaaaagggtgttgttgtggggnnnaaanngcccccccccctcggaatttttttttgtaaaaaaaaaggggtccccttttgtccccccgggaaaaaaaaaacactcttnggggggggggagattttttttatttttttttttt

SEQ ID NO: 49874 - protein, 88 aa, Zea mays
  misc_feature: Ceres CLONE 1461513-F
  misc_feature (47)..(47): Xaa is any aa, unknown, or other
  misc_feature (85)..(85): Xaa is any aa, unknown, or other
MEYDFRGGRSSSGPGPYGAPPGGAPGEGSRSTRASGSLSTAGAGLQXVSGAGPNHNGSGSDPVRGLRSGGARWVKPLFPALAPAXKGG

SEQ ID NO: 49875 - DNA, 691 bp, Zea mays
  misc_feature: Ceres CLONE 1461514-F
  misc_feature: Encodes the peptide sequence at SEQ ID NO. 49876
caaagctggagctccccgcggtggcggccgctctagaactagtggatcccccgggctgcaggaattcgcacgagaccattacctagaacatcctaatcgaaaaacgaattccccattcccttcccccatcgcatcgagagccaggccagccagccacctctgctaggtctccatggccgccgcgctcaggtccccggcctcggccaaggtctcgagccccgccgccgcctccaaggtgcgccaggcgtccagagtcgcggtgggcgggttccggcagcatccgcggagccgtgtcggccccgtggccgtgcgggcgtcgctgttctcgcccaagcccgcggcggccaaggacgcgcggccgaccaaggtgcaggagctgtacgtgtacgagatgaacgagcgggaccgcgagagccccgcgtacctgcgcctcagcgccaagcagacggagaacgcgctgggcgacctggtccccttcacaaacaaggtttacaacggcagcctggacaagcggctgggcatcaccgccggcatctgcgtgctcatccagcacgtccccgaccgcaacggcgaccggtacgaggccatctacagcttctacttcggcgactacggccacatctcggtgcagggcgcgtacctgacctacgaggagtcgtacctggccgtcacgggcggctccggcgtcttc

SEQ ID NO: 49876 - protein, 173 aa, Zea mays
  misc_feature: Ceres CLONE 1461514-F
  misc_feature (59)..(173): Pfam Name: Allene_ox_cyc Pfam Description: Allene oxide cyclase
  misc_feature: SWISSPROT Homolog: EC 5.3.99.6 Allene-oxide cyclase
MAAALRSPASAKVSSPAAASKVRQASRVAVGGFRQHPRSRVGPVAVRASLFSPKPAAAKDARPTKVQELYVYEMNERDRESPAYLRLSAKQTENALGDLVPFTNKVYNGSLDKRLGITAGICVLIQHVPDRNGDRYEAIYSFYFGDYGHISVQGAYLTYEESYLAVTGGSGVF

SEQ ID NO: 49877 - DNA, 710 bp, Zea mays
  misc_feature: Ceres CLONE 1461516-F
  misc_feature: Encodes the peptide sequence at SEQ ID NO. 49878
  misc_feature (345)..(345): n is a, c, t, g, unknown, or other
  misc_feature (466)..(466): n is a, c, t, g, unknown, or other
aaagctggagctccccgcggtggcggccgctctagaactagtggatcccccgggctgcaggaattcgcacgagaccattacctagaacatcctaatcgaaaaagaggctggaagcaacggtgccgccggagatggagacggaaaaggaggcggcagcggcgaggcaggcgaaggagtccctggagctggcgttccagatgtcccagatcctcgaaaccggcctcgaccgccacaccctgtcgctgctcatggcgctctgcgaccgcggcgccaaccccgaggccctggccgccctcgtccgcgaactctcctccactgctcccccaaccgcgccgaggctccctnccccgtgagcaacgccgccgcggggccggccccggcacagcgtccatgttctcctccggcctcgccgtccctagggtttgtgatgtcctttttttccccggtgagactgctttgcagttantcgactagatcccgcgtatgccctcaccccctgtatgcctgaatggaatatggtcttaagttttgacaaattttggccccccaaaaaaaaaagggtcccccaaggccaaatttccgtttccgggaaaaaaaaaaaaaaaaagtttttctacccgccccaccccggggggggcccgggcccattccccccatatggggggtaaataccggccccccgggccggtttttaaacgcgggggggggga

SEQ ID NO: 49878 - protein, 73 aa, Zea mays
  misc_feature: Ceres CLONE 1461516-F
  misc_feature (72)..(72): Xaa is any aa, unknown, or other
METEKEAAAARQAKESLELAFQMSQILETGLDRHTLSLLMALCDRGANPEALAALVRELSSTAPPTAPRLPXP

SEQ ID NO: 49879 - DNA, 749 bp, Zea mays
  misc_feature: Ceres CLONE 1461517-F
  misc_feature: Encodes the peptide sequence at SEQ ID NO. 49880
  misc_feature (370)..(370): n is a, c, t, g, unknown, or other
  misc_feature (371)..(371): n is a, c, t, g, unknown, or other
  misc_feature (381)..(381): n is a, c, t, g, unknown, or other
  misc_feature (391)..(391): n is a, c, t, g, unknown, or other
  misc_feature (408)..(408): n is a, c, t, g, unknown, or other
  misc_feature (410)..(410): n is a, c, t, g, unknown, or other
  misc_feature (411)..(411): n is a, c, t, g, unknown, or other
  misc_feature (488)..(488): n is a, c, t, g, unknown, or other
caaagctggagctccccgcggtggcggccgctctagaactagtggatcccccgggctgcaggaattcgcacgagaccattacctagaacatcctaatcgaaaactttcggtattcgccttgacacgcagactaggcgccagccttctgcgaactgtctctacccttgacgaaggaagaggcagccttctcaccgtcgcacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccgggagcttgcnntctatgctgntcgtgtcaangggggcggcggtgaacnanngtcgccgtgctgtccatggccgcgggattcctggctatagtggtggggggattagggcgaatggccgacaatgtcantgctgcttccgctctacccagcttgtcatccattgcgggtggcttcccctgggacggcattatcgggccagagttgttcttaaggggttggaagcaaaacccgaaggcccttccaagcctcaaaaggtttaaacgcggtccggggtgctcctgggaaccccgggcaaaagggggggttaaacctacaaacacccaaaccctggggaaaattttcccccccccaagaggctccgggagggggggaaaattttttcttttgat

SEQ ID NO: 49880 - protein, 137 aa, Zea mays
  misc_feature: Ceres CLONE 1461517-F
  misc_feature (55)..(55): Xaa is any aa, unknown, or other
  misc_feature (59)..(59): Xaa is any aa, unknown, or other
  misc_feature (62)..(62): Xaa is any aa, unknown, or other
  misc_feature (68)..(68): Xaa is any aa, unknown, or other
  misc_feature (69)..(69): Xaa is any aa, unknown, or other
  misc_feature (94)..(94): Xaa is any aa, unknown, or other
MQRHVASGRPSGTDGSDFSYRMVVESRYQRVAEGRSRLARLILVQALHLVAGSLXSMLXVSXGAAVNXXRRAVHGRGIPGYSGGGIRANGRQCXCCFRSTQLVIHCGWLPLGRHYRARVVLKGLEAKPEGPSKPQKV

SEQ ID NO: 49881 - DNA, 771 bp, Zea mays
  misc_feature: Ceres CLONE 1461524-F
  misc_feature: Translation starting site: 205
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (401)..(401): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (426)..(426): n is a, c, t, g, unknown, or other
  misc_feature (427)..(427): n is a, c, t, g, unknown, or other
  misc_feature (433)..(433): n is a, c, t, g, unknown, or other
  misc_feature (434)..(434): n is a, c, t, g, unknown, or other
  misc_feature (439)..(439): n is a, c, t, g, unknown, or other
  misc_feature (440)..(440): n is a, c, t, g, unknown, or other
  misc_feature (448)..(448): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (503)..(503): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (552)..(552): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (581)..(581): n is a, c, t, g, unknown, or other
  misc_feature (583)..(583): n is a, c, t, g, unknown, or other
  misc_feature (587)..(587): n is a, c, t, g, unknown, or other
  misc_feature (611)..(611): n is a, c, t, g, unknown, or other
  misc_feature (614)..(614): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (629)..(629): n is a, c, t, g, unknown, or other
  misc_feature (631)..(631): n is a, c, t, g, unknown, or other
  misc_feature (633)..(633): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (669)..(669): n is a, c, t, g, unknown, or other
  misc_feature (671)..(671): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (703)..(703): n is a, c, t, g, unknown, or other
  misc_feature (705)..(705): n is a, c, t, g, unknown, or other
  misc_feature (708)..(708): n is a, c, t, g, unknown, or other
  misc_feature (710)..(710): n is a, c, t, g, unknown, or other
  misc_feature (712)..(712): n is a, c, t, g, unknown, or other
  misc_feature (713)..(713): n is a, c, t, g, unknown, or other
  misc_feature (715)..(715): n is a, c, t, g, unknown, or other
  misc_feature (716)..(716): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (735)..(735): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
ggagctccccgcggtggcggccgctctaccaactagtggatcccccgggctgcaggaattcgcacgagaccattacctagaacatcctaatcgaaaaaccaccgctccagcctcctctagagccttcgccgcttcgcgcctcggcggcaatcatcggatcggaacctgcacaagtagaagtacgcaacaagccttgccactaacatgccttcagtcgaggtcgaggtccaggtgggcggccccggcggcgagaggccgaagcagcagcaccaccatccccttgagatccgtcaggtgtgggcggacaacgtggaccgcgaattcaagctcatccgcgccggcatcgagcggtttccctacgtgtcatggacgaacgaannnnnnnnnnnnnnnnnnatacncagnnnnnnnnnnnnnncccccccnncacccnnccccnncccccccnaaaannnnnnnnnnnnnnnncccccnnncccnnnnnnncccccccccccccaacnccnnnccccnnnnnnnncccgcnnnccccccacaacaannnnnnnnngngtcnnnnnnnnnnnnnnctnnnncnnngncnctgngggggggtccgcggcctgcgcggntcncgcaaannnnnnngngngntgnnnnngnnngnnnnnnnnngggtgtgggtaagcngngggtatgccccnnnnnnnnnnnnnannnnnancnacncncnntnnatttcnnnctcccccccanccccccctcnnntttccaacctgacgacggggaggg

SEQ ID NO: 49882 - DNA, 691 bp, Zea mays
  misc_feature: Ceres CLONE 1461531-F
  misc_feature: Translation starting site: 159
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
aagctggagctccccgcggtggcggccgctctagaactagtggatcccccgggctgcaggaattcgcacgagaccattacctagaacatcctaatcgaaaatctttcgttcccctttccgccgcgcctcccactaaagcctagatctctctctctagaatgccgacatcttcggctctcaccaagcgcggcggcgacggcggggacggcatcctggccgccctctcccgttcgcaggtggcggcgcacgggcgagaggcggcggccgtggcaaaaaagctgctgctgagcacggggaaggcggcgtggatcgcggggacaaccttcctggtgctggtggtgccgctgatcatcaagatggaccgggagcagcagctcaacgacctcgagctgcagcagcatacgcttctgggcggggcccctccgccgccgccgccgaccaagtatatagatccgtgcatcgaccctttcgttaagggtgagtgnnnnnnnnnnnnnnnnnnnnnnnnnnnnnnnnnnnnnnnnnnnnnnnnnnnnnnnnnnnnnnnnnncgggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 49883 - DNA, 735 bp, Zea mays
  misc_feature: Ceres CLONE 1461533-F
  misc_feature: Encodes the peptide sequence at SEQ ID NO. 49884
  misc_feature (309)..(309): n is a, c, t, g, unknown, or other
  misc_feature (376)..(376): n is a, c, t, g, unknown, or other
  misc_feature (388)..(388): n is a, c, t, g, unknown, or other
  misc_feature (389)..(389): n is a, c, t, g, unknown, or other
  misc_feature (399)..(399): n is a, c, t, g, unknown, or other
  misc_feature (423)..(423): n is a, c, t, g, unknown, or other
  misc_feature (656)..(656): n is a, c, t, g, unknown, or other
ctccccgcggtggcggccgctctagaactagtggatcccccgggctgcaggaattcgcacgagaccattacctagaacatcctaatcgaaaacttttttttcccttcggggatggtattcgtcgtcttggcttcatcctctcgcccgccgtctcgactgtagcaagcggggctgctgtccgccgcattcaggagccatgcgtgaggggatgagggagagggacagaggcgggagcccggatgcgtcaggccctccgcccttccgcggcccggcgtacaagacgaagctgtgcgcgctttgagggggcanggggcggctgcccccgccccaaactgcgtttcgcccacggcgaggctgaagctcgaaaggcgccccntcgcgcctcttnncagctcgccnacgaactgggaggaagggattacngagatcctgagtttaaactcaggcctgaaaaaagacactcaccccatggaagggattcccctgaaagaaaaattcaggcttctttcatttcatgaaaaaaaaaccaagtttcgaaaatagggggatttaggcctttccgaaatcccttttaggaaggaggggaaaaaaactttttaaaatttccggagggggaaaaaaaccattccctcccaaaagtgtaaaacccctcgttncccaaaacgggggaaaaaagggagagggcctttaaccccgggaaaaaaaaaagggtcttaaaaaaaacctggaaaaaaa

SEQ ID NO: 49884 - protein, 34 aa, Zea mays
  misc_feature: Ceres CLONE 1461533-F
MREGMRERDRGGSPDASGPPPFRGPAYKTKLCAL

SEQ ID NO: 49885 - DNA, 689 bp, Zea mays
  misc_feature: Ceres CLONE 1461535-F
  misc_feature: Encodes the peptide sequence at SEQ ID NO. 49886
aaagctggagctccccgcggtggcggccgctctagaactagtggatcccccgggctgcaggaattcgcacgagaccattacctagaacatcctaatcgaaaaatccatccgccatggcgaccgctacgctactgagctcctccttcgccatgcccgccgccgcccgtagggcctcctccccttcctccgcctcattgagcttcgccacgtcgcagctcgccggcctctccctctccgccggcgttgcaactccaaccgccgtcgccctcctccccaagaggcagcagctccagcccactgtcgcgcggcgtgtgtgcccgttcacggacaagaagacgaaccgggcgaacaaggtgtcgttttccaaccacaagacgaagaagcagcagttcgtgaacctgcagtacaagaagctgtggtgggaggccggcaagcgcttcatcaagctgcgcctttccaccaaggccctcaagaccatcgagaagcacggcctcgacgccgtcgcgcgcaaggccggcatcaacctcaacaagaagtgagcaagaagtgagcccatccgatgagcagccaaactagtgtggggtggcactagcttagcattcacgttcgcagggtcgtctcgtctgtctgtctgcctgcctgcctgcctcctgctgttctttccccaatcaatataattccttattttt

SEQ ID NO: 49886 - protein, 141 aa, Zea mays
  misc_feature: Ceres CLONE 1461535-F
  misc_feature (66)..(126): Pfam Name: Ribosomal_L28 Pfam Description: Ribosomal L28 family
MATATLLSSSFAMPAAARRASSPSSASLSFATSQLAGLSLSAGVATPTAVALLPKRQQLQPTVARRVCPFTDKKTNRANKVSFSNHKTKKQQFVNLQYKKLWWEAGKRFIKLRLSTKALKTIEKHGLDAVARKAGINLNKK

SEQ ID NO: 49887 - DNA, 723 bp, Zea mays
  misc_feature: Ceres CLONE 1461536-F
aaagctggagctccccgcggtggcggccgctctagaactagtggatcccccgggctgcaggaattcgcacgagaccattacctagaacatccaatcgaaaaagattgaataatctggcatcgttggagcgtacgtccactacgaagtacgaccaatctggccgccttgtgagttgcgagttgcgacttctagcatatcatcggcatcgcctgctctgctggtgaagagcgaaggggccaagaccacacgccttccaaggtccacacctaccccaagagccgcccgccccatcagccgccacgatgtgcatcctggagcagcgcggccgcgtcttcgtcctcacctctacgggcgacgcgagcaccgcctagccacgcccttattccttggtccgattcggcgtcgcctccccccggtctgggcccgccaaagcggggcccgggggccgcgttcgttccgttgggaagggcgctttcttcccaagggccttaaaatggggggggcgggaacccccccgcccggccagggaaaagttttaacccgccccccccgttttttgaaaaatctttggttcccaatggccaatgttcccccgcgtaccgggaaactcttccggggggggggtcccccccggctttccaaaaaatccgattttggggggggccccgaagtgtttttaaaaaaggggggggaaaaggcccccccccccccccccatttgggg

SEQ ID NO: 49888 - DNA, 745 bp, Zea mays
  misc_feature: Ceres CLONE 1461539-F
  misc_feature: Translation starting site: 220
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (718)..(718): n is a, c, t, g, unknown, or other
  misc_feature (719)..(719): n is a, c, t, g, unknown, or other
  misc_feature (723)..(723): n is a, c, t, g, unknown, or other
  misc_feature (724)..(724): n is a, c, t, g, unknown, or other
aaagctggagctccccgcggtggcggccgctctagaactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaaggccccgccctggctcccgcgtcggacgctggggcggcggtaccctgggcggggcttcttcgcggcgggcgcttttggttaactttttggctaaaaccggctgagaaccggggttcttggcccaaaaaattatttcttgggcttggccccgggagaccccccccgggggcgcggcctctctcttttgaaagggcccggggnnnntttttttttttaataaaaacccccccccccccccccaaaaaaaaaaagtggccccggggggggggaacctcttttcacccccccctttttgtgcgcgaaaaaaaacaccccccccccccttttnnnnttaaatctgaaatgaatccggcggnnnnnnnnnnnnnnnnnnnnnnnnnnnnnnnnnnnnnnnnnnnnnnnnnnnnnnnnnnnnnnnngnntggnnggggggggggggggggggggg

SEQ ID NO: 49889 - DNA, 800 bp, Zea mays
  misc_feature: Ceres CLONE 1461553-F
  misc_feature: Encodes the peptide sequence at SEQ ID NO. 49890
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (312)..(312): n is a, c, t, g, unknown, or other
  misc_feature (421)..(421): n is a, c, t, g, unknown, or other
  misc_feature (486)..(486): n is a, c, t, g, unknown, or other
  misc_feature (496)..(496): n is a, c, t, g, unknown, or other
aatgatgttccccaatcaaaacacaaaannaannnnnnnnnnnnnccaaactggggctccccgcggtggcggccgctctataactagtggatcccccgggctgcaggaaatcgcacgagaccattacctagaacatcctaatcgaaaaatcgtgacaatcccaacggtgatggcaatcagtgagtcatcaagactgcattcttctttgcaaaaggaaagtgttcctgtaaggagactcattgtgaaccaagttctgccaccttcaacatcggactgaaaattctgttctataaaaagaaaggatcaaacgcntccattggatataattcggactgacccaaagttaaaaggttcgaacatacgcaaagcacctcttgtggacatggaaattagaggtgttccggctctctattttttgggngatatcgtgtggaagtaatttcgattagggaaaaccaccctcctgaagaggggtgtttaattggnctattataantggggggggtgattaacgaatacacctgttttattacccaggtattttttgggggggcggggggttagtttcttggtgaccatttccgcggttagtttaggggtgttcgccgggtcgcgttccggccacggcgccattcccccggggctcggtttagatcttaataggcggggttcctaattgggaagggtttttagtataaatcttttcaatattttttctgccgccgcttttttatctgtgggcccgtcattaaatatttgtgggtaggggccctgtgtcttgggcaaacgttcaatatagt

SEQ ID NO: 49890 - protein, 91 aa, Zea mays
  misc_feature: Ceres CLONE 1461553-F
  misc_feature (10)..(10): Xaa is any aa, unknown, or other
  misc_feature (11)..(11): Xaa is any aa, unknown, or other
  misc_feature (12)..(12): Xaa is any aa, unknown, or other
  misc_feature (13)..(13): Xaa is any aa, unknown, or other
  misc_feature (14)..(14): Xaa is any aa, unknown, or other
  misc_feature (15)..(15): Xaa is any aa, unknown, or other
MMFPNQNTKXXXXXXQTGAPRGGGRSITSGSPGLQEIARDHYLEHPNRKIVTIPTVMAISESSRLHSSLQKESVPVRRLIVNQVLPPSTSD

SEQ ID NO: 49891 - DNA, 753 bp, Zea mays
  misc_feature: Ceres CLONE 1461558-F
  misc_feature: Encodes the peptide sequence at SEQ ID NO. 49892
  misc_feature (403)..(403): n is a, c, t, g, unknown, or other
agagctggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccgggtgacagaccattgggggaggtgatgatgctttcaacaccttcgtcagtgagactggccctggnaagcacgtcccccctgctgttttttgtgacctggagcccactgccatcgatgaggtgagggacgggaacttacccgcagtcttttccatcctgaacagcttaatcgggggcaaggaggatcgcagccaaaaaatttccctcggggcccataccccaatgggaagggaaatttttacactgggcccttcccccctttgggaaattttggaaaaaattggcgtggggctccaggggttctcctcttttaaacgcttttgggggaaaaaaaacgctcccgggtttttttttcccccccgaggaggcctttttttattaataaggaaaaaaaacaacattttttttctcccgcc

SEQ ID NO: 49892 - protein, 38 aa, Zea mays; identical to SEQ ID NO: 17326
  misc_feature: Ceres CLONE 1461558-F

SEQ ID NO: 49893 - DNA, 651 bp, Zea mays
  misc_feature: Ceres CLONE 1461567-F
  misc_feature: Encodes the peptide sequence at SEQ ID NO. 49894
  misc_feature (453)..(453): n is a, c, t, g, unknown, or other
  misc_feature (522)..(522): n is a, c, t, g, unknown, or other
  misc_feature (600)..(600): n is a, c, t, g, unknown, or other
  misc_feature (601)..(601): n is a, c, t, g, unknown, or other
tttgcactagtggatcccccgggctgcagtttttcgcacgagaccattacctagaacatcctaatcgaaaaacacattttcaatttcgtactgggcgactgggcgtagggcgagctgagctcccaagtcgacgtggcggggatggctgcgacggccggcgtcggcggtggtggaggggctaacgcggcggtggcagagcagatagcacaggcagtgcggtccacctccaatctcctccagctcatggagcagtcctcccccgctcaggttcacttggcaaaactacccaagaacctgttggaaaaagcatcctttgcaaagaacacggagcatgtactgcaccagctacctcaagtaatttcatccttggatgcttatatggacaggagtttgcaaagtgcatctcaaattaagactgtcacacagctcttgtcaaacatggagaagacacanctgaagtccatgttgccttcctctcgaaggaaggaagatcagaagagtactgaaccccttagaactcanggttgattgacgtcaccgagacatagtggaagggatagcttttgccgtcttatgctagagagatctgagtatgatggnnttgggctgatggctctatgcatctatccggcataaagatccatcgctgcc

SEQ ID NO: 49894 - protein, 128 aa, Zea mays
  misc_feature: Ceres CLONE 1461567-F
  misc_feature (104)..(104): Xaa is any aa, unknown, or other
  misc_feature (127)..(127): Xaa is any aa, unknown, or other
MAATAGVGGGGGANAAVAEQIAQAVRSTSNLLQLMEQSSPAQVHLAKLPKNLLEKASFAKNTEHVLHQLPQVISSLDAYMDRSLQSASQIKTVTQLLSNMEKTXLKSMLPSSRRKEDQKSTEPLRTXG

SEQ ID NO: 49895 - DNA, 680 bp, Zea mays
  misc_feature: Ceres CLONE 1461569-F
  misc_feature: Encodes the peptide sequence at SEQ ID NO. 49896
  misc_feature (489)..(489): n is a, c, t, g, unknown, or other
aaagctggagctccccgcggtggcggccgctctagaactagtggatcccccgggctgcaggaattcgcacgagaccattacctagaacatcctaatcgaaaaagccggaagaggggatttcgagccgcggcgatcggggctagagtggccctcgacgcgtccgcgggtggaattgccgagaagccgagagagagggcttggagcggagttgcgggaggtgggagagaaggcggcgatggggcgcctgttcctgatgcacctggacggcaacgtctacagctgcaaacactgcaagacccacctcggcgttgccagcgacatcatctccaaggccttccagtgcaagcacggcaaggcgtacctcttccataaggttgtcaacgtgacttctggagtaaaagaagaccgcatgatgatcacaggaatgcatactggttctgatatcttctgtgtgggctgtggatccataggtggggtggaatatgatgncgcacatgagaaggggccagagatacaagggagggcaagtttattctggaaaggtgacaggggggccggcccctggacggaagccaatactggggttccccaaaaatgcctcctttggggcggaagcccaccccccaatgaacttttaaaccccccgtctccaacaggcctcaaggcttattgtttggaac

SEQ ID NO: 49896 - protein, 148 aa, Zea mays
  misc_feature: Ceres CLONE 1461569-F
  misc_feature (1)..(102): Pfam Name: Yippee Pfam Description: Yippee putative zinc-binding protein
  misc_feature (85)..(85): Xaa is any aa, unknown, or other
MGRLFLMHLDGNVYSCKHCKTHLGVASDIISKAFQCKHGKAYLFHKVVNVTSGVKEDRMMITGMHTGSDIFCVGCGSIGGVEYDXAHEKGPEIQGRASLFWKGDRGAGPWTEANTGVPQKCLLWGGSPPPNELLNPPSPTGLKAYCLE

SEQ ID NO: 49897 - DNA, 787 bp, Zea mays
  misc_feature: Ceres CLONE 1461570-F
  misc_feature: Encodes the peptide sequence at SEQ ID NO. 49898
ctggagctccccgcggtggcggccgctctagaactagtggatcccccgggctgcaggaattcgcacgagaccattacctagaacatcctaatcgaaaaagcaacacggtgtcggcgatgccgttcctggtcctgatcaccctggtgtcgggcacgctgtgctacttcatggtgcgcctgcacccgggcttcacgcactacctcttcttcgtgctggacctctacgccagcgtcaccgtggtggagagcctgatgatggccatcgcgagcgtcatcccccaacttcctcatgggcatcatcgtcggggcggggaatcaggggaatattcctgctgggggtcgggttacttaaggctcccccaaaaatttcccaaacccttctggaaggtaccccatgttccaaaatacgcccccccacttctggggccccttttgggcccctttacccaaaacccccccccaagggtccttcctttttcaaccggccaaaaaagagcaaactttttttcccccagaaaaaaaccccccgggaaatttcactccctggaaaaaaattgttttcttaaaagggaccccggggtggagaatactaggggtttcaaaatctggccccgggttgttttctgaaagggttgtattcccctagaccggcggcgccctctttttttctaattaaaaaaaacgtcccccataatatcaccccccccccccctgggtttcgcccccccccttttttctttcccctgtagtgttgggaaaacacggcgtttcctcaatttccttttttg

SEQ ID NO: 49898 - protein, 207 aa, Zea mays
  misc_feature: Ceres CLONE 1461570-F
GAPRGGGRSRTSGSPGLQEFARDHYLEHPNRKSNTVSAMPFLVLITLVSGTLCYFMVRLHPGFTHYLFFVLDLYASVTVVESLMMAIASVIPQLPHGHHRRGGESGEYSCWGSGYLRLPQKFPKPFWKVPHVPKYAPPLLGPLLGPFTQNPPPRVLPFSTGQKRANFFSPRKKPPGKFHSLEKNCFLKRDPGVENTRGFKIWPRVVF

SEQ ID NO: 49899 - DNA, 703 bp, Zea mays
  misc_feature: Ceres CLONE 1461639-F
  misc_feature: Encodes the peptide sequence at SEQ ID NO. 49900
ctggagctccccgcggtggcggccgctctagaactagtggatcccccgggctgcaggaattcgcacgagaccattacctagaacatcctaatcgaaaaacttagctacagagatccttcaaggacgatcgatgatggccggcgctcaagagcaagggctgaagctgctgggggcggcgtccggggtgagcccgtacgtgatccgcgcccagatggtgctcggcatcaaggggctgacctacgactacctccccgaggacccccggtgcaagagcgacctgctcctcgcatccaatcccgtgcacaagaagctgcctgtcctcatccatggcggcaggcccgtctgcgagtcgctgatcatcttggagtacctcgacgacgccttccccgaaaatggcgccgccatcctccctgccgacccctaccgccgtgttgtcgcccgttttctggcccgctacgtggataacaagctgttcccttcgtgcatcggcatcctcaagacggaaagctgcaggaaagagccgaccaggtggaggagaccttggcagcactcgggctcctagaggccgccctggccggaatgctcaaaggaagggggccccgatggcccctttctttgggcgggggttcccccgggctggttgaaatttgcccccgggggctttctttccccggaatcaaaaccaaaaggggtccctttctgg

SEQ ID NO: 49900 - protein, 142 aa, Zea mays
  misc_feature: Ceres CLONE 1461639-F
  misc_feature (7)..(82): Pfam Name: GST_N Pfam Description: Glutathione S-transferase, N-terminal domain
  misc_feature: SWISSPROT Homolog: EC 2.5.1.18 Glutathione transferase
MAGAQEQGLKLLGAASGVSPYVIRAQMVLGIKGLTYDYLPEDPRCKSDLLLASNPVHKKLPVLIHGGRPVCESLIILEYLDDAFPENGAAILPADPYRRVVARFLARYVDNKLFPSCIGILKTESCRKEPTRWRRPWQHSGS

SEQ ID NO: 49901 - DNA, 711 bp, Zea mays
  misc_feature: Ceres CLONE 1461646-F
  misc_feature: Encodes the peptide sequence at SEQ ID NO. 49902
caaagctggagctccccgcggtggcggccgctctagaactagtggatcccccgggctgcaggaattcgcacgagaccattacctagaacatcctaatcgaaaactccccgcccactacctcaaaccctaccgcctcgccgccgccgccatggcctcgtcgtcgtctccggcgagtagccacccgcctggcccgtttgctctagggttggagtcctcggcgaacaagattggcatcggcgtcgtctccatctccgggcaaatcctctccaacccgcgccatacgtacatcaccccgccaggccacggtttcctgccccgggagaccgcgcagcaccacctcgtccacctactccctctactccgcgcagcactcgccgaggccgatgcctctcctgccgacctcgcctgcatttgctacaccatgggccccggcatgggcgggcctctccaggtcgccgccgcatcggcccgggctctgtcgctcctatgggggaaaccgcttgtcgccgtcaatcactgtgttgcgcacattgaaatgggccgcgcggtcaccggcgccgtggaccctgttgtgctctacgtctcaggtggcaacacgcaggtcatcgcgtatagcgaagggaggtacaggatcttcggtgagaccattgatattgccgtcgggaactgcctcgaccgctttgcgcggatcctcgagctctcgaatgaccc

SEQ ID NO: 49902 - protein, 187 aa, Zea mays
  misc_feature: Ceres CLONE 1461646-F
  misc_feature (37)..(187): Pfam Name: Peptidase_M22 Pfam Description: Glycoprotease family
  misc_feature: SWISSPROT Homolog: EC 3.4.24.57 O-sialoglycoprotein endopeptidase
MASSSSPASSHPPGPFALGLESSANKIGIGVVSISGQILSNPRHTYITPPGHGFLPRETAQHHLVHLLPLLRAALAEADASPADLACICYTMGPGMGGPLQVAAASARALSLLWGKPLVAVNHCVAHIEMGRAVTGAVDPVVLYVSGGNTQVIAYSEGRYRIFGETIDIAVGNCLDRFARILELSND

SEQ ID NO: 49903 - DNA, 685 bp, Zea mays
  misc_feature: Ceres CLONE 1461679-F
  misc_feature: Encodes the peptide sequence at SEQ ID NO. 49904
ggagctccccgcggtggcggccgctctagaactagtggatcccccgggctgcaggaattcgcacgagaccattacctagaacatcctaatcgaaaaatcatatctagcctgcctgtgcgcatctaccctagccctcataaatataacgattgcttcgcaccaccccaacagcatggtcggagcgcagggagtacctcttctacgccggtgtgatgcgctgccactactacttgatgtaggacatggcgacgcccatctacatactcgccgttcatcgacaccatcttcgcggagaagtcgatggtcgtgtggaacctcacgtactctgtcacgccacacaagactgcagatcccagtacgctttcgtttatgcctccttacagctgtggcctctgtgctcaggatgctaactcagcttccacgtccagttagtgctactacgatactgggacgcaagctaatgctcggggacttcataggggctccctgcccgccgctagccaggccccgagatgcccgccatccgtgggctggccatgaaacccgaagatgttcccccttcccgcatgggaccaaagggtgggaaaccccttgggggcaaataacctccgcactttccttatgtgacgagaggggaacccgaaggggtaaagggttcttttgggccataaattcccccaaactg

SEQ ID NO: 49904 - protein, 30 aa, Zea mays
  misc_feature: Ceres CLONE 1461679-F
MPAIRGLAMKPEDVPPSRMGPKGGKPLGGK

SEQ ID NO: 49905 - DNA, 704 bp, Zea mays
  misc_feature: Ceres CLONE 1461683-F
  misc_feature: Encodes the peptide sequence at SEQ ID NO. 49906
aagctggagctccccgcggtggcggccgctctagaactagtggatcccccgggctgcaggaattcgcacgagaccattacctagaacatcctaatcgaaaaatcaaaccgtctccctcatctctctgcaatacgggcgggggggctgtgctcttcttcttctcctccagcgagggaccgagctaagctcggaggtcgagcgaaaatgccggtgagcctgatcgccgtggggatcctccgttaggtgtagcaggtgggcgccctcaaggcgtctctcgccgagttactctcctcgctcatcttcttcttcacaggacagcgctccggcatgctcttcctcaagctcagcccctacggcgcggggacccccggcggtctcttttcgcctgccagagcccacatcttcccactattcctggccgtgtccgtgcgcgccaacatctcctgcgcgcatgtgatccctgccgtgacctccggcgccttcttggggggcaacatcatcctcttccgcggtctgatctactggatcacgcaactgctggcctctaccggcgcctgattcctactccgcattataagcggcgggatccccactggcaccttcaggctgagtgtcctctgcccgtggtaggcggtggcgctggatatcgtgattaccttcgggctgctgtacactgtgtaccccactggcgtggaccccaagaa

SEQ ID NO: 49906 - protein, 76 aa, Zea mays
  misc_feature: Ceres CLONE 1461683-F
MLFLKLSPYGAGTPGGLFSPARAHIFPLFLAVSVRANISCAHVIPAVTSGAFLGGNIILFRGLIYWITQLLASTGA

SEQ ID NO: 49907 - DNA, 700 bp, Zea mays
  misc_feature: Ceres CLONE 1461726-F
  misc_feature: Encodes the peptide sequence at SEQ ID NO. 49908
  misc_feature (540)..(540): n is a, c, t, g, unknown, or other
tccccgcggtggcggccgctctagaactagtggatcccccgggctgcaggaattcgcacgagaccattacctagaacatcctaatcgaaaaaaagctgttcttctcccctcatcgcatacggcataccacactagagccgccgccgccgccgccgctgccgtttcgcgcaccgtaccctagccctcgtcagcggcggcttcgagctcctccagccatgacgttcaagcggaggaatggcggacgcaacaagcacgggcgcggtcacgtcaagtacatccgctgctccaactgtgccaagtgctgccccaaggataaagctatcaagcggttcttggtgaggaacattgttgagcaggctgctgtgaaaaatgtgcaggaggcctgtgtacatgatggatatgttctacccaaattgtatgcaaaggttcatcactgtgtctcatgcgcaatccatgcgcacattgtccgtgtccgctctcgtgagaacaggaggacccgtgagcccccgcagcgcttcagacgccgggatgatggcccanggcctggtcaggggcccgcgcgcccaggggggtgcagctcctgcagctgcacctgctgctgctcctcgtaattaagttcgggaattagtttccgggcttaattttggggaaaattacctgttttgaagaaaccattgttaccgtatccccctggaagcca

SEQ ID NO: 49908 - protein, 131 aa, Zea mays
  misc_feature: Ceres CLONE 1461726-F
  misc_feature (1)..(114): Pfam Name: Ribosomal_S26e Pfam Description: Ribosomal protein S26e
  misc_feature (109)..(109): Xaa is any aa, unknown, or other
MTFKRRNGGRNKHGRGHVKYIRCSNCAKCCPKDKAIKRFLVRNIVEQAAVKNVQEACVHDGYVLPKLYAKVHHCVSCAIHAHIVRVRSRENRRTREPPQRFRRRDDGPXPGQGPARPGGCSSCSCTCCCSS

SEQ ID NO: 49909 - DNA, 708 bp, Zea mays
  misc_feature: Ceres CLONE 1461732-F
  misc_feature: Encodes the peptide sequence at SEQ ID NO. 49910
aagctggagctccccgcggtggcggccgctctagaactagtggatcccccgggctgcaggaattcgcacgagaccattacctagaacatcctaatcgaaaaaattctcggaagccggccgatgtcgagtccaaaattgcaaaaatctctgccgtgcctctcgtctctcttctcaggcgccacgcaaaacgttctccgttttccctctccggatccggcccgcgggggccaggagctaccgatgatccggaccgcaacggtgcgagcgcgtctcctcctatcgcgctcctacgtagcacaggcacaggcagcttctcgctggcctctcgtccgctggaaggcttcgcatcttggatctgtacgctctttctatcagatggacattacaaggcaatacaaaaataaaagtttgactgcaagagggtgccatagctcccctgagagtcaagaattagcaatgaaaagctgtgttccatgcaactctaaggatttaggtcccatgtcagaagattctgctaaaaagttgcttgaacaggtgaatggttgggaactgatcactgaaggtggtgttctgaaattacatagaacatggaaggtgaagaactttgttaaaggacttgagttctttcagcttgttgctgctattgctgaggaagaagtcaccatccagatcttcatcttgttggttggataatgtgaaaattgatgt

SEQ ID NO: 49910 - protein, 150 aa, Zea mays
  misc_feature: Ceres CLONE 1461732-F
  misc_feature: SWISSPROT Homolog: EC 4.2.1.96 4a-hydroxytetrahydrobiopterin dehydratase
MIRTATVRARLLLSRSYVAQAQAASRWPLVRWKASHLGSVRSFYQMDITRQYKNKSLTARGCHSSPESQELAMKSCVPCNSKDLGPMSEDSAKKLLEQVNGWELITEGGVLKLHRTWKVKNFVKGLEFFQLVAAIAEEEVTIQIFILLVG

SEQ ID NO: 49911 - DNA, 800 bp, Zea mays
  misc_feature: Ceres CLONE 1461733-F
  misc_feature: Encodes the peptide sequence at SEQ ID NO. 49912
  misc_feature (15)..(15): n is a, c, t, g, unknown, or other
  misc_feature (20)..(20): n is a, c, t, g, unknown, or other
  misc_feature (36)..(36): n is a, c, t, g, unknown, or other
  misc_feature (37)..(37): n is a, c, t, g, unknown, or other
  misc_feature (424)..(424): n is a, c, t, g, unknown, or other
ggggtttttgtttgngcggntgtggtcttttcctannactactcttttctaaactgggactccccgcggtggcggccgctctatactagtggatcccccgggctgcaggaattcgcacgagaccattacctagaacatcctaatcgaaaaaaacaagcgagtatcaattcagtgagatagtttaagaaaatctactctgttctttcggtaccgcaacttggcaaacccactactacacaaggatcacaagtcactctcctctcttgagcagcgcagcatgatcaaggaggaggaggagagacgatggctggtccggcgaatgcatcgtggatggtggccatgagcgtgggcgcagtctaggtactcatggaccttgtcgggctctgccgctggaactacgccctaaggtctatgcgctgtgtancaaaggtgaacgtgagcaactatgtctcgtatggtaacaaggagttgcctgcctcaatggcctccgtggcaaaaaggtggcgagcggacaatgctgacgaggggctggagactgtcatgtaccttaactggttgaggcctaaattgaaaatggctattgccttgaagggctgggtttgttgctgccagcgactttagctgtttgtaaacattccttggggctggggacttgagttctgggtttgacccctgggtcggggttggcaaaggatctcccgcccaatgatagaaggatcgccggaacaataatggtgcttcaaaaaaggaatatactttttattcccccggtgtaaaggacgaatatgcctaaggccctt

SEQ ID NO: 49912 - protein, 84 aa, Zea mays
  misc_feature: Ceres CLONE 1461733-F
  misc_feature (20)..(20): Xaa is any aa, unknown, or other
MDLVGLCRWNYALRSMRCVXKVNVSNYVSYGNKELPASMASVAKRWRADNADEGLETVMYLNWLRPKLKMAIALKGWVCCCQRL

SEQ ID NO: 49913 - DNA, 468 bp, Zea mays
  misc_feature: Ceres CLONE 1461734
  misc_feature: Encodes the peptide sequence at SEQ ID NO. 49914
actaatcacattttcttcgcgtatatatcacaaagaaaaacaagaagggtaaagagaaaagatgatctcagtggtgataataactgagtacctagtggagtacacgacggctctcgctaaactcaccgccgggattcttccacggcgtaccggcgacagaaacgtcttacggatcggcggtttcctccttccctcaccttcttcagctgtctctaggattcctgatttctctgctcacctcgtcgatttttgatttctcttagcacttattttttgggatttttcagttcttgacattagattttattcctctatcttttctatgagaggcggctgagatttttaccgagtgtcttgtcatctcctctctttttttttttgtttatcttggttatgaatctgatagagcttttgtaagtagatccatatctaattaatatatagagatgaataaaaaaaaaaaaaaaa

SEQ ID NO: 49914 - protein, 63 aa, Zea mays
  misc_feature: Ceres CLONE 1461734
MISVVIITEYLVEYTTALAKLTAGILPRRTGDRNVLRIGGFLLPSPSSAVSRIPDFSAHLVDF

SEQ ID NO: 49915 - DNA, 674 bp, Zea mays
  misc_feature: Ceres CLONE 1461738-F
  misc_feature: Encodes the peptide sequence at SEQ ID NO. 49916
  misc_feature (549)..(549): n is a, c, t, g, unknown, or other
ctggagctccccgcggtggcggccgctctagaactagtggatcccccgggctgcaggaattcgcacgagaccattacctagaacatcctaatcgaaaaaagttctgcaagtgctgtttggtttagctgcctcttgccgctggcagccagcggaagccaaccaccttgtccccgtcgagcaccgagaccgcgactcctcaccgcactgcgccgctcgcgagaacctcgcgtaagcttcggcaagcagcatccgtcccgccgatcgcaatgccggaggacaaggagtacgcgcccctgccactcggccaggcggcggcgcctgaccccgaggaccccgtcaagtcgccgccgcgacccagctcgcctgccacgtccactcgcaaggcatgctttgctgttcttcaaagctgggtgtcaagaaaatttatgaccggatgtgtagttcttttcccaattgctgtcacattcttcctcacttggtggtttattcaatttgttgatggttttttccagccactctatgcaaaactggggttttgacatgtccggncttgaattttttacctccctggtgtcatacttcctgttgggaacctttggggctccctggggggggtcacactgccttccgggttggaaaatggttaataaaaaaatgccatttgaagggcaatt

SEQ ID NO: 49916 - protein, 90 aa, Zea mays
  misc_feature: Ceres CLONE 1461738-F
MPEDKEYAPLPLGQAAAPDPEDPVKSPPRPSSPATSTRKACFAVLQSWVSRKFMTGCVVLFPIAVTFFLTWWFIQFVDGFFQPLYAKLGF

SEQ ID NO: 49917 - DNA, 690 bp, Zea mays
  misc_feature: Ceres CLONE 1461744-F
  misc_feature: Encodes the peptide sequence at SEQ ID NO. 49918
  misc_feature (331)..(331): n is a, c, t, g, unknown, or other
  misc_feature (388)..(388): n is a, c, t, g, unknown, or other
  misc_feature (396)..(396): n is a, c, t, g, unknown, or other
ctccccgcggtggcggccgctctagaactagtggatcccccgggctgcaggaattcgcacgagaccattacctagaacatcctaatcgaaaagcgtcagacagagaaagccgagattagcggcggcggcgatggcactcccggcgtcaagctccggcctcttccgcttcgtctccccccgcagtcgtccccagtccaccgacatcgtggccgctgcctcctggggagtcttcgccggcaccgccggcctctacctcgtccagccatttgactggattaagaagactttcttcgataaacctgaaccagaggcatgagtctccaggcagagnatgctgcaaatctgcaactttggtacaccacttttgtccgggatgattcctgatgantactcagncaataatatgagaccctctcgtctttcctttgttgactttatcagatgtaggcattcctcttgcatgtaaatctcacgaggggagtgggatcatttgacttggtttttcatacacagaggacctgtttggttcaaccgggtaatatgacctgatggcatttccaaaaaaaaaaaaaaaaagcttatccatcccgccaacttcaaggggggcccgggaaccaattcgccttaaagggatcgaaatacccgcccaccggcccgtcttttaaaacccccgggatgggaaaacccggg

SEQ ID NO: 49918 - protein, 61 aa, Zea mays
  misc_feature: Ceres CLONE 1461744-F
MALPASSSGLFRFVSPRSRPQSTDIVAAASWGVFAGTAGLYLVQPFDWIKKTFFDKPEPEA

SEQ ID NO: 49919 - DNA, 614 bp, Zea mays
  misc_feature: Ceres CLONE 1461745-F
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
aagctggagctccccgcggtggcggccgctctagaactagtggatcccccgggctgcaggaattcgcacgagaccattacctagaacatcctaatcgaaaaaatccatcggaggtgctctcctcttcggcttccttcggcttcggttgcaagaaagaaaaaggtcacctcttaacaccaggccgccgccattgctgctccctttgttcgtttctcggcaccctcgatcccgagcgtggttaatccacgcatcgaccggcgaacgccaccgtatcccatctcgaatacctccgcgctcagcgtcatggacggcttctccaaaacgatcggcggtggtggccctaacgttccggcgggatccccacccgcgggcggggagcccaggcgggcggcaggggggaaggccccaacccaccgggaaacaccaaaacccgcgagtggggaaggggggggccctccccccccttgggggggggcgaaaaaaaaaaaaaaaaaggggggggggggggggtggggtcacaactatttcaccccgcgtggnnngngaccnnnaaaaagggggggagagggggagccaaacttccaccaccccnnnncacccccccacaaacacaa

SEQ ID NO: 49920 - DNA, 710 bp, Zea mays
  misc_feature: Ceres CLONE 1461746-F
  misc_feature: Encodes the peptide sequence at SEQ ID NO. 49921
  misc_feature (689)..(689): n is a, c, t, g, unknown, or other
  misc_feature (700)..(700): n is a, c, t, g, unknown, or other
aagctggagctccccgcggtggcggccgctctagaactagtggatcccccgggctgcaggaattcgcacgagaccattacctagaacatcctaatcgaaaaatctaaaaacgtaaatgcacacaaaactagggtttccaccccacccggcgtcaccctcatgagccagccgccacccccacgtccccacccatccgccagccccaggcttctagcctctgtcccagccggcagcccaccacccgcgaggccgcgaccggcgaccgcccgcccctgacgcggtgactgcgtcctcctccgctctccgtgcgccaccctgaagcggtgaggcggcgacctccaggcacctccctcccccggttcggcggctccctcgaggccttcctccccacgggttcagcagctcccgatccacacggccaaaggccgattcgcgctcctccagccttcctcggcgtccaacagcaagtgaaaaacttcaacccaggaatggcgatgtcttggacaagagggttaaagcatggtgttgttccgaggcatgccgctcaattggtagagagcagaagccttgcaattgcaagcaaggcgaagaagggtggaaaggctgatgctggcaaaactcctgctctcagccaagagctcaagagtacaacagtgttcggggcaaacatcttcaaggaggggtctgantcgaaaatccnaccagactct

SEQ ID NO: 49921 - protein, 74 aa, Zea mays
  misc_feature: Ceres CLONE 1461746-F
  misc_feature (67)..(67): Xaa is any aa, unknown, or other
  misc_feature (71)..(71): Xaa is any aa, unknown, or other
MAMSWTRGLKHGVVPRHAAQLVESRSLAIASKAKKGGKADAGKTPALSQELKSTTVFGANIFKEGSXSKIXPDS

SEQ ID NO: 49922 - DNA, 688 bp, Zea mays
  misc_feature: Ceres CLONE 1461747-F
  misc_feature: Encodes the peptide sequence at SEQ ID NO. 49923
  misc_feature (499)..(499): n is a, c, t, g, unknown, or other
  misc_feature (572)..(572): n is a, c, t, g, unknown, or other
ctggagctccccgcggtggcggccgctctagaactagtggatcccccgggctgcaggaattcgcacgagaccattacctagaacatcctaatcgaaaatctgctaacgccgctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagcaagatcctccgcatcctcaaggcccatgggttggcgccggagatcccggaggatctctacttcctcattaagaaggcggtggcgattangaagcatttggagaggaacaggaaaggacaggactccaaattcagactcattctttgtgagagcaggatccancgccttgcccgctactacaagcgtaacaagaaagctccacccacctggaagtacgagtcaactaccgcgaacacctctggtgggcctagtgaaatccctccaggggctgggccttt

SEQ ID NO: 49923 - protein, 161 aa, Zea mays
  misc_feature: Ceres CLONE 1461747-F
  misc_feature (1)..(60): Pfam Name: Ribosomal_S13_N Pfam Description: Ribosomal S13/S15 N-terminal domain
  misc_feature (65)..(149): Pfam Name: Ribosomal_S15 Pfam Description: Ribosomal protein S15
  misc_feature (99)..(99): Xaa is any aa, unknown, or other
  misc_feature (123)..(123): Xaa is any aa, unknown, or other
MGRMHSRGKGISSSALPYKRTPPIWLKTATTEVEEMITKAAKKGQMPSQIGVLLRDQHGIPLVKSVTGSKILRILKAHGLAPEIPEDLYFLIKKAVAIXKHLERNRKGQDSKFRLILCESRIXRLARYYKRNKKAPPTWKYESTTANTSGGPSEIPPGAGP

SEQ ID NO: 49924 - DNA, 703 bp, Zea mays
  misc_feature: Ceres CLONE 1461753-F
  misc_feature: Encodes the peptide sequence at SEQ ID NO. 49925
  misc_feature (462)..(462): n is a, c, t, g, unknown, or other
  misc_feature (463)..(463): n is a, c, t, g, unknown, or other
  misc_feature (514)..(514): n is a, c, t, g, unknown, or other
  misc_feature (516)..(516): n is a, c, t, g, unknown, or other
  misc_feature (523)..(523): n is a, c, t, g, unknown, or other
aagctggagctccccgcggtggcggccgctctagaactagtggatcccccgggctgcaggaattcgcacgagaccattacctagaacatcctaatcgaaaaaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaaactacgcctctacgtcgacgccgccgaccccgcggnncgcacgtgccctacgtcgccgtcgtgtacgagcaggtctggacccgcaccngncagctcngctccttcaaccggtgccccggcgccccctgaaacatacggacccggttgggccgaagcgaccacgaacatggtctccgtcaattaccgggcgagctaacctaataatgggttccaaaaaaaaaaaaagggctccccccgttcccaggggccctaagaaggaaaccaaaagggttccgag

SEQ ID NO: 49925 - protein, 152 aa, Zea mays
  misc_feature: Ceres CLONE 1461753-F
  misc_feature (100)..(100): Xaa is any aa, unknown, or other
  misc_feature (118)..(118): Xaa is any aa, unknown, or other
MATHRHCLPLLLVAAALALAAVPARAALGGGRGPLLGGWNPIPDVSDSHIQELGGWALGQAKHQKLAADGLRFRRVVRGEQQVVSGMKLRLYVDAADPAXRTCPTSPSCTSRSGPAPXSSAPSTGAPAPPETYGPGWAEATTNMVSVNYRAS

SEQ ID NO: 49926 - DNA, 801 bp, Zea mays
  misc_feature: Ceres CLONE 1461755-F
  misc_feature: Encodes the peptide sequence at SEQ ID NO. 49927
  misc_feature (7)..(7): n is a, c, t, g, unknown, or other
  misc_feature (16)..(16): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (427)..(427): n is a, c, t, g, unknown, or other
  misc_feature (428)..(428): n is a, c, t, g, unknown, or other
tattccnttctcctcnctttctcctctttttttttatnntntttnnnnnnccaaactggagctccccgcggtggcggccgctctattctagtggatcccccgggctgcaggaattcgcacgagaccattacctagaacatcctaatcgaaaaattgcaagccttcccggttacttgttcactagcaaggtagggacggcatggcccttggagctgcgtaccatcactacctgcagctcgtcggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggnnccaagaccccacatctcgatccgggacctggacgcccaccacgggagcaacggcctgttgctcctccgcatcggcgccctgcccaccctgttcgtgtccctctcccaacgcccgccaagcccctccctgcggcacccagaaacaaattcttccccttcccgggcccgcccttctatgggccgccaaaaattatccgcttacggggcccttcgaaagttcccgttttgtggccttaccgcaaattacttgtggggtcgggccaagaaaaattctcttacctagtaaaaatcctcacccccaaaaaaagggggattcctttccccccaggtgccaaaaaaaaaaaaagtgccgcctccctttcgtaaaaaaaaac

SEQ ID NO: 49927 - protein, 35 aa, Zea mays
  misc_feature: Ceres CLONE 1461755-F
MGRQKLSAYGALRKFPFCGLTANYLWGRAKKNSLT

SEQ ID NO: 49928 - DNA, 675 bp, Zea mays
  misc_feature: Ceres CLONE 1461758-F
  misc_feature: Encodes the peptide sequence at SEQ ID NO. 49929
  misc_feature (505)..(505): n is a, c, t, g, unknown, or other
  misc_feature (506)..(506): n is a, c, t, g, unknown, or other
ctccccgcggtggcggccgctctagaactagtggatcccccgggctgcaggaattcgcacgagaccatacctagaacatcctaatcgaaaagacccctaccccatctcccggccgaccccacggcgctctccgccatgccggacgtgcaacctctcgtcagcgacttcgtcctcaagctcaagcgccggaaggtggaggggtcgcacgcggtggcccggcagacggcggagctgctacggtcggttgtgtcgcagcatcggatgggtagcagcgccaaccaggcggccacacttgccgatgccgtacgggctgtgggggagcagctcattgccgccaatcccattgagcttgctgttggaaacattgtgagacgtgttttgcatataataaaggaggaagatatatcttccacagcagttggtatcgaaggtctttctgttactgttgacagtgatgatgaatatgacagcgaacatgatgatcgccctgcattatctgctgctnngtctgctgcacatgctagaaatgcccctccgtgcacccttcattgcagaactctgctagaagaacattcctggtgagtcctggaattttcccgcactgcatccatcaactgttgacctcaaacggaaaaagtaaaccagctggagataaaacctcacctagaaaactga

SEQ ID NO: 49929 - protein, 148 aa, Zea mays
  misc_feature: Ceres CLONE 1461758-F
  misc_feature (124)..(124): Xaa is any aa, unknown, or other
MPDVQPLVSDFVLKLKRRKVEGSHAVARQTAELLRSVVSQHRMGSSANQAATLADAVRAVGEQLIAANPIELAVGNIVRRVLHIIKEEDISSTAVGIEGLSVTVDSDDEYDSEHDDRPALSAAXSAAHARNAPPCTLHCRTLLEEHSW

SEQ ID NO: 49930 - DNA, 729 bp, Zea mays
  misc_feature: Ceres CLONE 1461763-F
  misc_feature: Encodes the peptide sequence at SEQ ID NO. 49931
ccccgcggtggcggccgctctagaactagtggatcccccgggctgcaggaattcgcacgagaccattacctagaacatcctaatcgaaaaataacccactctcgttttcttcttgcatcggaagacgatctctcctcttgagcgacgaaagatggagaaaggagggatagatccccgggttcgactcctccacaaccatgcgtcccgatccctcatcagctctcgaatcgcgataggagacggccgctgctgcaccttcctggagatccacttctacatcatcctcccgcacctcgacgccttcctcctattcagctgctgcggagaagagttacgcatctggctgctggatcacatccttggataagtacccggaatcatctacgccatctatgcttgttgaccccctcgatgtatgacccgggcccaaagggaattactacagcccttgctttagagctcctggttgtgcccggggggggcctgcgaaggcggaaggtggaaatcaacctttttctttttctcggtgggcattcggctggacgtggccttaagcggcaatgggttaacccaggccttgggggccttaaactgctggttaaccaaagttgccaacctcccctgttatgggccccccacgttactccatacctggaattcggcaaacctgcgggggggatcacacagggcgctggtgttctctgaaaacccaatggggtcttcctgtgg

SEQ ID NO: 49931 - protein, 71 aa, Zea mays
  misc_feature: Ceres CLONE 1461763-F
MEKGGIDPRVRLLHNHASRSLISSRIAIGDGRCCTFLEIHFYIILPHLDAFLLFSCCGEELRIWLLDHILG

SEQ ID NO: 49932 - DNA, 637 bp, Zea mays
  misc_feature: Ceres CLONE 1461770-F
  misc_feature: Encodes the peptide sequence at SEQ ID NO. 49933
  misc_feature (344)..(344): n is a, c, t, g, unknown, or other
tggagctccaccgcggtggcggccgctctagaactagtggatcccccgggctgcaggaattcgcacgagaccattacctagaacatcctaatcgaaaacttcgcggcgctgcttatctcccgctcccggctcccctcctcccccgcgccgcgatgaacacagccatggccaccacctccttatccctccaaggccgcccatcccacgctcccactaggaagctctcctccccgttcctcggagcccccgcgtcctttctccggccgctggctcccacgcccgccgccggcccctcctcgcggcggacgcttgccgtcagggccatggcgcctccccagccgggnagcaagcccaagaaagtggtgggccttataaagctggcgctcgaggccggcaaggcgacgcgggcgccgcccgtcggcccggcgctcggtgcccagggaagccaacatcatgggcgtttctgccaagggagtaacaatggcccaaaaagggccgaaaaaagccccggggtaaaaataattccccgtcaaaatccccggggttgaaaaaaaaaacttaacctccgctttgaaaaaccccccgggtttagtcccgggtcacaagggtgccgggggccaaaaaaggtcaaaaaaac

SEQ ID NO: 49933 - protein, 127 aa, Zea mays
  misc_feature: Ceres CLONE 1461770-F
  misc_feature (69)..(128): Pfam Name: Ribosomal_L11_N Pfam Description: Ribosomal protein L11, N-terminal domain
MATTSLSLQGRPSHAPTRKLSSPFLGAPASFLRPLAPTPAAGPSSRRTLAVRAMAPPQPGSKPKKVVGLIKLALEAGKATRAPPVGPALGAQGSQHHGRFCQGSNNGPKRAEKSPGVKIIPRQNPRG

SEQ ID NO: 49934 - DNA, 709 bp, Zea mays
  misc_feature: Ceres CLONE 1461782-F
  misc_feature: Encodes the peptide sequence at SEQ ID NO. 49935
  misc_feature (522)..(522): n is a, c, t, g, unknown, or other
  misc_feature (545)..(545): n is a, c, t, g, unknown, or other
  misc_feature (547)..(547): n is a, c, t, g, unknown, or other
  misc_feature (558)..(558): n is a, c, t, g, unknown, or other
  misc_feature (606)..(606): n is a, c, t, g, unknown, or other
ggagctccccgcggtggcggccgctctagaactagtggatcccccgggctgcaggaattcgcacgagaccattacctagaacatcctaatcgaaaaacccacacatccgacgccgaggaagtaggaagcacgaccagcatatgtcacagagggccagcgtcccacactcctcctgcatagccttcgcgctccattcccatctcctggtctccagtgagatgtgccccagctcctattggcagcaatagctattctccgccttcctttttttcttcttcttcttcctttcctcccgtctggatttcgtttccgtttgatcgagctggctctcagcttccgtttttagttttgttggcatctttgctctcggatccgtctctccctaactcctgaaacccaaaaggagagaagaaaccgggcaagcaagcgatgggtgtcaagggattcgtcgagggcggcatcgcctccatcgtggccggctgctccacccacccgctggacctcatcaaggtccgcatgcanctgcaggggggagcggcggccgncntggcgccgcanccggcgctgcgccgggggctcgccttccacgcggggggcacgcgttcngctcccgaacaccagaaattccgggcccccccgaaacccgggcccctgccttcggcccaaaactggggcccaaggccccgggcctttcccggggggccccccc

SEQ ID NO: 49935 - protein, 93 aa, Zea mays
  misc_feature: Ceres CLONE 1461782-F
  misc_feature (31)..(31): Xaa is any aa, unknown, or other
  misc_feature (39)..(39): Xaa is any aa, unknown, or other
  misc_feature (40)..(40): Xaa is any aa, unknown, or other
  misc_feature (43)..(43): Xaa is any aa, unknown, or other
MGVKGFVEGGIASIVAGCSTHPLDLIKVRMXLQGGAAAXXAPXPALRRGLAFHAGGTRSAPEHQKFRAPPKPGPLPSAQNWGPRPRAFPGGPP

SEQ ID NO: 49936 - DNA, 732 bp, Zea mays
  misc_feature: Ceres CLONE 1461784-F
  misc_feature: Translation starting site: 186
aaagctggagctccccgcggtggcggccgctctagaactagtggatcccccgggctgcaggaattcgcacgagaccatacctagaacatcctaatcgaaaaacaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaagagccatatgttgtgaagcttgatcagcgagaggatggctcaaagattcaggatgccctacttgaagatagttgcaaggctactgtccctcaagttttttgtcatggaaagcacttggtggttctggactatcctgtgacctccaccaaaggggaaaaatggctaaccttctaaaatcgaaatcaaggccaaactttgagggaaattttaatcgggcacccctgttctttgggtttaaaccgacccggttttcaaaatttcaaaatggtttttgccccgggggcacccccccacactccaaaacccgggtttttttccaaaggaaaactccaaaatttctt

SEQ ID NO: 49937 - DNA, 750 bp, Zea mays
  misc_feature: Ceres CLONE 1461788-F
  misc_feature (406)..(406): n is a, c, t, g, unknown, or other
  misc_feature (452)..(452): n is a, c, t, g, unknown, or other
  misc_feature (454)..(454): n is a, c, t, g, unknown, or other
  misc_feature (455)..(455): n is a, c, t, g, unknown, or other
  misc_feature (461)..(461): n is a, c, t, g, unknown, or other
  misc_feature (465)..(465): n is a, c, t, g, unknown, or other
  misc_feature (467)..(467): n is a, c, t, g, unknown, or other
  misc_feature (490)..(490): n is a, c, t, g, unknown, or other
ggagctccccgcggtggcggccgctctagaactagtggatcccccgggctgcaggaattcgcacgagaccattacctagaacatcctaatcgaaaaacaataaccaggagcgagctacctgcgaagccacatctctccttccacttcatcgatagtacgcatctccatattcaggtaaataacatcgtctgcatgccgcgcgcccctaatagcatctcgatcacatttttgtgttcttgacttctcctctggaagccttgttgtttaacaaagttatatcagtcggtcgatctttggacccacatgtaaatcttggtccgcgtccgccgtgcagtgcagaagcacaagctaagccatgagcaaacgtggtaaccgcagcaggggcggcgcgaaggtcgagctgcanctgcacctgtcgccgccgcccccggctagaagggtggaagtggacngnngaaggnaacngnagcaactcttcttcctcccaaanttcggggtggtcttcggacggcaccccagggaaaaagcccctaatggggatccgcccctgaccccgggcaataaattacttacaggggggccaaaaaggatctccccccctggtaaaattggaaaaaccccctccccggggaacccccccccagtttggggcccggggggaaagggggaaaagccaataaaaaaggggggcccgttgttttaaaacaccccccgggggggggcaaatgtggtccccccggggggggggcc

SEQ ID NO: 49938 - DNA, 717 bp, Zea mays
  misc_feature: Ceres CLONE 1461789-F
  misc_feature: Encodes the peptide sequence at SEQ ID NO. 49939
  misc_feature (397)..(397): n is a, c, t, g, unknown, or other
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
cagctggagctccccgcggtggcggccgctctagaactagtggatcccccgggctgcaggaattcgcacgagaccattacctagaacatcctaatcgaaaaaacgcatttccgtcttctcctccgacgagttccctcaatccgcgctgcctgagcccaccctgcctgcctcgccgcgatccctccgcgctgctcgaggctcctgtcctgaaccaatcgagaacgccgacttccggggacgggatcatctaaagccgcctccttcccgttgaatccgccgagattctgcgtgaggcgaggttaccgacttcccttgcgcgtagggccggcaggagcgcccgctggccatggcgtgccgggtcttctttgactgcttcctcgggggggggggggcctcnncnncatggcggtttggctggtcatggtgggctacagcaccttcctgctcgtgacctgccttcaggtcgcgccacttccgccggcttcgtcgtcgccggacgcccggccccccagcgggaagcccttgaagctccggaggcccctgctccttttcgttaaccttccttgtcggaatggaaccccgaagaggtctcccgggcccgcgtttattttggcgtttattggcgtcgggccctaaaccttttttcccaatcaattttgcgctggggggggacttaaaaagggggtgccgttcttcgcttttactccatcccccact

SEQ ID NO: 49939 - protein, 77 aa, Zea mays
  misc_feature: Ceres CLONE 1461789-F
MAVWLVMVGYSTFLLVTCLQVAPLPPASSSPDARPPSGKPLKLRRPLLLFVNLPCRNGTPKRSPGPAFILAFIGVGP

SEQ ID NO: 49940 - DNA, 711 bp, Zea mays
  misc_feature: Ceres CLONE 1461794-F
  misc_feature: Encodes the peptide sequence at SEQ ID NO. 49941
  misc_feature (292)..(292): n is a, c, t, g, unknown, or other
  misc_feature (301)..(301): n is a, c, t, g, unknown, or other
  misc_feature (386)..(386): n is a, c, t, g, unknown, or other
ctggagctccccgcggtggcggccgctctagaactagtggatcccccgggctgcaggaattcgcacgagaccattacctagaacatcctaatcgaaaaacgtcacagtgacagaggtcttcgaactcttggtacaccatcgtctactctactgttcttggcggtgctactgtatatgtatataagtagtcccttccgtcatcaacattaagaaaataggagcagcttcacctcggaagctcagactcagtaggatgcaacaagaacatgcccaaccttcaatggttggtgcngaagggggntgtgagagatgcagggactggcaggagcactactactgggagcatatggatgcgagcaagatccgctttctcaggtgcatgacangagactttgctcatcgcattagcgtgccagagaaagtcgcaaagaacttcagggggcagatcaccaaaaagttccacctgaaatccactagcagcgctgaaacatggaccgtccggtgtaaaaaccatggcaacaaactattcctctggtcagggtggaaaaatttcccaaagctcatgaacttgaaagaaaaagatcccccgccctttcgcttgcctgggaaaacctttcctttgagggccaagccttccaaaacaaggggttttaaaaaaaaggtcccccctttttggaaaggaaatttggccccaaaaagggcaaaaaattt

SEQ ID NO: 49941 - protein, 143 aa, Zea mays
  misc_feature: Ceres CLONE 1461794-F
  misc_feature (36)..(36): Xaa is any aa, unknown, or other
MVGAEGGCERCRDWQEHYYWEHMDASKIRFLRCMTXDFAHRISVPEKVAKNFRGQITKKFHLKSTSSAETWTVRCKNHGNKLFLWSGWKNFPKLMNLKEKDPPPFRLPGKTFPLRAKPSKTRGFKKKVPPFWKGNLAPKRAKN

SEQ ID NO: 49942 - DNA, 758 bp, Zea mays
  misc_feature: Ceres CLONE 1461796-F
  misc_feature: Encodes the peptide sequence at SEQ ID NO. 49943
  misc_feature (325)..(325): n is a, c, t, g, unknown, or other
ggagctccccgcggtggcggccgctctagaactagtggatcccccgggctgcaggaattcgcacgagaccattacctagaacatcctaatcgaaaaaaattaaagaaaaaggaaattttcttgggcgttcttcggcttcattgtcacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaggccaaaatccaggacaaggaagggattcccccagatncacagcgactgatattcgctgggcagcagctgggagatggacgcacgctggctgactacaacatccaaaagagtcaactcttcatttggcctcaggctttaggggtggaacctgattcaggtcaaaaatttcctggggaaaaaaatccaaatcaacattgaaccccccgactcctattgaccggataaaggaccctgtttaaaaaaaaaaaggttttccccccggggaacaaaaggctccttttttctggaaaaaacctttgttataacaaaaccccaaagggcctcacaccccgggggggggaggggcccccccttttccctttcctagagggggggttcctctccaaccccgggaaaacccccccaaaaaaactgtgggtgtggcggcaaaaattgggcgccccttttttttatctccgggggaaaaaaaa

SEQ ID NO: 49943 - protein, 92 aa, Zea mays
  misc_feature: Ceres CLONE 1461796-F
  misc_feature (6)..(74): Pfam Name: ubiquitin Pfam Description: Ubiquitin family
  misc_feature (40)..(40): Xaa is any aa, unknown, or other
MQIFVKTLTGKTITLEVESSDTVDNVKAKIQDKEGIPPDXQRLIFAGQQLGDGRTLADYNIQKSQLFIWPQALGVEPDSGQKFPGEKNPNQH

SEQ ID NO: 49944 - DNA, 769 bp, Zea mays
  misc_feature: Ceres CLONE 1461797-F
  misc_feature: Encodes the peptide sequence at SEQ ID NO. 49945
  misc_feature (1)..(1): n is a, c, t, g, unknown, or other
  misc_feature (73)..(73): n is a, c, t, g, unknown, or other
  misc_feature (75)..(75): n is a, c, t, g, unknown, or other
  misc_feature (769)..(769): n is a, c, t, g, unknown, or other
nttttgggggaggggattaggtgtagagggggggtttgggcgccaccaaaaaagcagctcacagggaggaggnanactaacacctactcaaaaaccgccgggatgcaggaggtctccccagaccattacctagaacatcctaatcgaaaaactacgcgcgaggcacggcacggcacggcacgaccgagctccagtctgcccccgcccccgcccccatccgcacgtccgccttgatccggcaaatggcgtcgccggcgcggcggctcctgcagaccaactccgtgcagtacccgacgctccccgcggccgacccgccgagcgcgctggccgtcgactccgacgtggtggtcatcctcgccgcgctcctctgcgcgctcatctgcgtcgtggggctggcctccgtggcccggtgcgcgcgctccagagacacgcccgccgccgccgccaggagggggctcaggaacaacgcgctcagggcgctgccgagcctcgcgtaaaaggacgccatgacggcccgggcccggggccggggacggggccggggacggggccggcggaagtcctggccgaattgcgccttctgcctgtagggagttcgcggcacggggaggaaggtaccgtgtggtttgccgtagggaggggacaaaacattcacaagatcgccccggagacggacaacctgggggttgggtgatacaaattttcaaccacggtccacctccggggacccacccaccgtctcccccatacgtacaggaccgaaaaaaan

SEQ ID NO: 49945 - protein, 84 aa, Zea mays
  misc_feature: Ceres CLONE 1461797-F
MASPARRLLQTNSVQYPTLPAADPPSALAVDSDVVVILAALLCALICVVGLASVARCARSRDTPAAAARRGLRNNALRALPSLA

SEQ ID NO: 49946 - DNA, 695 bp, Zea mays
  misc_feature: Ceres CLONE 1461798-F
  misc_feature: Encodes the peptide sequence at SEQ ID NO. 49947
  misc_feature (560)..(560): n is a, c, t, g, unknown, or other
ctccccgcggtggcggccgctctagaactagtggatcccccgggctgcaggaattcgcacgagaccattacctagaacatcctaatcgaaaaacaaacacgtgacacctccgcccaccctcgccccctccctaccggcaccgcccagatggcctgctcccacatcgtcgccgccgcgggggtctcctcccccgccgcagcggcggctcgttccccggcgcattctcccgctgccgccttcgcgcgcctccggtcgacgcctcgtttcgcgagcgctggcttgtcggttaagggaaacggagcggcgttcccgttggtcgccgccgcggggccggccgcggcggcaccggtggccgacctggacggccgcccggccacggagaagcagcccatcatcgtcatcgacaactacgacagcttcacatacaacctctgccagtatatgggggagcttggattgaacttcgaagtataccgcaatgatgaactgaccatagaagatgtgagaaggaagaacccaaggggaatacttatttctccaggacctggtgaaccacaagnatcgggaatatcattgcagactgttcttgaattaggccccacccatccaattttttggagtttgcatgggtctgcaatgcattggagaagcatttgaaggaaagattatcggggctccttccggatgatgcatgg

SEQ ID NO: 49947 - protein, 169 aa, Zea mays
  misc_feature: Ceres CLONE 1461798-F
  misc_feature: SWISSPROT Homolog: EC 4.1.3.27 Anthranilate synthase
  misc_feature (138)..(138): Xaa is any aa, unknown, or other
MACSHIVAAAGVSSPAAAAARSPAHSPAAAFARLRSTPRFASAGLSVKGNGAAFPLVAAAGPAAAAPVADLDGRPATEKQPIIVIDNYDSFTYNLCQYMGELGLNFEVYRNDELTIEDVRRKNPRGILISPGPGEPQXSGISLQTVLELGPTHPIFWSLHGSAMHWRSI

SEQ ID NO: 49948 - DNA, 914 bp, Zea mays
  misc_feature: Ceres CLONE 1461802-F
  misc_feature (22)..(22): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (437)..(437): n is a, c, t, g, unknown, or other
  misc_feature (914)..(914): n is a, c, t, g, unknown, or other
ttggtttttggtttttttttgngtcgcccccccnnnggtggnnnnnaacaaaggaactccccgcggtggcggccgctctagaactagtggatcccccgggctgcaggaatgtcgcacgagaccattacctagaacatcctaatcgaaaaaactttcttgctgctccaattcgctctctttactcggccagcggaaggggagaggagggcgagatgacggtggagaaggtggacgcggggctttccgacttcgacgcccacttcgatcgcctcttcgcttcccgggacgccgcctccgaaggcaagggtgaagctgcagctcttcctgagccacacgtaaggctggttcctcgctcatctggggccccgactgttatggtggcataacgcggaaaccagcggggggatggtaggttagttgagggtgtgtgggggatnggggcaacaaacaaaacaagtattggataacctgcccccccctgggtgggaggttgggagtgattcttaggcgacggggggtaccaccgggatccacgcacgccaaagagatatggacccaacattcgtctataggataggccgcgtgcagaactatccccctcgactgccgcctgccgaacccgcgggacttaccaatagtgtgctgggcgggacacgcatcgcgggctccgcgcgccgccgaggatgatggcggagggtggagtgagtaccaccccgccatcacaaggaagatcgtagtactaagcaaaaatagagacggcaacgcgcgtagtgtggagtgggcttctcctactatgtttgcgcgagcacaacccccagagacaagacgaacgcgcacggagttcgagcagtctgagcgccgcctcgaacggcagccccgcgacacctttggctaccagcatcgcctcctagccn

SEQ ID NO: 49949 - DNA, 708 bp, Zea mays
  misc_feature: Ceres CLONE 1461808-F
  misc_feature: Encodes the peptide sequence at SEQ ID NO. 49950
ggagctccccgcggtggcggccgctctagaactagtggatcccccgggctgcaggaattcgcacgagaccattacctagaacatcctaatcgaaaaacgggccacggccacgccgtagatctcctcctcgtcgcagggctccggcggtctcgccggcgtgagctgaagcgatggagctctggagcaagctgcgaaacctggatgcctacccgaaagtgaacgaggacttctacagccgcaccctctccggcggcctcatcaccatcctctcctccctcgccatcctcctcctcttcttctccgagatccgactttatctatattctgccacggaaagtaagctcactgttgatacctcgagaggggaaagactacatatcaattttgatgttacgttcccggcccttccttgttctctagttgctgttgatacgatggatgttagtggagagcaacattatgatataaggcatgacataataaagaaaagaattgatcatcttggtaatgtaattgaatcaagaaaagacggagtttggtgcccctaagattgaaagaccattacagaagcctggcggtagggcttgaccacaacgaggtttactgcggatcttgttatggtgctgaggagtccgatgatccgtgttgcacctcctgtgaaaaattccgggaagcgacccaaagaaagggtggggcgttcacaaacgt

SEQ ID NO: 49950 - protein, 125 aa, Zea mays
  misc_feature: Ceres CLONE 1461808-F
MELWSKLRNLDAYPKVNEDFYSRTLSGGLITILSSLAILLLFFSEIRLYLYSATESKLTVDTSRGERLHINFDVTFPALPCSLVAVDTMDVSGEQHYDIRHDIIKKRIDHLGNVIESRKDGVWCP

SEQ ID NO: 49951 - DNA, 739 bp, Zea mays
  misc_feature: Ceres CLONE 1461810-F
  misc_feature: Encodes the peptide sequence at SEQ ID NO. 49952
aagctggagctccccgcggtggcggccgctctagaactagtggatcccccgggctgcaggaattcgcacgagaccattacctagaacatcctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgataggcagcgcggcgtcgccctcccgcgcgtgctgcagcggggtgcgctcgctcaacagccgcgcgtcgtcgacggcggaaccggcaggccaactgcaactgcctcaagagcatgacgggcccggctcggggggggcgtcagcatggccaacgccgccaacatccccgggaatgggggggtctccgttggggtgccatcaacccccccgtgaattggcccaagaacaaatgattcatggaccccaaggggaggagcttttcccccccaatccccttggaaggaacaggggccaataaaaaaagggggccccctcccccccccaaaaaagtccccaaaccacggggggcgcccaaaagggggcgggggccaaaaaaaaaaaaaaaccccg

SEQ ID NO: 49952 - protein, 148 aa, Zea mays
  misc_feature: Ceres CLONE 1461810-F
MAARSSSQQLVAAAVLAAALLLLAAGAGTASAAVSCGEVTSSVAPCLGYAIGSAASPSRACCSGVRSLNSRASSTAEPAGQLQLPQEHDGPGSGGASAWPTPPTSPGMGGSPLGCHQPPRELAQEQMIHGPQGEELFPPNPLGRNRGQ

SEQ ID NO: 49953 - DNA, 747 bp, Zea mays
  misc_feature: Ceres CLONE 1461812-F
  misc_feature: Encodes the peptide sequence at SEQ ID NO. 49954
ggagctccccgcggtggcggccgctctagaactagtggatcccccgggctgcaggaattcgcacgagaccattacctagaacatcctaatcgaaaaattcacaacttcagctgcgcctcgactcgtagcccgaaccctagccaccaagccggaggcgagagagcagccatggcgcggtgcctcgcgctcgtcgccctcctcgtactcggcctcgccgccgccgccgcccctcgcggcgacgcgcccttcgtcgtcgcgcacaggaggatttcgctctcccgccccaagcggggcgtcaagcgcgtcgtcgtcttccgtcgacttcttcaacaggggatcgcgactggccatgaaggggccataaatggccacctttggcccaaaaaagtgtttgaaccttttccttggaaaaaaatcccaaaaatttaaaaaaggttttaaccctggggcccctgggtttccaaaaatttttccggggaaaacaaaaaaaggggggggttccgggggtccccccttttttattaaaaacgggggtccccaaaaaaaacctttttcggggggggtaccccccccccctctccccccgggatttttcccgcggaaagcccctcccaaaaaaaattttttggcggccaaaactttttttaaaaaaaacaggggcttttgggggggggcctctttttttggggggggtttttatcccggggggggggccccccggagaaaaacctttagagaacacaaaaa

SEQ ID NO: 49954 - protein, 86 aa, Zea mays
  misc_feature: Ceres CLONE 1461812-F
MARCLALVALLVLGLAAAAAPRGDAPFVVAHRRISLSRPKRGVKRVVVFRRLLQQGIATGHEGAINGHLWPKKVFEPFPWKKIPKI

SEQ ID NO: 49955 - DNA, 723 bp, Zea mays
  misc_feature: Ceres CLONE 1461817-F
  misc_feature: Encodes the peptide sequence at SEQ ID NO. 49956
  misc_feature (723)..(723): n is a, c, t, g, unknown, or other
aagctggagctccccgcggtggcggccgctctagaactagtggatcccccgggctgcaggaattcgcacgagaccattacctagaacatcctaatcgaaaaaaaaacccctacatcctgccatacatccatccgccgccgccgccgccgccatctcctcccactctcttcccactccgacgaaaccctattcagtatccatctctccatccatggcgtggcgcggccccgccacccgggccgtcctcgccgccgtccgccgcccggcagcggccgcgcgcctccacgccccgcgccgccgcgtcccgcccgccttcgccaccacctcctccccgctcccgtccgcgcggcctctggcggcgttgatggggtccccggtgacggtggccgccgtgatggcgcgtctcacggcgcatcccggcgccagcgcgcgcgcgtgctgcgagctttcccagggaaacggaaaagatgggtgatgcaagagaggccatcgtagagcctgccaaaggtacttgaatctgttgtgtagatcccatcctttcgaaaggataaatgatgtgtcttttgggggaataaaagctattatggcatttcttccacagcaaagttcgaagaaattacccaacaatagctagtttcctcgttaggatttcgagaagacttaataattttaacgttacatggcatggttttggtgtttaaaacagctattgacgaataattn

SEQ ID NO: 49956 - protein, 87 aa, Zea mays; identical to SEQ ID NO: 45551
  misc_feature: Ceres CLONE 1461817-F

SEQ ID NO: 49957 - DNA, 729 bp, Zea mays
  misc_feature: Ceres CLONE 1461819-F
  misc_feature: Encodes the peptide sequence at SEQ ID NO. 49958
  misc_feature (371)..(371): n is a, c, t, g, unknown, or other
ctggagctccccgcggtggcggccgctctagaactagtggatcccccgggctgcaggaattcgcacgagaccattacctagaacatcataatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagnatagaccgcgggacatcacgatgatgccttcagcaccttcttcagccagactggtgctgggaagcacgttccccgtgcaattctcgttgatctaaaacccactgtgatcaatgaagggcgcattggcacgtaaccgccagctcttccaccctgaagaactcttcaggggaaagaggaagcccttaaaatttcgcccggggccactacaaattggcaagaattttttgatttgggctttgacttttcccaaatttgtgtaaaaatggcccggcccccgggggtccggggtcttaaagccccgtggggggggcccgggcctggccttggtttctcccccccttgggcgccgttggggagg

SEQ ID NO: 49958 - protein, 38 aa, Zea mays
  misc_feature: Ceres CLONE 1461819-F
MRECISVHIGQAGIQVGNACWELYCLEHGIQPDGQVPG

SEQ ID NO: 49959 - DNA, 743 bp, Zea mays
  misc_feature: Ceres CLONE 1461821-F
  misc_feature: Encodes the peptide sequence at SEQ ID NO. 49960
  misc_feature (346)..(346): n is a, c, t, g, unknown, or other
  misc_feature (376)..(376): n is a, c, t, g, unknown, or other
  misc_feature (398)..(398): n is a, c, t, g, unknown, or other
ctggagctccccgcggtggcggccgctctagaactagtggatcccccgggctgcaggaattcgcacgagaccattacctagaacatcctaatcgaaaagtatacttcaacacatcagactcagagcctgcgctgtcggattcgccgccagctaggcgagatggctgcgccgttgcctctttccgcggaggacatgctgcgcgtcaacggcagccgccgcttcgccgccgcgatggcggccgcctcccccttcgcgtccctcgcagacgccctcctcgccgctcggcgcatctggctcgacgagggtggatgtcacggatggctcgaggccttcgcggcgcaccccnggcatcgaaccaccctcccatctgtctccnagtcggtgaagtgcattgcccntctcacatcactcaattcgtccgcttaatttcagttggcgttttgctggtgtcgatccgccctcctccggtccctggggctgtcttgggatttgggttttccccgtcctttcaattattggaccggacccctcccctggcctgggtgccccttctggggatttcagggtttgaaacgaaaaaaaaaagggggaaaccctttaagagaaaccaatggggccaaaaacgggggggaaaacccccttccccctcccggttaaagggggaaaagggagaaaaaattaagggttttcccaccccccggtttctttggccccaaggtgtttagaggggggcgcccaaaagg

SEQ ID NO: 49960 - protein, 88 aa, Zea mays
  misc_feature: Ceres CLONE 1461821-F
  misc_feature (63)..(63): Xaa is any aa, unknown, or other
  misc_feature (73)..(73): Xaa is any aa, unknown, or other
  misc_feature (80)..(80): Xaa is any aa, unknown, or other
MAAPLPLSAEDMLRVNGSRRFAAAMAAASPFASLADALLAARRIWLDEGGCHGWLEAFAAHPXHRTTLPSVSXSVKCIAXLTSLNSSA

SEQ ID NO: 49961 - DNA, 761 bp, Zea mays
  misc_feature: Ceres CLONE 1461822-F
  misc_feature (494)..(494): n is a, c, t, g, unknown, or other
aaactggagctccccgcggtggcggccgctctagaactagtggatcccccgggctgcaggaattcgcacgagaccattacctagaacatcctaatcgaaaaaatatacgtagtgttatggatccgccttctgtcttcaagtgacaaactgaaactaaccatgaagccatgaaacaggctccgctccggcctgtagccgtgacggcgtcaggctcagctcgctcccccccacgaaaaccctaatggcgtcccggctccttcacctccgccgcctcattactcctccctccaccgtccccaccgcttccttctccaccgccgtcagcgcgaccccgcgcgtctccgcgctcgtcgacgagatctgcgggctcaccctcctcgaggcctctttcctggccgatgccctgcgcggccgcctcggcgtcgaccagttgcccgcactagctatccttacgggcggcgcccgcacgctcgtcggcggcggattaggtcccngccccgcccggcaagaggccaagccaaggaagaaaaaaaggccttccaactggaaactggaagggttccacacccccggcaaaactccagatccttcaggatctgagggggttccccaaatctggggcctaaagaaggccaaagattccctgagaaaaaaggcccccccggctcaagggttggaatcccaagggggaggggggaaaaattcccccaaaaaaatacggggcccctccccccaaaaattttttcccaaaaaaaaaaaaa

SEQ ID NO: 49962 - DNA, 732 bp, Zea mays
  misc_feature: Ceres CLONE 1461825-F
  misc_feature: Encodes the peptide sequence at SEQ ID NO. 49963
  misc_feature (398)..(398): n is a, c, t, g, unknown, or other
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcgaaaaagcctgcaacgaacaaaccagcgagcgagcgggcggaggaggagatgccgggaaaggggcagcggcggagggagaagaacttccgggcggcgcacggcggggtaccgtgcctgcccccgccgccaaagcagagggagctcgaggccatcccgactaaactccgccgcctcatcgccttccagaacaagcacaacgccaatgctgacgcgtcctcaggaggtgctcccaagaagcaagacgatgggttaaggaagaacaagctagcaacagacaaggcaaaggacaagaaaaccaanaancaggcattggtggttcctgctgatagcaaagcatcagatattaaaggtaatgataaacgttcagctgccaatgaggatgtgaatgcagagggaaagaaggggaagagaaagaggggaaatgttaaggaccttcgtttcgaggaactggacaagaacatctcaccccccataaagcaaaggaggaagcaccccctggatgagaaggaaaaaaaagcgcagggacaattaaaacagaaactcctcccgacttttcccggggccccgagaaaatccaattttggtgaaaattgtttctgggcccccccaaaatttgtcctttcccgcaaggggg

SEQ ID NO: 49963 - protein, 195 aa, Zea mays
  misc_feature: Ceres CLONE 1461825-F
  misc_feature (84)..(84): Xaa is any aa, unknown, or other
  misc_feature (85)..(85): Xaa is any aa, unknown, or other
MPGKGQRRREKNFRAAHGGVPCLPPPPKQRELEAIPTKLRRLIAFQNKHNANADASSGGAPKKQDDGLRKNKLATDKAKDKKTXXQALVVPADSKASDIKGNDKRSAANEDVNAEGKKGKRKRGNVKDLRFEELDKNISPPIKQRRKHPLDEKEKKAQGQLKQKLLPTFPGAPRKSNFGENCFWAPPKFVLSRKG

SEQ ID NO: 49964 - DNA, 774 bp, Zea mays
  misc_feature: Ceres CLONE 1461982-F
  misc_feature: Encodes the peptide sequence at SEQ ID NO. 49965
  misc_feature (710)..(710): n is a, c, t, g, unknown, or other
aaagctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtnctcttaagttgttaaataaagaaaattatctgaacaaaaaaaaaaaaaaacgagacgctcgagg

SEQ ID NO: 49965 - protein, 72 aa, Zea mays; identical to SEQ ID NO: 46899
  misc_feature: Ceres CLONE 1461982-F

SEQ ID NO: 49966 - DNA, 787 bp, Zea mays
  misc_feature: Ceres CLONE 1461984-F
  misc_feature: Encodes the peptide sequence at SEQ ID NO. 49967
  misc_feature (492)..(492): n is a, c, t, g, unknown, or other
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactcccaagctaaactgtttgagtactatgctaagctgaggagctgcattcccatcatggtggtgaagcgcgaggaaagcttcnttacggacaagttcacttgccacggaccaatcagggacccccccaagccggggactaacctgggtttggtttggcatgacacaaaccccgtgtgttgccaaaggcaatccgaaaccggaaaaccggacttttttaacccaagggtccccccccccaaaaaaatggggggctctttgcaaagcgccaaaaaaacgctttcaaaaaaaaaaaaaaaaaaaggccgggagacccattccccaaaagggaagaaaataacccccccggggcgcttttataccggggtggggagaaaccc

SEQ ID NO: 49967 - protein, 72 aa, Zea mays; identical to SEQ ID NO: 46180
  misc_feature: Ceres CLONE 1461984-F

SEQ ID NO: 49968 - DNA, 717 bp, Zea mays
  misc_feature: Ceres CLONE 1462001-F
  misc_feature: Encodes the peptide sequence at SEQ ID NO. 49969
  misc_feature (245)..(245): n is a, c, t, g, unknown, or other
aaagctggagctccccgcggtggcggccgctctagaactagtggatcccccgggctgcaggaattcgcacgagaccattacctagaacatcctaatcgaaaagctcctcacgaaaccctacctctccaactcgctccttccagtcccatccccgccgccgtcgggccctactctcagctccaaccatgcaagcccccttgccgcccctacttgccgtcgcagccgcctccgcatctccgccacantcacggctgcgccgtctccttcgtcggctgccgctgccaccgcgtcgctgagtcgagtggacgtgctctcgaagcgcctcctttttattcagcgattcaaaggcaagaacgggggtggccagtacgggggggccgccaataaatcccccgaactttcaggggtcccggaaccccggaatccggggtgggctccccggggggggcctcccccccggggttttttcaaggggggggctccagaaaaaaaatccttgtgtttggggcccttggggtaaaaacccaatttctccaaagggcccctccggtaagagaacgcctccccaaagggggccccccaaaaagggggttttccgggagaagaaaaaaaaaaaaactttttttcccctccaaaaaacacggggggagagacccctctctttttttgtggggggggaaagaaccggggctttaaaaaaccccgccccccccaaaa

SEQ ID NO: 49969 - protein, 36 aa, Zea mays
  misc_feature: Ceres CLONE 1462001-F
  misc_feature (20)..(20): Xaa is any aa, unknown, or other
MQAPLPPLLAVAAASASPPXSRLRRLLRRLPLPPRR

SEQ ID NO: 49970 - DNA, 652 bp, Zea mays
  misc_feature: Ceres CLONE 1462007-F
caagctggactccccgcggtggcggccgctctagaactagtggatcccccgggctgcagattcgcacgagaccattacctagaacatcctaatcgaaaaaccctcccccactttctcctcctcaccgagtcacaaagccaaaccctattcacggccgccggagatgggacaaggttctccggcgggatggcaagcagccggccttccggcgacgcagcaggagacgcaagaagagagaatatgaacaccgctgccccttccgtgtcgcccgagcagaagcgcagaaggctcgaaagcgcgcggcgctcccggcgtggcgcggtctaaatgcgcccttcgctactcagttcgaaccgtaaagactactttcttggaaaagaattctttgccgccagaaacccctgcccccccccggttaaaaccggggagaccctttccaggggaaaaaactcccggggattcccttaaaatcgaaatccttggggagatattttaaaaaccccttggcttttttcccctccccgggggccccaaaaataaccccgggaaaatttcttctcttttaaaagacccccccccccccgggggtgggcccttttttttgaaaaaaaaaggtgcgaaaaggttccccccaggagtgtgcagggggggg

SEQ ID NO: 49971 - DNA, 751 bp, Zea mays
  misc_feature: Ceres CLONE 1462010-F
  misc_feature: Translation starting site: 179
  misc_feature (367)..(367): n is a, c, t, g, unknown, or other
aagctggagctccccgcggtggcggccgctctagaactagtggatcccccgggctgcaggaattcgtctcacccctaatcgaaaactctgatttttggcgagcagaacatacctgagacgacaggtagaagacgactgactgcctcgagcagcacagatcacggaggccgagggcgggatgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcactgttcgtttgtggagcaccggaactacaaggtcgtttataggtgttangtgttaacttttcatcctcgtcggcgtccacagcgatgagggtggacccacccacccttgaattcatacatcttctggtggaaactatggatcgccccttccacaatgtgtgcgacctcgatatcatgttccatctggagaaagggaccttcctgttgaaagaaatggtgatgaatggttgcattgtggagacaagataaccgaacatcgttggggcccatccaaccttatgggggaaaacttccctaaaaaaggggtatcccatttgcgggaggtttcactccgattctttgaaaattttgccggtccgcgcccctttcctcaaatttccgctctgaatgtggacaggccaaaaccactcccgttaaccctgggtgtattgga

SEQ ID NO: 49972 - DNA, 774 bp, Zea mays
  misc_feature: Ceres CLONE 1462012-F
  misc_feature: Encodes the peptide sequence at SEQ ID NO. 49973
  misc_feature (468)..(468): n is a, c, t, g, unknown, or other
ggagctccccgcggtggcggccgctctagaactagtggatcccccgggctgcaggaattcgtctcacccctaatcgaaaaaacgaattgggatcgaaaaacatctccgttccccaccaccaccttcgctccttctgcttcgcccgtccccctccgtcgcgtcgactcccaagatggataagctcagtggttctgcacgtcttatgattgtttcagatcttgaccatacaatggttgatcatcatgacgaggagaacatgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgaggatacatatggggaggcaatgttcctgatgatggctgggaagattatctgaancataagtggaacggaattatgttgtaacaaaaactgggagcttttctagctgaaacctccacccaaaacgaaacacgcccgacaaggtcaactttttttttgataaaaaaaatgccccggaaggataaaattggttcgccaaagattggaaaacgtggggctaatgccaaaattatttaagggggggccggaccctttaattttcccccgggaggggagagggccccacctttgtttttttttaaaaaatttattttttgggaaacccccccaaaacccttttgtgggggcccccggtaaaaaaaa

SEQ ID NO: 49973 - protein, 97 aa, Zea mays
  misc_feature: Ceres CLONE 1462012-F
  misc_feature (8)..(97): Pfam Name: S6PP Pfam Description: Sucrose-6F-phosphate phosphohydrolase
MDKLSGSARLMIVSDLDHTMVDHHDEENMSLLRFGALWESVYCEDSLLVFSTGRSPTLYKELRKEKPMLTPDITIMSVGTEDTYGEAMFLMMAGKII

SEQ ID NO: 49974 - DNA, 440 bp, Zea mays
  misc_feature: Ceres CLONE 1462023-F
  misc_feature (191)..(191): n is a, c, t, g, unknown, or other
caagctggagctccccgcggtggcggccgctctagaactagtggatcccccgggctgcaggaattcgcacgagaccattacctagaacatcctaatcgaaaaaaccgcgtccccaacgcgaatcatccttcctccgtcaccagacagacgggtagagagtcgaacaatcgccgggctcgacgcccctcttnccgacgccgcacggccttcactggtcctcggcagcccgatctttccagagcgggttccaaccaccggtggcttgcccaccgggtcgaaaattcacttggccggcctttctggccggggaaaggtttgggctatccttttgttccgaaaccccccgttttgatccccccttttctcttccccccccccccgggggaggggcgcaaaacagttgggttccggttggtgttttattggccccccgcttttaa

SEQ ID NO: 49975 - DNA, 723 bp, Zea mays
  misc_feature: Ceres CLONE 1462025-F
  misc_feature: Encodes the peptide sequence at SEQ ID NO. 49976
agctccccgcggtggcggccgctctagaactagtggatcccccgggctgcaggaattcgtctcacccctaatcgaaaaaagctcttgaaaactgctcgtcccctccacttcaaaatctactactcaaggatggaaagctgtcatctctgtacacaacccaaggtgtggcggttgctgagctacagttctgccatcctgaggtggtcccaacgtcaaagaacttctggaagccactatgtgcatctctgcagaatctgctgaggtgcagcgtcgacatccgaatcaacctatctcctatctccggcaacggggcgggatccaaggactcgtccgtcagccttgtcatggagtcaagagaagaagaccgcgaggcacaggacccagccacctcaaactgcagaaccgtggtgtcatccgggagagactgcccttccccacccttggggcaggccaaggagagatcgtcccacatcctggggtgcctccatggcggcgcgggtggcgacgccgtggacaccgagccgaggatcctgagctaccagaagatctccgttgtccctgcagcatccaccccaggaaacactcccctgaaagccgctgccgccgctgccggagacgagtcaaaggttgatgatggcggggttcgtcctggctgctgctcgcacattttaccctgtggtgcttgcgctccccgtcagaagccccggacgcgggagaaacgcc

SEQ ID NO: 49976 - protein, 126 aa, Zea mays
  misc_feature: Ceres CLONE 1462025-F
MESREEDREAQDPATSNCRTVVSSGRDCPSPPLGQAKERSSHILGCLHGGAGGDAVDTEPRILSYQKISVVPAASTPGNTPLKAAAAAAGDESKVDDGGVRPGCCSHILPCGACAPRQKPRTREKR

SEQ ID NO: 49977 - DNA, 812 bp, Zea mays
  misc_feature: Ceres CLONE 1462027-F
  misc_feature: Encodes the peptide sequence at SEQ ID NO. 49978
aagctggagctccccgcggtggcggccgctctagaactagtggatcccccgggctgcaggaattcgtctcacccctaatcgaaaagcagtttctcgcgccatctgaagtcagctggggcgacgaagaaatgtcctctagcgatcaaaacccagctgccacacccgcgtcgtcgggccccgccgagccctcgccgccgggcaggccaacggcggtgtcctcgcgtgtcctcgacatgggcgcgcagctggcgcaggcgctgaagccggtgcggcagatgaagcagcacgcgtgcagcttcgcgctgtacgcccacgacttgcaccgccaggtggaagtcccacacttcgtcgcccggctcaacccagacgtcctccagtgcgccgtctacgactccgaacagccctcggcccgcctcatcggcgtggagtaaatcgtcttcgaacccatcttcaaggggctggcccccggacgaccaaaggctggggccactcccacccttaccaggtgaaggcgggcttggaaccaacatcgggtgtccgaaaggctttcaaaacctcgaaaaaggggaccctcccaaggcgccccggaaaattttggggccccctgagaggggaaacgggggaaaactttttcccctttgggggccggggttttgtggtgtccccacagaggccaaaaaaccccgcgcgtgggggaaaaattttggccccccccttaaaaaagggggggactcccccccctcggggggggcctccggggggggggggtgaagaaacacccccgggttattctcccaacaccaaataggggg

SEQ ID NO: 49978 - protein, 100 aa, Zea mays
  misc_feature: Ceres CLONE 1462027-F
  misc_feature (23)..(100): Pfam Name: DUF1264 Pfam Description: Protein of unknown function (DUF1264)
MSSSDQNPAATPASSGPAEPSPPGRPTAVSSRVLDMGAQLAQALKPVRQMKQHACSFALYAHDLHRQVEVPHFVARLNPDVLQCAVYDSEQPSARLIGVE

SEQ ID NO: 49979 - DNA, 707 bp, Zea mays
  misc_feature: Ceres CLONE 1462033-F
  misc_feature: Encodes the peptide sequence at SEQ ID NO. 49980
ggagctccccgcggtggcggccgctctagaactagtggatcccccgggctgcaggaattcgcacgagaccattacctagaacatcctaatcgaaaaataaacatcgcaatacaaacagtttcaaggtcatccttaaaggaaggaaaaggaagttgtgggagagtatcatggacactattggtccacatgtactcatagttgatgacacctttgttgatcgccttgtggcatctcgagttttgaagacttgtaacattcaagtgacaatggtggagggcccaaagcaagccttagattttctagatgtggagaatgatgtaaatttgattctgaccgattattgtatgcctggtatgactggatatgatctcctaatggaggtgaaggaatcaccaaagctaaagcacatcccagtggtggtcatgtctagtgaccacatccctcaaagaatgcaaaagtgcatggatgcaggggcaaaggaatacatcataaagcctatcaaagctattgatgtgcctcgtatcttgagctatatttgataagatgatgtgggaagagaatatagaacaagacaactcactatagggttctattttcaattgtcaaggaattattctaagaagaccttgcatggtcttgtgttatgtcattaattctatggaatttgcttcaacttcaattatattatttttgttatgtccaagaaa

SEQ ID NO: 49980 - protein, 123 aa, Zea mays
  misc_feature: Ceres CLONE 1462033-F
  misc_feature (6)..(121): Pfam Name: Response_reg Pfam Description: Response regulator receiver domain
  misc_feature: SWISSPROT Homolog: EC 2.7.13.3 Histidine kinase
MDTIGPHVLIVDDTFVDRLVASRVLKTCNIQVTMVEGPKQALDFLDVENDVNLILTDYCMPGMTGYDLLMEVKESPKLKHIPVVVMSSDHIPQRMQKCMDAGAKEYIIKPIKAIDVPRILSYI

SEQ ID NO: 49981 - DNA, 737 bp, Zea mays
  misc_feature: Ceres CLONE 1462036-F
  misc_feature: Encodes the peptide sequence at SEQ ID NO. 49982
  misc_feature (540)..(540): n is a, c, t, g, unknown, or other
  misc_feature (541)..(541): n is a, c, t, g, unknown, or other
  misc_feature (568)..(568): n is a, c, t, g, unknown, or other
  misc_feature (573)..(573): n is a, c, t, g, unknown, or other
  misc_feature (595)..(595): n is a, c, t, g, unknown, or other
  misc_feature (610)..(610): n is a, c, t, g, unknown, or other
  misc_feature (613)..(613): n is a, c, t, g, unknown, or other
  misc_feature (645)..(645): n is a, c, t, g, unknown, or other
  misc_feature (656)..(656): n is a, c, t, g, unknown, or other
  misc_feature (657)..(657): n is a, c, t, g, unknown, or other
  misc_feature (712)..(712): n is a, c, t, g, unknown, or other
aaagctggagctccccgcggtggcggccgctctagaactagtggatcccccgggctgcaggaattcgtctcacccctaatcgaaaaatctctaaaatagtctcccctgtgcaggcatccacttcttctctccctgatccaaatcgtgaaatagcgtcggcggttccctgcgctcctcccctctttttctagcggcgcgcagcagccacgaccggtgttctggcgatcctggacgccccctgcccagactgcgatccattttcgagcttcgaggaatcgacagtcaagcttcggcgaccaagtgatctggctcttcatgttctacaaagttgaagaccctgagcatctgtttggtgaaggttgcctttggtgcaatctatgctcaggtaaagaagaaggcgtcgagatggatctccaggagttccaggacgttgatgagttcgaggattaggctagcaacctcccccagtcagctgcctgtggtcatcttctttcacgaccccgtggacgagtacctgatgcagtacctgatggactacgnnagacagaagttccagaacgtgtccaangaggnactgaagctgggcaaggactcnaagctcaaggagctncanggatcgttcaaggagctgactgactggtgaangaaagccctgnnaaacaagaacgtggactccgtgaagatcagcaacgggtggccaaacccccctggntcgtggtccctcccagtacggtgga

SEQ ID NO: 49982 - protein, 69 aa, Zea mays
  misc_feature: Ceres CLONE 1462036-F
  misc_feature (36)..(36): Xaa is any aa, unknown, or other
  misc_feature (45)..(45): Xaa is any aa, unknown, or other
  misc_feature (47)..(47): Xaa is any aa, unknown, or other
  misc_feature (60)..(60): Xaa is any aa, unknown, or other
MSSRIRLATSPSQLPVVIFFHDPVDEYLMQYLMDYXRQKFQNVSXEXLKLGKDSKLKELXGSFKELTDW

SEQ ID NO: 49983 - DNA, 709 bp, Zea mays
  misc_feature: Ceres CLONE 1462038-F
  misc_feature: Encodes the peptide sequence at SEQ ID NO. 49984
agagctggagctccccgcggtggcggccgctctagtactagtggatcccccgggctgcaggaattcgcacgagaccattacctagaacatcctaatcgaaaactagtcgctctttctggtggtcacacatttgagaagagcacaatgtcaatttgtgacacctcgtctttataacttcaacggtaccaatagcccagacccgagtattaacccaacttacctcgcccaactacgtggactgtgccctcaaaacggaaacggcaccgttcttgtcaacttcgaccccgtgactcccgatggtttcgataataaatactacactaatcttcgtaatgggagaggtctgattcagagtgatcaagaactgttttcgactcctcaagccgacacgattccactagtggagcaatacagcacccaccagaccgcgttctttgatgcattcgcaaaagcaatgattcgaatgggagatcttaaacctttgactgggaatcaaggtgagataagactgaattgtagtgttgtgaactcaaggatcatgagtgtggagaatgaagatgatggtgttgtgagttcgatttgatcatgtcggagacatgtatatgtaagagagcataaaatgcatggggaataatttatgtaattcgactaaataaatattctcacgagttatgagataattacgggtcttaaaaaaaaaaaaaacaag

SEQ ID NO: 49984 - protein, 42 aa, Zea mays
  misc_feature: Ceres CLONE 1462038-F
  misc_feature: SWISSPROT Homolog: EC 1.11.1.7 Peroxidase
MIRMGDLKPLTGNQGEIRLNCSVVNSRIMSVENEDDGVVSSI

SEQ ID NO: 49985 - DNA, 732 bp, Zea mays
  misc_feature: Ceres CLONE 1462044-F
  misc_feature: Encodes the peptide sequence at SEQ ID NO. 49986
  misc_feature (395)..(395): n is a, c, t, g, unknown, or other
ctccccgcggtggcggccgctctagaactagtggatcccccgggctgcaggaattcgtctcacccctaatcgaaaaatcttaacagccaggaagctggcgtcttgcttgtccttgttcttttcccacccggctacccccgtcgtcgccgccgctttccccgtggtttcagagctccagtcggctagctaggccgcctggctaatctccctgccttctataagtacaggttcattgtgtgctgtgctcccagctccatcactgacacaagagagcacgctactactcatcactcgccaacgtgcagagatcagggaagcggcactccatccactgactgaccgctcatggcgaaaggtcacctctacgtcgccgcggcctggggcgtcgtcctcgngctccccaccccggcccttcgcggtgaccccgacatgctggaaggaatctggccggctgactacccctccccgggaaactgaacgggttcccgggcaagggaaattttcggggaaagactctttcttaaaggttgaagaaaccggaaaaccaaaaaccccggggggtccgggggaaaggggcccaacggggaaaattccccggcggaaaacccggggggttccctgggggcgaaaaaaaacgccgggggggggaaaaaccccgaaaaaaccccgggggcacaaaaaaaattttctccccaagggcccctgagggggttttttccccccgcaaaagct

SEQ ID NO: 49986 - protein, 43 aa, Zea mays
  misc_feature: Ceres CLONE 1462044-F
  misc_feature (17)..(17): Xaa is any aa, unknown, or other
MAKGHLYVAAAWGVVLXLPTPALRGDPDMLEGIWPADYPSPGN

SEQ ID NO: 49987 - DNA, 727 bp, Zea mays
  misc_feature: Ceres CLONE 1462045-F
  misc_feature: Encodes the peptide sequence at SEQ ID NO. 49988
  misc_feature (412)..(412): n is a, c, t, g, unknown, or other
  misc_feature (413)..(413): n is a, c, t, g, unknown, or other
  misc_feature (444)..(444): n is a, c, t, g, unknown, or other
  misc_feature (483)..(483): n is a, c, t, g, unknown, or other
aaagctggagctccccgcggtggcggccgctctagaactagtggatcccccgggctgcaggaattcgcacgagaccattacctagaacatcctaatcgaaaactagcctctatctcattccactccgacattcacgtgcagctgtcgggagcaggcaatggcgccggatctaagcgaactcgccgccgccgctgcagcccgtggcgcctacctcgccggcgtcggtgtcgcggtcctcctcgctgcctccttcctcccagtagccgagtcgtcctgcgtgcgagataactcattggtgagagacataagccaaatgccgcaaagcagctatgggattgaagggatgtcacatataacagttgctggtgcgctcaatcatgggatgaaggaagtggaaagtgtgcttcagacnnatagtcccagtcaaaagacgccgatccacangcattcctgtgaagaagttttcactgtcctcaaaggaangggtacgctcttgatgggatcaagctccctaaagtacccaggccagcccccgggaaaatcccttccttccaaaaacccaattttccaatccgtgtaacgaatccaacccaggtttggaattctgaccacccccaaaaattcgcagttcttgtgatacatttcaaaccccccggcaaaaaatttttatatggaaaatggggggaggccctttaaacccccgggaagggaaattccccttccgcgg

SEQ ID NO: 49988 - protein, 140 aa, Zea mays
  misc_feature: Ceres CLONE 1462045-F
  misc_feature (36)..(141): Pfam Name: Auxin_BP Pfam Description: Auxin binding protein
  misc_feature (86)..(86): Xaa is any aa, unknown, or other
  misc_feature (96)..(96): Xaa is any aa, unknown, or other
  misc_feature (109)..(109): Xaa is any aa, unknown, or other
MAPDLSELAAAAAARGAYLAGVGVAVLLAASFLPVAESSCVRDNSLVRDISQMPQSSYGIEGMSHITVAGALNHGMKEVESVLQTXSPSQKTPIHXHSCEEVFTVLKGXGTLLMGSSSLKYPGQPPGKSLPSKNPIFQSV

SEQ ID NO: 49989 - DNA, 801 bp, Zea mays
  misc_feature: Ceres CLONE 1462055-F
  misc_feature: Encodes the peptide sequence at SEQ ID NO. 49990
  misc_feature (792)..(792): n is a, c, t, g, unknown, or other
atagctggagctccccgcggtggcggccgctctagaactagtggatcccccgggctgcaggaattcgtctcacccctaatcgaaaaacacggtgtggtatatgtgttagctttcgtcttcgcctcggtttgggagccacatgatcggggcacagagattccgtgtgatcggggcacagagattccgtcgtaaaaaaatcgtgtcctcgccgacagggaaagccgtgttgcaagaaggggaattccgctgcgagatccgtgaacggttcagagatggcacagacggtgttcaccccctctttggaagcgatgaagcatgtcaaggcagagaacggagtcattctcaccaagcccttccttgatgtctgcaagcaaatattgcctgtcctcgataaatttggaggtgctatgccaaccccaaagagtgatatccggcggcaatatcacaagacctggaaaaacagtatactttcagaacccatcaagtattgaacccttgtaacagcatgggttcaggaaggaattccaaaaaaagaaccgcaaaagggttcttcaagctgccacaaattgggcttctggggcttgaacaggggccatggaacttcccttgttgaatttgttccgaaccttgccttgaaaccccaaacgggggcccggggggccaactttggcctgggttctatccccccaaaacttggaaaaaaattttcggggagggggtttgcgcgttcttattttttacggggcggaataagaacctcgccccccaaaaagaaaaaaatttttggggggncttttgtgg

SEQ ID NO: 49990 - protein, 72 aa, Zea mays
  misc_feature: Ceres CLONE 1462055-F
MAQTVFTPSLEAMKHVKAENGVILTKPFLDVCKQILPVLDKFGGAMPTPKSDIRRQYHKTWKNSILSEPIKY

SEQ ID NO: 49991 - DNA, 799 bp, Zea mays
  misc_feature: Ceres CLONE 1462059-F
  misc_feature: Encodes the peptide sequence at SEQ ID NO. 49992
  misc_feature (335)..(335): n is a, c, t, g, unknown, or other
  misc_feature (344)..(344): n is a, c, t, g, unknown, or other
ctggagctccccgcggtggcggccgctctagaactagtggatcccccgggctgcaggaattcgtctcacccctaatcgaaaacatttccctggaacatccagtctccaagactcgaacaaaacggggcagagtcaccctgctgaagaattggatctttcctgagtactattttgctaacatgacgagttaattatcgcagaggaggtacggctgccgcgctatgatgctggaaacggtggctgcggtaccggggatggtgggcggcatgctgcttcacctgcgctcgctccgccgcttcgagcacagcggcggctggatccgggcgctgctggangaaggcganaatgaacgcatgcacctcatgaccttcatggaggtggccaaagccaagtggtacgaggcggtcccccccccccccggggaagggggtcttttttaaggcttattcctcgggtaactatctccccccaatttcggaaacgggtccttgggcccctcgggaaagggcctcccccttttatccgaatacctccaggacctgagggcgggaaaaaaaaaaaacccccccccggcgcttttcccccaaaggggggcccccccgttaggccccccccaaggtgtggtttggggggggcccccaaaaggggccccccccggcaaaaaattttttggggagaaaaattttccgggggggccacacaggaaaccacccccccatatttaaatattaaaaaaaaggggcggggcgggcgaggaaaaaaacccctttttttttgttgggggcgaaaaaaaaaaaag

SEQ ID NO: 49992 - protein, 72 aa, Zea mays
  misc_feature: Ceres CLONE 1462059-F
  misc_feature (38)..(38): Xaa is any aa, unknown, or other
  misc_feature (41)..(41): Xaa is any aa, unknown, or other
MMLETVAAVPGMVGGMLLHLRSLRRFEHSGGWIRALLXEGXNERMHLMTFMEVAKAKWYEAVPPPPGEGGLF

SEQ ID NO: 49993 - DNA, 753 bp, Zea mays
  misc_feature: Ceres CLONE 1462061-F
  misc_feature: Translation starting site: 147
  misc_feature (688)..(688): n is a, c, t, g, unknown, or other
  misc_feature (728)..(728): n is a, c, t, g, unknown, or other
aagctggagctccccgcggtggcggccgctctagaactagtggatcccccgggctgcaggaattcgtctcacccctaatcgaaaagttgggtagtagtaaaaccaggtaggtgtggctggctcgtgcagcggcggcagtgagagcgatgagcgcggcggcggcggcgagctcggtcaccaagttcatcaaatgcgtcacggtcggcgatggggccgtcgggaagacctgcatgctcatctgctacacctgcaacaagttccccacggattatatccccaccgtattcgacaacttcagcgccaatgtctccgtgggtgggagcatcgtgaacttgggcctctgggacacggcaggtggggggtgggcgacatcagattgtcaactagtgtttccatctcttctgttttctgccggaaatggttggtttggatgcaggccaggaggattacagcaggttgaggcctctcagctacaggggtgccgatgtgttcatcctctccttctccctggtcagcagggcgagctatgagaacgtcctcaagaagtggatgccagagcttcgccgattttcacctactgttcctgtagttcttgttggaacaaactagatctccgtgaagacagatcttaccttgctgaccattctgctgcttccatcatctctactgaacagggagaagagctcangaagcagataggcgctgtggcgtacatagaatgcagctcnaagacacagaggaacgtaaaggctg

SEQ ID NO: 49994 - DNA, 771 bp, Zea mays
  misc_feature: Ceres CLONE 1462066-F
  misc_feature: Encodes the peptide sequence at SEQ ID NO. 49995
  misc_feature (731)..(731): n is a, c, t, g, unknown, or other
atagctggagctcaccgcggtggcggccgctctagaactagtggatcccccgggctgcaggaattcgtctcacccctaatcgaaaaacaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaacacagagccatatgttgtggagcttgatcagcgagaggaccccccacagattcaggatgccttacttgagatagttggcaggcgtactgtccctcaagtttttgtccatggaaagcacctgggtggttctgacgatactgttgactcctacaaaagtggaaaactggctagacttctaaaccatcgagtccaggaccacctttgagtgacatggctacttcgggcagcccggttcctttggtttcaaacccgtaacgggtttcaacaacttcaaaattggttttgtcctctatggaataccgcctaccaccagcctaaaaagctggattttaaccccaagcggaaacagtccaaaccnggccccttgtttttaagttaacccaagggatcttttttgg

SEQ ID NO: 49995 - protein, 135 aa, Zea mays
  misc_feature: Ceres CLONE 1462066-F
  misc_feature (44)..(108): Pfam Name: Glutaredoxin Pfam Description: Glutaredoxin
  misc_feature: SWISSPROT Homolog: EC 1.11.1.15 Peroxiredoxin
MVALLGRRIGVAAAAAAFIALVAFGSASSSPKSFVKSTVSAHDVVIFSKSYCPYCKRAKAVFKELELNTEPYVVELDQREDPPQIQDALLEIVGRRTVPQVFVHGKHLGGSDDTVDSYKSGKLARLLNHRVQDHL

SEQ ID NO: 49996 - DNA, 743 bp, Zea mays
  misc_feature: Ceres CLONE 1462067-F
  misc_feature: Encodes the peptide sequence at SEQ ID NO. 49997
  misc_feature (427)..(427): n is a, c, t, g, unknown, or other
atagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactcccccccccacctgnttgagtactatgctaagctgaggagctgcattcacatcatgtggtggagcgcgagggaggcttctttatcggacagcctcacttgtcaccgacgcaatcaggcacccccccaagccgtggactacgctgggtttggctttggcatgagaacgaccgctgttgttgtcataagtcatatcctaactagagaaacaggtagctttataatcacaatgtatcaccctcctaccaaactatggatgcgtcttgtacataggccggaaaaaacgcttctaaaaaaaaaaaaaaaaacgagaccctcgagggacccaatttc

SEQ ID NO: 49997 - protein, 73 aa, Zea mays; identical to SEQ ID NO: 46194
  misc_feature: Ceres CLONE 1462067-F

SEQ ID NO: 49998 - DNA, 811 bp, Zea mays
  misc_feature: Ceres CLONE 1462069-F
  misc_feature: Translation starting site: 116
  misc_feature (415)..(415): n is a, c, t, g, unknown, or other
aaagctggagctccccgcggtggcggccgctctagaactagtggatcccccgggctgcaggaattcgtctcacccctaatcgaaaaacttcacgcgcaggccgcggactagcgccatggcgacgtgccggtgccccgagccggcgcaatgccatcacaggccgctcctctcgacggccaagggctaccctaagctgcacgaccgcccgaggccggcgcccggcagcgtcctcgccgaggtggccgccatcctctgcctcaccgggccaatggtcggcgcggggatcctgttctacatgcgctccctggtgtccatgggtgttcctcggccgcctcggccagctgcccctcgccggaggctccctcgtgttcggcttcgccaacatcaccgggtattccgtccttctaaggaccancctgtcccaccgaatttggttttgccccctagcctttccgccccgggggcgaacggaacctcctcccgcaaccgggttccgggcgccaccgttattgcttggtccttgggccgcgtcccgtgcccattcgccaatggttctggggggggccatggcaccgggggcctccttcccccgcggggcaagacaccctaaaatttgcggccccggcgaaagccaaaaatccccttgctgcccccccccaaactcctgggagagaaaggtttccccccacccgatacccaaatttccttggcgcggcaaaacccgcacacactttcccccataccacaaaggcgcccccgcccccgcctgttctctccccggggcccataaaatttcctcccctgacagggt

SEQ ID NO: 49999 - DNA, 786 bp, Zea mays
  misc_feature: Ceres CLONE 1462072-F
  misc_feature: Encodes the peptide sequence at SEQ ID NO. 50000
  misc_feature (378)..(378): n is a, c, t, g, unknown, or other
  misc_feature (380)..(380): n is a, c, t, g, unknown, or other
  misc_feature (382)..(382): n is a, c, t, g, unknown, or other
  misc_feature (383)..(383): n is a, c, t, g, unknown, or other
atagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcangncnngcgcctgaactatgaatgtatgagtcactccaaacctaaactgtttgagtactatgctaagctgaggagctgcattcacatcatgtggtggagcgcgagggaggcttctttatcggacagcctcacttgtcaccgacgcaatcaggcacccccccaagccgtggactaccgctgggtttgggctttggcatgagaaccacccgctgtgtttgtcataagccctatcctaactagaaaaaccaagtagcttttataatcccaatgtatccaccatccttaccaaaactaatggatgcgtctttggtacataaggccgcgaataaagccccttcctaaaaaaaaaaaaaaaaacaaccaagccccctccgaaggacaccaaattcgcccctataaaggggagccc

SEQ ID NO: 50000 - protein, 73 aa, Zea mays; identical to SEQ ID NO: 46194
  misc_feature: Ceres CLONE 1462072-F

SEQ ID NO: 50001 - DNA, 766 bp, Zea mays
  misc_feature: Ceres CLONE 1462077-F
  misc_feature: Encodes the peptide sequence at SEQ ID NO. 50002
aaagctggagctccccgcggtggcggccgctctagaactagtggatcccccgggctgcaggaattcgtctcacccctaatcgaaaaatcccggggcacgaaaccctaactgaacccatggcgctctccgccgctcgccggctctccaccaccgcgtcctcctcctccgtcgccgacgcgccgccaaagctctcttcgctggtccagaacccgaagcctcgaccgctgcctgtccgcggcgtcaaggagccgcggcggggggccagggccaggccgaggcagccctgggaggaggaggcgggggcgctgctgctgcggctccacaaggggaggtacctcccgggccccgacctctcgtcggcgccgcacgctgtctcacccgacgccgtcaagaccgccgccgagtggttcgggcatgaccaccagcccgacgcctaatggctgtcaaggagtgatttgcagaagcttgccttgattgcgtgtcccactgctgagcgaagaacggttattgcatcacaacgattaagagccttcttcaacatccatgaagaacaaatatgctgttcctgtaaactgagaagctcgtgcgagtttgtgaaccaggaagtggcccagcataatagagtgattctatcagatacggtgagactatcctcctagttgtactggacgcttgcccacaagagctcgagattaccgctaagtaaaaagcagtgtctgcaagctgctaaaggacgccttaaatctcagcagtgtactgctgagcg

SEQ ID NO: 50002 - protein, 106 aa, Zea mays
  misc_feature: Ceres CLONE 1462077-F
MALSAARRLSTTASSSSVADAPPKLSSLVQNPKPRPLPVRGVKEPRRGARARPRQPWEEEAGALLLRLHKGRYLPGPDLSSAPHAVSPDAVKTAAEWFGHDHQPDA

SEQ ID NO: 50003 - DNA, 764 bp, Zea mays
  misc_feature: Ceres CLONE 1462080-F
  misc_feature: Encodes the peptide sequence at SEQ ID NO. 50004
  misc_feature (655)..(655): n is a, c, t, g, unknown, or other
  misc_feature (668)..(668): n is a, c, t, g, unknown, or other
ctggagctccccgcggtggcggccgctctagaactagtggatcccccgggctgcaggaattcgtctcacccctaatcgaaaaaccgatttgcagacccatggtgctgacgaagaatgcactccgcattctctacaaatagcttggcaccttgacacctagcttcacctccctcctcctggcccagtcgtcctagccatcaaaattcagttgagggttcttcagttcagccatgaagcttgagatgacagcagcggccatggtcttgatcctgctgacctcgggcgccgaggccaaggtctgctactcgcggagcaggaccttcaaggggtggtgctaccacagcatcaactgcatcgccatctgcatcaccgagggcgacaccagcgggttctgccaggccggggcctgcatgtgcacttatgagtgtctcaatggtgtcgtcgccggtggcggcggtggcggcggacagcatccatcggttggctcatcgcgtggtggtggtgctgaggctaaagcagccgtcccatcagtatagagcttctgattctggcggggtgatggcagatggtgcactactactcttccgtgcacatgctaactcaaggttccgaggtgatgaataacacaaatggttcctttaactaatgtgttttntttcccctacccnaatacaaaaaaaaaaaaaaacgagacgctcgagggacccaattcccccttatagtgagtcgattacgcgcgctcactggccgtcggttttaaacgt

SEQ ID NO: 50004 - protein, 101 aa, Zea mays; identical to SEQ ID NO: 42029
  misc_feature: Ceres CLONE 1462080-F
  misc_feature (22)..(66): Pfam Name: Gamma-thionin Pfam Description: Gamma-thionin family

SEQ ID NO: 50005 - DNA, 754 bp, Zea mays
  misc_feature: Ceres CLONE 1462081-F
  misc_feature: Translation starting site: 190
  misc_feature (373)..(373): n is a, c, t, g, unknown, or other
  misc_feature (666)..(666): n is a, c, t, g, unknown, or other
atagctggagctccccgcggtggcggccgctctagaactagtggatcccccgggctgcaggaattcgtctcacccctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgntggtgctgccggggctggcgctgacggcctccgtggtggggctggccgtggccacgccggtgttcctgatcttcagccccgtgctggtccccgccgcgctgctcatcgggacggccgtcatggggttcctcacgtcgggcgcgctggggctcgggggcctgtcctcgctcacgtgcctcgccaacacggcgcggcaggcgttccagcgcaccccggactacgtggaggaagcgcaccgcaggatggcggaagccccggcgcacgcgggccacaagaccgcgcaggcaagccangccatccaaggcaggtcgcaagaagccgggccccggggaagtgcaaggtgccggccctgccggcggcggcagggcttcctcgtagcca

SEQ ID NO: 50006 - DNA, 768 bp, Zea mays
  misc_feature: Ceres CLONE 1462083-F
  misc_feature: Encodes the peptide sequence at SEQ ID NO. 50007
  misc_feature (434)..(434): n is a, c, t, g, unknown, or other
  misc_feature (439)..(439): n is a, c, t, g, unknown, or other
atagctggagctccccgcggtggcggccgctctagaactagtggatcccccgggctgcaggaattcgtctcacccctaatcgaaaactctctcactttaaaagcatcctctccgccgcggcgcaacggccacaccttccgtcccccggcctccgctcgcctgtccctctctctctctctcctcgctgagtcgccgccagccatgaacaacctcctcacggattcctttgagctcccccggcgggactcctcaagagatgcagacattgaaatgcgaatgcatcaagctgatgcttcagacaacttacaagatttcttgaagaacgggtcgatgcattgacagttcaatgcaaagctgacaaatctagttgcatagctacagactgcaaatgaggaatcccaaagcagggacaaaacccacgtccatgaaagcanttaancttcggatggagaaagatcctgattaaattggggaaaaatcgctcctccggcaaaaaccaaagttgaggaattggaaaaagacaacttttccaaatggcaaaaccctggttttgaaaaggttctgccttggaacctcccaaaaaccaactcttggagcggggaaaaaaatttgagggggcggaggggtgcctttcacccctggaaaaacccccccgccaaatttccgggggttttaaaaaaagggtttttccgaaatggaaccccccccgaaaaaaaaatttttttttttttaaccccccaaaaagggctttttttttttgtttttttt

SEQ ID NO: 50007 - protein, 45 aa, Zea mays
  misc_feature: Ceres CLONE 1462083-F
MNNLLTDSFELPRRDSSRDADIEMRMHQADASDNLQDFLKNGSMH

SEQ ID NO: 50008 - DNA, 803 bp, Zea mays
  misc_feature: Ceres CLONE 1462087-F
  misc_feature: Encodes the peptide sequence at SEQ ID NO. 50009
  misc_feature (384)..(384): n is a, c, t, g, unknown, or other
  misc_feature (757)..(757): n is a, c, t, g, unknown, or other
  misc_feature (758)..(758): n is a, c, t, g, unknown, or other
atagctggagctccccgcggtggcggccgctctagaactagtggatcccccgggctgcaggaattcgtctcacccctaatcgaaaaatagtattacacaaccagcaaggccgcccgcttgccggcaacatgaagaagatcttcggcgccaagaagaacaaggatccgccgcccacaatccaggacgcaaccgacagaatcaccaagcgcggcgacaccgtcgatgaaaagatcaagaagctcgacgccgagctcgcgcgctacaaggagcagatcaagaagacgcgcccaggccccgctcaggaggccgtcaaggcacgagccatgagggtcctcaagcagcgcaggatgtacgaagggcagcgtgacatgctctacaccaaancatatacctttgacccagtgctttttgcgcaaacggacttaaagatgctcagcaaactatgactgcgaatgaaagctgccaataaagagctcaaagggatgaatgaaactgtcaagccccaaaaaatttgaaagatgccaaaatgaaaggagggatcttttggatgggaggcccggaaaaacaagaaaccttggggaaaaactcccaccccccaatgacctcctgagagaaaaaattttgggggaatctcattgttttgaaccccaaagggtctttaaataaaaaagggcccctttttccccccacaaaaaaaaaaacggaaattcttttttttgggcgcccaggggggtggggggccccccccaaaaccccnnagggggaaaattttaattttcctcagtcgcccacgtttttttttt

SEQ ID NO: 50009 - protein, 105 aa, Zea mays
  misc_feature: Ceres CLONE 1462087-F
  misc_feature (86)..(86): Xaa is any aa, unknown, or other
MKKIFGAKKNKDPPPTIQDATDRITKRGDTVDEKIKKLDAELARYKEQIKKTRPGPAQEAVKARAMRVLKQRRMYEGQRDMLYTKXYTFDPVLFAQTDLKMLSKL

SEQ ID NO: 50010 - DNA, 751 bp, Zea mays
  misc_feature: Ceres CLONE 1462089-F
  misc_feature: Encodes the peptide sequence at SEQ ID NO. 50011
aaagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaggaacgtacattgtcatttttggaagcttctgaaagcatggcgtgcgcgtgaactatgaatgtatgagtcactccgaagctaaactgtttgagtactatgctaagctgaagaactgcattcacatcatggtgtggaaccccagggagctttcttttcggaacagctccctttgtaccgaagcaataggcacccccccaagccgggaacaaccctggttttgcttttgccatagaaacaccccctttgttttccacaagccttccccaccctaaaaaaaaaaggccttttaaaccccacagttccccccctcccccaaacttggggggcccttttttaaaaagccggaaaaaaccctctttaaaaaaaaaaaaaaaaaaaaacccgcgggggacccattcccccccaaaggggg

SEQ ID NO: 50011 - protein, 73 aa, Zea mays; identical to SEQ ID NO: 46214
  misc_feature: Ceres CLONE 1462089-F

SEQ ID NO: 50012 - DNA, 787 bp, Zea mays
  misc_feature: Ceres CLONE 1462090-F
  misc_feature: Encodes the peptide sequence at SEQ ID NO. 50013
  misc_feature (325)..(325): n is a, c, t, g, unknown, or other
  misc_feature (335)..(335): n is a, c, t, g, unknown, or other
  misc_feature (362)..(362): n is a, c, t, g, unknown, or other
aaagctggagctccccgcggtggcggccgctctagaactagtggatcccccgggctgcaggaattcgtctcacccctaatcgaaaagtttgttccacctgcgcaactgcgacggggataagtacgtcttccagatgacgacggcggcatggccgcggccacgcttcctcgtcctcccccagcctggattcctccgctcggtctgccacggcctctgctcccgctgtctcttctgcttcctgctgctcctcgccttcgcctgcagctccagctccgggcgggtggtggtcactagcttgcctggcttcgacggcgacctccccttnccactcgaancaggggtacgtggagtggaagaggacnccggcgtggagctcttctactacttcgtccaggccgagtccggcgccgcgccccccgccgatgaacaccctttccctcttcgggttcccggggggaaccgttggttccgttttaggggcctccccaagaaaacggcccctcaaatttgtcgggaaccttaaaagggcccttgccggcctgggaaaaaccccacatttggggaaagggggccaaaacccctttccggaatccccggggggggggggtttttcttttgggaaacccccaggggtttaggtgggaaaaactccccccccctgcggccaagaagacccccccaaggggggtggagaactcccccggaggcccccgaatatttttttcttgggggggggcctcttttgtaaaaaaaccgctcccccccccccgaaaaatataaaaaagaa

SEQ ID NO: 50013 - protein, 129 aa, Zea mays
  misc_feature: Ceres CLONE 1462090-F
  misc_feature (64)..(64): Xaa is any aa, unknown, or other
  misc_feature (68)..(68): Xaa is any aa, unknown, or other
  misc_feature (77)..(77): Xaa is any aa, unknown, or other
MTTAAWPRPRFLVLPQPGFLRSVCHGLCSRCLFCFLLLLAFACSSSSGRVVVTSLPGFDGDLPXPLEXGVRGVEEDXGVELFYYFVQAESGAAPPADEHPFPLRVPGGNRWFRFRGLPKKTAPQICREP

SEQ ID NO: 50014 - DNA, 836 bp, Zea mays
  misc_feature: Ceres CLONE 1462093-F
  misc_feature (276)..(276): n is a, c, t, g, unknown, or other
  misc_feature (396)..(396): n is a, c, t, g, unknown, or other
  misc_feature (436)..(436): n is a, c, t, g, unknown, or other
cgggctggagctccccgcggtggcggccgctctagactagtggatcccccgggctgcagggattcgtctcacccctaatcgaaaaagcctttttgttctccccgcgagcgctctctttctctatcgactggcgacgaactccgccaccgccgccgctctacgggagacgcccaggtcttcgccaacgacgagcatccgggttagagaggaagaaattgcaacccaaagaggggccggaagattccggcgctcgcgaaaaaccaagctccccacagnccaaccaactccccccctctacccccgggggcgggagcccccccccccaggctgcccaaccccgccccgtgtgcgcacacactccgtccgaaggtgggtttttttttgtttggtgttttnaccgggggggggggttttttgatatgtgtaaattattctncccgtccgcttgtggggggggggcgcccccccccccccctctttggccgctgcccgccccccccgccgctgtgttcggggtatatcttcagcacgtcgcgcacggctcaccccccccacccgcccccacctggggcgctgtcactcttccacccccgccgcggcggtcgagactgtctctgcccgcctcccccccgcgcgccccgctcccgccccccaccaccccacacccacaccgcacccacccccccccaacacaggccccccctcactcgcccccgcctgccagctccccctccgcactgctctcctgctctctcacatgcccgctccccctcaccgcttcgtcgcccggcggtctctacccgcctcgggctgctctcgctccttgctctcctcgc

SEQ ID NO: 50015 - DNA, 769 bp, Zea mays
  misc_feature: Ceres CLONE 1462096-F
  misc_feature: Encodes the peptide sequence at SEQ ID NO. 50016
  misc_feature (382)..(382): n is a, c, t, g, unknown, or other
  misc_feature (422)..(422): n is a, c, t, g, unknown, or other
aaagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctctttttttcctaagaacgtacattgtcatttttggaaagctttctgaaagcatggcnttgcgcgtgaactatgaatgtatgagtcaccccaaagctnactggtttgagtactatgctaagctgaggagcctgcatccccatccgtggggtgaaccccaagggaaactttttttttgggaaacccctctttgtgcccgagcaaattggggcccccccccaagcggggaaacccccggggtttggttttggcaagaaaacccccccgcggttttccacaaaccctcccgccccaaaaaaacaaatgttttttttacaccctgtgccccccctcccaaaaaattggggggccttttttaaaccggcaagaaaacccctttcaaaaaaaaaaaaaaaaaggcggggggggcgcaccccccccccagagggggaatcaccccccccccc

SEQ ID NO: 50016 - protein, 73 aa, Zea mays; identical to SEQ ID NO: 46214
  misc_feature: Ceres CLONE 1462096-F

SEQ ID NO: 50017 - DNA, 891 bp, Zea mays
  misc_feature: Ceres CLONE 1462102-F
  misc_feature: Translation starting site: 163
  misc_feature (1)..(1): n is a, c, t, g, unknown, or other
  misc_feature (10)..(10): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (55)..(55): n is a, c, t, g, unknown, or other
  misc_feature (198)..(198): n is a, c, t, g, unknown, or other
  misc_feature (320)..(320): n is a, c, t, g, unknown, or other
  misc_feature (421)..(421): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (472)..(472): n is a, c, t, g, unknown, or other
  misc_feature (648)..(648): n is a, c, t, g, unknown, or other
  misc_feature (667)..(667): n is a, c, t, g, unknown, or other
  misc_feature (761)..(761): n is a, c, t, g, unknown, or other
naaaccaccntgggacgctggagctccccnnnntggcnnccnctctataactagnggatcccccgggctgcaggaattcctctcacccctaatcgaaaaaattcacatcgcactctcctccagcctccaggcttggcaagcgtgcttcacatgaccacatccatgtcgaacagcgccgctagcgagaagcaatcccancaggcaggccacaggcagcggcccccggcggcgtcggccgcggacgcggagatgcagagggtgttctgccgcatcgacgcgaacggcaacggccggatctccgcctcggagctggccgcggngacgcccgccatctctcccaccagcaagcgtcctcccacgggccgctgcaaggttttttttttatgatttttttcaccgggggggggggagcccccccccncttccctnnnacttttttcccccccccccgccaaacccacccaaatatggnatacacgccgccccccacaccaataaaccctcaaaccccgcgcggccgcacttaccaaccgcttgacacacctgactactgtcccaatcgcccgccctcacccccacctcggttgacacacccactgcaagccacaccccacgcttgcactctccccccccccccacccttgtgangagccccccccaaggtgtnagcacgacatacccccaccccctctttatcagctcccccccgcccccgcacgtggcgttcccccgcccccacatcatagtatccccagtggctntccacactccccagagccgacacgctatcccaaccaacacgaccccaacgttgactcatccacccacaatcgttgctcactaccaccccactctcacgctgcgctgctccaccctctgggcccctcccaa

SEQ ID NO: 50018 - DNA, 750 bp, Zea mays
  misc_feature: Ceres CLONE 1462103-F
  misc_feature: Encodes the peptide sequence at SEQ ID NO. 50019
  misc_feature (440)..(440): n is a, c, t, g, unknown, or other
  misc_feature (474)..(474): n is a, c, t, g, unknown, or other
  misc_feature (523)..(523): n is a, c, t, g, unknown, or other
aaagctggagctccccgcggtggcggccgctctataactagtggatcccccgggctgcaggaattcgtctcacccctaatcgaaaaattcccaacttcagctgcgcctcgactcgtagcccgaaccctagccaccaagccggaggcgagagagcagccatggcgcggtgcctcgcgctcgtcgccctcctcgtactcggcctcgccgccgccgcctccgcggccgacgcgcccttcgtcgtcgcgcacaagaaaatttcgctctcccgccccaagccgggcgtcgagcgcgtcgctgtctccctcgacctctacaaccagggatccgcgactgcctatgatgtgtccattaatgacgactcttggccaacagaagtgtttgagcttgtcactggagagaaatcgaagacattggaaaggcttgaccctggtgccactgcntcacacacatatgtcctggagaacaaacacaggncagggttcagggttccacagctatcattacataccgggtttcaaacaangacaggctctcaggaggaataatcaaatccccatcttccaatggaaaattcccgctgaaagaccccaaaaaaaaaaatttgaatgggctaaaaggctttggaaagaaaaaccgggcacctggggcccgggggccccctccgggggagggttttctacccttggcccgagccccctaaaaaaccttcaaaggggcaaaaaaaaaaacccctttctcctttttgggggc

SEQ ID NO: 50019 - protein, 128 aa, Zea mays
  misc_feature: Ceres CLONE 1462103-F
  misc_feature (8)..(127): Pfam Name: TRAP_beta Pfam Description: Translocon-associated protein beta (TRAPB)
  misc_feature (106)..(106): Xaa is any aa, unknown, or other
  misc_feature (122)..(122): Xaa is any aa, unknown, or other
MARCLALVALLVLGLAAAASAADAPFVVAHKKISLSRPKPGVERVAVSLDLYNQGSATAYDVSINDDSWPTEVFELVTGEKSKTLERLDPGATASHTYVLENKHRXGFRVPQLSLHTGFQTXTGSQEE

SEQ ID NO: 50020 - DNA, 760 bp, Zea mays
  misc_feature: Ceres CLONE 1462105-F
  misc_feature: Encodes the peptide sequence at SEQ ID NO. 50021
aagctggagctccccgcggtggcggccgctctagaactagtggatcccccgggctgcaggaattcgtctcacccctaatcgaaaactcagtcctccctcacacaccgaaccgagcgcaccatgtcgtcggcggctggaggagtggaggagacggtgcgggcgtcgcacatcctcatcaagcacgagggttcccgccgcaaggcctcctggaaggaccctgacggccgcatcatctccgccaccacgcgcggcgacgccgcagcgcgcctcctggacctccgcaaccagattctctccggccaggccaacttcgccgacctcgccgctcggcactccgactgctcgtccgcgcgacgcggtggggacttaggtacctttgggaggaggcagatgcagaaacccttcgaggacgccacatatgccctcaaagttggtgagctcagcgacatcgtggacactgacagtggggttcacatcatcctgcggactgcctgaggaggggatcacactgtcctctcaggctttcagttagtgcttatggcgttctgttagaacctgtatttgtattcctgctgggagcctgagttccattccgtgcaaagattaatcatgtgtgacaacacgtttcgcacaccatttatgcttaaactgccattaatgatgatgccttgacctccctgaatgcccagtttttctgggcgccaaaaaaaaaaaaaaaacgagacgctccaggtacccaattcccccctataggggatcc

SEQ ID NO: 50021 - protein, 124 aa, Zea mays
  misc_feature: Ceres CLONE 1462105-F
  misc_feature (16)..(124): Pfam Name: Rotamase Pfam Description: PPIC-type PPIASE domain
  misc_feature: SWISSPROT Homolog: EC 5.2.1.8 Peptidylprolyl isomerase
MSSAAGGVEETVRASHILIKHEGSRRKASWKDPDGRIISATTRGDAAARLLDLRNQILSGQANFADLAARHSDCSSARRGGDLGTFGRRQMQKPFEDATYALKVGELSDIVDTDSGVHIILRTA

SEQ ID NO: 50022 - DNA, 754 bp, Zea mays
  misc_feature: Ceres CLONE 1462107-F
  misc_feature: Encodes the peptide sequence at SEQ ID NO. 50023
  misc_feature (605)..(605): n is a, c, t, g, unknown, or other
  misc_feature (612)..(612): n is a, c, t, g, unknown, or other
  misc_feature (672)..(672): n is a, c, t, g, unknown, or other
  misc_feature (722)..(722): n is a, c, t, g, unknown, or other
  misc_feature (749)..(749): n is a, c, t, g, unknown, or other
aaagctggagctccccgcggtggcggccgctctagaactagtggatcccccgggctgcaggaattcgtctcacccctaatcgaaaagagaatcgaggattattatcgaataacagaacaccacttacctggtattcatgcgtcgaccatcaccggcgacggcgtatctccgtgctcacgtcccggcgtcccgagccggcggccacgggccataacagacccggaggacatcaccagcgcgagcgccgccagccccaagcaccgaggccgagccgcccgagcgcggagcggcggtaccacgccacccgcccgccgccgcccgttgcggaggctgtgcagcacagccgttggggtgccgaggcaccgatcaggctgcgcaaccgccgaagtcggcctccgggtggcgccaagctgcagagcagcgcgccagcgcccctgtatcggactacctttttcggcgagaccaccctagtagaggatgatatacaccgcgattgacacgttctacctgacggaggagcagctgcgcaactcaccatcacggaaggatgggatcgacgaagccactgagactgtgctccgcgtctatggctgcgacctcatccnagagagncgcatcctcctcaggctaccacaagcagtgatggcccacgcacaagtatttgtccatcgnctttactgcaaaaatcatttgttcgatttagtgcaaagagagtgctgctnagtgtgtttggctggcaggaaagttgnaagaa

SEQ ID NO: 50023 - protein, 92 aa, Zea mays
  misc_feature: Ceres CLONE 1462107-F
  misc_feature (43)..(43): Xaa is any aa, unknown, or other
  misc_feature (45)..(45): Xaa is any aa, unknown, or other
  misc_feature (82)..(82): Xaa is any aa, unknown, or other
  misc_feature (91)..(91): Xaa is any aa, unknown, or other
MIYTAIDTFYLTEEQLRNSPSRKDGIDEATETVLRVYGCDLIXEXRILLRLPQAVMAHAQVFVHRLYCKNHLFDLVQRECCXVCLAGRKVXR

SEQ ID NO: 50024 - DNA, 743 bp, Zea mays
  misc_feature: Ceres CLONE 1462108-F
  misc_feature: Encodes the peptide sequence at SEQ ID NO. 50025
  misc_feature (535)..(535): n is a, c, t, g, unknown, or other
  misc_feature (564)..(564): n is a, c, t, g, unknown, or other
  misc_feature (650)..(650): n is a, c, t, g, unknown, or other
aagctggagctccccgcggtggcggccgctctagaactagtggatcccccgggctgcaggaattcgtctcacccctaatcgaaaacttccaccacgcagtcactcccgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaacctagtgatcatcgctaacaactgcccgccccttcgtaagtctgaaattgagtactatgctatgctggccaaggtcactgtccaccacttccatggaaacaacgcccaccttggaactgcctgtggtaaatactttcgggtctgctgcctcagcattattgatcctggtgattctgatatcatcaagactacaccgggtgagcagtaaagaagcccctgcagtangggggatctactgccatttgtcttctggnctgtaaacagcatttacctgctagtaaactgagttatccggaaccattgtcctgaattgaatttttggctcggtgttttgaccctnaaaaaaagctttagcttataccgttgttcagtcccaactgttttttgtcactttcaaaccgtaaaacgaatggccccccgggggaggatcccc

SEQ ID NO: 50025 - protein, 112 aa, Zea mays
  misc_feature: Ceres CLONE 1462108-F
  misc_feature (12)..(106): Pfam Name: Ribosomal_L7Ae Pfam Description: Ribosomal protein L7Ae/L30e/S12e/Gadd45 family
MVATKKTKKSTDNINNKLQLVMKSGKYTLGYKTVLRTLRNSKSNLVIIANNCPPLRKSEIEYYAMLAKVTVHHFHGNNAHLGTACGKYFRVCCLSIIDPGDSDIIKTTPGEQ

SEQ ID NO: 50026 - DNA, 762 bp, Zea mays
  misc_feature: Ceres CLONE 1462111-F
  misc_feature: Encodes the peptide sequence at SEQ ID NO. 50027
aaagctggagctccccgcggtggcggccgctctagaactagtggatcccccgggctgcaggaattcgtctcacccctaatcgaaaactgttagatatccaaccgtacgtaaactagtcacaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagtttaaaaaaaattcccccccccccgcagcttgatcaaccgaaaggatggctcaaaaattcaggatgcctttccttaaaaaagttgggaggggtactggcccctcagttttttgcccaggaaaaccacctgggggggtctgaaaaaacttgttaacccctaccaaaagggaaaaacgggttaaattttaaaacctcgaaacaaggaccaaccttttagggacaaggctaccccggcccccctgttttttggttttcaaccaaccgggttccaaacattctaatatgtttttccccccggggaaccccccccaccccccaaaaagcttttttttccccagagaaaaaccaaaaaaacttctttt

SEQ ID NO: 50027 - protein, 76 aa, Zea mays
  misc_feature: Ceres CLONE 1462111-F
MVALLGRRIGVAAAAAAFIALVAFGSASSSPKSFVKSTVSAHDVVIFSKSYCPYCKRAKAVFKELEFKKNSPPPAA

SEQ ID NO: 50028 - DNA, 754 bp, Zea mays
  misc_feature: Ceres CLONE 1462112-F
  misc_feature (435)..(435): n is a, c, t, g, unknown, or other
aaagtggagctccccgcggtggcggccgctctattctagtggatcccccgggctgcaggaattcgtctcacccctaatcgaaaagttccgactctggagcggagcggcagccaaatctcgaccacgtccggcaaccgcgccccctcggctttgcgcccacaccaagccaccctctgttctcctcttccgtggcggactagcggcgcactggtgtggtgctcctccaagctctggtctgctccgcgccccgcctccccgtcgaccggcgactttggccccggcccccgggctaggaagcgagttcaccggtggatccgcgcgtgtccctccctgttacctgcgggtcgccccagccggccacccgtgtttctgtaccctactgacttgggcttgctgtatagcacggaccaaatttccccccccccccccaccacntttgaggcttggccatgcctttaaatatagatattgaacttgttcaagctggaaattgatgagcctgatggctgattattccaagggagaactgtaatcactccttccaaatccaacgaagtagggatgggcaacaaattttctttattctgtgacagccaaactaagaacaactcgggtttattccagggagtccctccttcctgcattggaatgggtcctttgcactcctcaaagtttacctgcaccaaagattggctgggctattctgccctatactgtctgaacggagaggccacccaaaaaacccccactccca

SEQ ID NO: 50029 - DNA, 750 bp, Zea mays
  misc_feature: Ceres CLONE 1462113-F
  misc_feature: Encodes the peptide sequence at SEQ ID NO. 50030
aagctggagctccccgcggtggcggccgctctagaactagtggatcccccgggctgcaggaattcgcacgagaccattacctagaacatcctaatcgaaaaaatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgcccttcggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtggaggcgaagcaggcgctctactcgagggacctcgctcgcaacctgcgcttcgcctccaacttcgacctcttcaaggctgctgcggccgactggcgcgacacgctcttctgcgaggtggctccgaacccgccgccgcgggaggagctgccggagccactcaggaacgtgatgctggagtacggcgcggcggtgacaaagctggcgcgttcgtgttcgagctgctgtcc

SEQ ID NO: 50030 - protein, 201 aa, Zea mays
  misc_feature: Ceres CLONE 1462113-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPFGAAIPVVDLSVTRREDLVEQVRHAAGTVGFFWLVNHGVPEELMGGMLRGVRQFNEGPVEAKQALYSRDLARNLRFASNFDLFKAAAADWRDTLFCEVAPNPPPREELPEPLRNVMLEYGAAVTKLARSCSSCC

SEQ ID NO: 50031 - DNA, 727 bp, Zea mays
  misc_feature: Ceres CLONE 1462114-F
  misc_feature: Encodes the peptide sequence at SEQ ID NO. 50032
ctggagctccccgcggtggcggccgctctagaactagtggatcccccgggctgcaggaattcgcacgagaccattacctagaacatcctaatcgaaaaaggatttcagccattcaggagggccaccgtacgcagcgagaccagccagcaggcggcgatgttcgcgacggcggtgcggtgggcggccaagaaggggaagcccaagatggcgccgatcgagctgacggcgccgccggagcaggcgcagtccatcacgcgcgccatcttcgacgccgtccgggagcacggcccgctcaccgtctccgacgtctgggaccacgtcaaggatgtcgggcttcgaggtctggcaagcaagaggcagatgaagatcatgctgcggtggatgagggagcgccagaagctaaagctcatctgcgaccacgacggcccgcacaagcagttcctctacaccacctggtttaccaaccccaggaacgcgccgcagaggcccaatccgaagccccatgtcaaagcggataagctccccaccttccttccccttccaagcaactgtgacgagaatttgtttctgtgctctctggacttggttctgctgcccccactaatgttccccatccaaacaaatgctagatttgttcaggccaatttaggcttgttatggcttatttggtcctttgccaaaccctaatttgttggccttgcctatttgaacccttatatcttgggat

SEQ ID NO: 50032 - protein, 176 aa, Zea mays
  misc_feature: Ceres CLONE 1462114-F
MFATAVRWAAKKGKPKMAPIELTAPPEQAQSITRAIFDAVREHGPLTVSDVWDHVKDVGLRGLASKRQMKIMLRWMRERQKLKLICDHDGPHKQFLYTTWFTNPRNAPQRPNPKPHVKADKLPTFLPLPSNCDENLFLCSLDLVLLPPLMFPIQTNARFVQANLGLLWLIWSFAKP

SEQ ID NO: 50033 - DNA, 751 bp, Zea mays
  misc_feature: Ceres CLONE 1462115-F
  misc_feature: Encodes the peptide sequence at SEQ ID NO. 50034
  misc_feature (443)..(443): n is a, c, t, g, unknown, or other
  misc_feature (466)..(466): n is a, c, t, g, unknown, or other
aagctggagctccccgcggtggcggccgctctagaactagtggatcccccgggctgcaggaattcgcacgagaccattacctagaacatcctaatcgaaaaccacaagcttcagctagccttcttactcccgccgtcacccccgatccgagagcgagcatggcgcactctctcgccgcctccttctcgccggccgccgcccggcgccaggtcacaaatgtgattccaagctggacctcggtttccttccagagccacaggatgacttctgtatccatccgctcaagacaaaggtctcttgggtttaagatttgctgttcggctaagaaagagacagtggacaaggtttgcagtatagtgaaggagcagctggctcttcccgatgggaccgccatcactgccgaatcaaaattcgctgaacttggcgctgattcgctggatacngtcgagattgtgatgggcctcgnagaggcgttcaacataacagtcgacaaaccaagcgcacaggactccccaccgtgcagggacgctgcggactttatcaagagcctcagcttgaggccccttccaaaggccgccaaattccacaacctttggaatccacaaacctggggttaaacccaagggggggggagaaattgggcccgggcgccccactttgtccttctcttgaaatccaaaaaaaggttttttatatgggggtctcccaagggaaaataaaaaacccccaagggcccaaagaaaaaaagaga

SEQ ID NO: 50034 - protein, 152 aa, Zea mays
  misc_feature: Ceres CLONE 1462115-F
  misc_feature (61)..(128): Pfam Name: PP-binding Pfam Description: Phosphopantetheine attachment site
  misc_feature (103)..(103): Xaa is any aa, unknown, or other
MAHSLAASFSPAAARRQVTNVIPSWTSVSFQSHRMTSVSIRSRQRSLGFKICCSAKKETVDKVCSIVKEQLALPDGTAITAESKFAELGADSLDTVEIVMGLXEAFNITVDKPSAQDSPPCRDAADFIKSLSLRPLPKAAKFHNLWNPQTWG

SEQ ID NO: 50035 - DNA, 768 bp, Zea mays
  misc_feature: Ceres CLONE 1462117-F
  misc_feature: Encodes the peptide sequence at SEQ ID NO. 50036
aaagctggagctccccgcggtggcggccgctctagaactagtggatcccccgggctgcaggaattcgcacgagaccattacctagaacatcctaatcgaaaacagtcaaacatcagtagagggcgatggtattaatgcaaagccagagatttcaatgcaggagtcagctggtgacccagagcgtgaagcatcttgccccagactcttgggtggaaccgacagtataggactaagctctttgctcactgacagcctggatgcgttccagaaattctctgttttctgaagctcagaaatccataaagaacgacgggcttatacaatatgaactaagcggaggtatatattaaccaggtttctgtttcgtgaacagaactaattgttttgggcttcctaagttatttctgtagataaaactccccatatctgtattgtgaagttttttattatctctagtttactactccatctgttcttttttatttatcgcggtttagtttaaaaatgtactagctgacgacaaatattcgagaacggaggtagtactagaaagaaatatgtattctgaagttgaaatttctttcgctttatcttaaggtagcaagtgcctagcctatagggaggctctgccaactgggctgtcacccagttatatttgtcattgcatcttgctgttaagtgaacattttgtctttggaacattgatcggctgtggtattatagtgcaataacagcggtaatctggccgttttgctgtaaaaaaaaaaa

SEQ ID NO: 50036 - protein, 43 aa, Zea mays
  misc_feature: Ceres CLONE 1462117-F
MQESAGDPEREASCPRLLGGTDSIGLSSLLTDSLDAFQKFSVF

SEQ ID NO: 50037 - DNA, 765 bp, Zea mays
  misc_feature: Ceres CLONE 1462121-F
  misc_feature: Encodes the peptide sequence at SEQ ID NO. 50038
  misc_feature (575)..(575): n is a, c, t, g, unknown, or other
ggagctccccgcggtggcggccgctctagaactagtggatcccccgggctgcaggaattcgcacgagaccattacctagaacatgctaatcgaaaacagaagctagaagcctagagcagccaagaaaagcacatacccgagtcgccgaaacaacaacaatcccaatcccccctcgtcactcaaaactcgaccaacaatgtcgctgattcgccgtggaagcgcattcgaccccttctcccttgacctctgggaccccttccagggctttcccttcggctctggaagcagcagcagcagcagcctgttcccctcgttcggaggcaccaccagctctgagacggccgccttcgccggcgctcgcgtcaactggaaggagacgccggaggcgcacgtgttcaagacccacacgccggggctgaagaacgaggaggtgaaggtggagctggaggacggcaacgtgctccagatcagcggcgagcgcagcaaggagcatgaggagaagacggacacctggcaccgcgtggagcgcagcagcggcaagttcctgcgcaggttccgcctgccggagaacgccnggacggagcagatcagtgcgtccaggggagacggcgtgctcaccgtcaccgtgcctaaggaggagccgagaacggcgacgtcaagtctatcccgaatttccggctagtaggctcaaactcacaaaccaaggatgttgcgtcttacaactgtggtgaacccaaccggtagttctaaacatggccgttgccc

SEQ ID NO: 50038 - protein, 161 aa, Zea mays
  misc_feature: Ceres CLONE 1462121-F
  misc_feature (57)..(162): Pfam Name: HSP20 Pfam Description: Hsp20/alpha crystallin family
  misc_feature (127)..(127): Xaa is any aa, unknown, or other
MSLIRRGSAFDPFSLDLWDPFQGFPFGSGSSSSSSLFPSFGGTTSSETAAFAGARVNWKETPEAHVFKTHTPGLKNEEVKVELEDGNVLQISGERSKEHEEKTDTWHRVERSSGKFLRRFRLPENAXTEQISASRGDGVLTVTVPKEEPRTATSSLSRISG

SEQ ID NO: 50039 - DNA, 716 bp, Zea mays
  misc_feature: Ceres CLONE 1462125-F
  misc_feature: Encodes the peptide sequence at SEQ ID NO. 50040
aagctggagctccccgcggtggcggccgctctagaactagtggatcccccgggctgcaggaattcgcacgagaccattacctagaacatcctaatcaaattgcttgctttgatggaagggaggggtcattatctgatatacagaggcagactagtgcaaacgtgcagatattaccaagagaagatcttccgtcatgcgctttagagtctgatgaactcatacagattgttggagagattaaagctgctcggaatgctctgatacaagtaacaacaaaattaaggagttttctataccgtgagatacctgatcctattcaagttggcaatatcaatttacatggagccatttctccagtagcaggctcacctcgaggaccataccaaggaaatgatatcccaatgggtgcttatcaccaagcatcgcaactggcaacttcatggcattcaaaggatagtggaggcagtgcaagtggatcatttgagcaaggcagcaacattaatgatgatataaggcaaagtgctacaaaaagatttgccgttcctctagtgactagaagcacactagaaattgtcataccaaacagtgctgttgcaagcctcaccatgagagctggtagcaagcttatcgataccgtcgacctcgagggggggcccggtacccaattcgccctatagtgagtcgtattacgcgcgctcactggccgtcgttttaca

SEQ ID NO: 50040 - protein, 224 aa, Zea mays
  misc_feature: Ceres CLONE 1462125-F
AGAPRGGGRSRTSGSPGLQEFARDHYLEHPNQIACFDGREGSLSDIQRQTSANVQILPREDLPSCALESDELIQIVGEIKAARNALIQVTTKLRSFLYREIPDPIQVGNINLHGAISPVAGSPRGPYQGNDIPMGAYHQASQLATSWHSKDSGGSASGSFEQGSNINDDIRQSATKRFAVPLVTRSTLEIVIPNSAVASLTMRAGSKLIDTVDLEGGPGTQFAL

SEQ ID NO: 50041 - DNA, 757 bp, Zea mays
  misc_feature: Ceres CLONE 1462130-F
  misc_feature: Encodes the peptide sequence at SEQ ID NO. 50042
  misc_feature (630)..(630): n is a, c, t, g, unknown, or other
ggagctccccgcggtggcggccgctctagaactagtggatcccccgggctgcaggaattcgcacgagaccattacctagaacatcctaatcgaaaagacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgggggcacggcgctgcgccgcgcccgcagcgtcacggacgacaacctcgacgagctccgcggctgcatcgacctgggcttccccctccagccggcgcacgccgccgcgtgcgtctgcgcctgcgcctgcgccgggaggaaccgcctcctggagacgctgcccgcgctcgacctctactacgccgtccacggcggggcggcggaggcgcccccgtgctcgtgcggcgccgcgtcggaagcgtcctcgtccgaagagtcgccgctcggcagccccatgtccatactctctccaggcgacacgccngagacggtgaagaagccgcttgagcatggggcgcaagtggttgcgcttgtcattgttgagccgccactggaactctccggggcccggccgccccctcccttgttccatttgggaagaaaaaagaaaa

SEQ ID NO: 50042 - protein, 191 aa, Zea mays
  misc_feature: Ceres CLONE 1462130-F
  misc_feature (21)..(138): Pfam Name: DUF1685 Pfam Description: Protein of unknown function (DUF1685)
MEKAGQQRHVIGGGGKKAPALGLQKQNSWSPDIERDEAWERRRRGMRRGGTALRRARSVTDDNLDELRGCIDLGFPLQPAHAAACVCACACAGRNRLLETLPALDLYYAVHGGAAEAPPCSCGAASEASSSEESPLGSPMSILSPGDTPETVKKPLEHGAQVVALVIVEPPLELSGARPPPPLFHLGRKKK

SEQ ID NO: 50043 - DNA, 797 bp, Zea mays
  misc_feature: Ceres CLONE 1462132-F
  misc_feature: Encodes the peptide sequence at SEQ ID NO. 50044
  misc_feature (398)..(398): n is a, c, t, g, unknown, or other
  misc_feature (400)..(400): n is a, c, t, g, unknown, or other
  misc_feature (419)..(419): n is a, c, t, g, unknown, or other
  misc_feature (420)..(420): n is a, c, t, g, unknown, or other
  misc_feature (425)..(425): n is a, c, t, g, unknown, or other
ggagctccccgcggtggcggccgctctataactagtggatcccccgggctgcaggaattcgcacgagaccattacctagaacatcctaatcgaaaaagccccgaaaccccgttcgttgcgtagccaaatcgagatctccgtctcccccgtgacgaatcccacgcccacctctccccgacccggctggccgcagcaacagcgcatcgcaccgggaggcgggagccgaagaaccaaacaggagatggcgtcggcgctgtcctccctgcgctacggcgacagcctctcggtggtgggcatctccgccgcgacggccgtgctctgcgaggccatctcctggcttctcatctaccgcaccgccacttatgactccctccgcgcctccatcgaacgccactcangnaagttgcaacccacccaannccggntccaacttctccggcgctgcctcctccctccgcgcaggccgcgtcgtcgcgggctaaaaaaaatgacccgcgtcaagaacagcctcaaggaccccccgcgggaactttcgtttgccaactcaagtcgggggccgtctctccccccggggcctcttcgacggcttggggctggtaaaatccctcctctaagaggcccccccgttccaaaattgcctttttgcgcctttcccgtttgccacgggaaaaaaacccctcggaatagcccgggaaaaaaactcccccaagggggctcggggtcttcctcttaatctcccttgctccagagaaattcctaaaaccccccccaaaaaaaagtgtgtggttttccccccg

SEQ ID NO: 50044 - protein, 163 aa, Zea mays
  misc_feature: Ceres CLONE 1462132-F
  misc_feature (9)..(163): Pfam Name: DUF841 Pfam Description: Eukaryotic protein of unknown function (DUF841)
  misc_feature (53)..(53): Xaa is any aa, unknown, or other
  misc_feature (60)..(60): Xaa is any aa, unknown, or other
  misc_feature (62)..(62): Xaa is any aa, unknown, or other
MASALSSLRYGDSLSVVGISAATAVLCEAISWLLIYRTATYDSLRASIERHSXKLQPTQXRXQLLRRCLLPPRRPRRRGLKKMTRVKNSLKDPPRELSFANSSRGPSLPPGPLRRLGAGKIPPLRGPPVPKLPFCAFPVCHGKKTPRNSPGKKLPQGGSGSSS

SEQ ID NO: 50045 - DNA, 818 bp, Zea mays
  misc_feature: Ceres CLONE 1462137-F
  misc_feature: Encodes the peptide sequence at SEQ ID NO. 50046
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (422)..(422): n is a, c, t, g, unknown, or other
  misc_feature (436)..(436): n is a, c, t, g, unknown, or other
  misc_feature (458)..(458): n is a, c, t, g, unknown, or other
cattttatcacaaacnnccncccnnnnnnnnnnnnnnnccatactggagctccccgcggtggcggccgctctagtactagtggatcccccgggctgcaggaattcgcacgagaccattacctagaacatcctaatcgaaaagatcgataccaatgggaaaggaactgcctctgccttgcctctataaatacgccgcccgtcgcagaaccgaaaccgcagccgtgacggatccagccgaaccccctcgcagtcgcagccccctcacgccacgcgacatgggcaagatcaggatgcccgtgccgtccctgttccgccgccgctcctccaagccgccgccgccgcagccgcagcagcaggcgcctgccgcgggcgacggcgacggcaacgggtccccggagcgggcgagggcggatgattaaatngcgcgcgtgttccncaagttcgacgagaaaagccanccttccacctcgcggtcggagctggcggcgctgatccaaagcctgggccaacggccgacggacaacaaggtggctcgcatgatggccgaggccgacggcgacggtaacggcttcatcagccctgcccgagttcgcgggccttcaacgccaccgtgggtcggctactcggccgccgttgaggaggacctgcggcacgccttcccggtctttcaccacgaaggcttcggcgccttcttcgccgcgaagatcgggggcggtcctccgcatcttcgggagagccccgccttcgtcccgacagtgccgccccctggatcgagggggaccaacaagagtggggaacgggcttctttctcctgttga

SEQ ID NO: 50046 - protein, 93 aa, Zea mays
  misc_feature: Ceres CLONE 1462137-F
MMAEADGDGNGFISPARVRGPSTPPWVGYSAAVEEDLRHAFPVFHHEGFGAFFAAKIGGGPPHLRESPAFVPTVPPPGSRGTNKSGERASFSC

SEQ ID NO: 50047 - DNA, 748 bp, Zea mays
  misc_feature: Ceres CLONE 1462142-F
  misc_feature: Encodes the peptide sequence at SEQ ID NO. 50048
ggagctccccgcggtggcggccgctctagaactagtggatcccccgggctgcaggaattcgcacgagaccattacctagaacatcctaatcgaaaacaacttggccccaaatcgtggagtggaaaccctactcgtccccttccgcagccggtactcaaccccaaccctatcctgtccgccgccgtcgcccggcgcctcctcccccacctagaaacccagaggctctaatcctagttctttctgtgcagtcgccgcccaattcccccacccaattcccactctccgctcgacagatccatacatgatgggagaggccaaggagaacgacgtttatgaggaggagctcctggactacgaggaggacgacgacaagacggtcgatggctccgctgctaagcccaccggagaggtcgcaaagaagggctacgtcgggatccacagttccggtttcagagacttcctgctcaagccagagctgctccgtgctatccaggattgtggttttgagcatccttccgaagtgcaacacgagtgtatccctcaagccattcttggaatggatgtcatctgtcaagctaaatctgggatggggaaaactgctgtttttgtcctttcatccctccaacaaattgaccctgttgcgggtcaggtagcagcacttgtactgtgccacacaagggaactggcttatcagatatgccacgaatttgagagggtcagcaaatatcttactgaagttaaggttgct

SEQ ID NO: 50048 - protein, 148 aa, Zea mays
  misc_feature: Ceres CLONE 1462142-F
MGEAKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERVSKYLTEVKVA

SEQ ID NO: 50049 - DNA, 894 bp, Zea mays
  misc_feature: Ceres CLONE 1462145-F
  misc_feature: Encodes the peptide sequence at SEQ ID NO. 50050
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (425)..(425): n is a, c, t, g, unknown, or other
ccagggttgggaaagcgaacattacaannnnccaccnncncacatagtggggctccccgcggtggcggccgctctataactagtggatcccccgggctgcaggatattcccacgagaccattacctagaacatcctaatcgaaaaatcttctctcaaacgattccacatccacatcggcgtgctcccgagccctgaaccctgtccctgacccgttcacccgtcgcaggcgagcagcagacagccagaggagacgtcgcgcctgtgcctaccatggacgagaaggagttctggcgcatgctcgacctcttccccgtcgtccgctcccgtgactattgcgctgatcctggagcatccagcagaggaaccagacagcggtcacgaggacaggacgcggcgaagggtattgatatagacccacccgacnaaaagaatttccttatggtgaaatttaacccccccccccacaaaaaccactgccacaaccacaagggggaactgcttccgccacggcatccccaaaaaaactccaaggaaaaactcttgtgtatcatactgagatttaaattttggaatcccagcctgccagaaggattcagaactccccctaaatgaaccctctggcatgtacgcacaccaagcaagctcgctatccctgtgtcccagggtaactcgccaacgagttcacatgagatcactcaaacacgccgcctgcatggtatgccctagcaatgttggattttttatcatctcacctcgcttaggcagtctcgccagtcttgttaaatacaagtctcatacctagtctcaactccaaatcatctcgcccaaagttggtcaccgcgatgtctagtgcattaataaccctgaaggctgtttgcgcacacgcttgagag

SEQ ID NO: 50050 - protein, 113 aa, Zea mays
  misc_feature: Ceres CLONE 1462145-F
  misc_feature (52)..(52): Xaa is any aa, unknown, or other
MDEKEFWRMLDLFPVVRSRDYCADPGASSRGTRQRSRGQDAAKGIDIDPPDXKNFLMVKFNPPPHKNHCHNHKGELLPPRHPQKNSKEKLLCIILRFKFWNPSLPEGFRTPPK

SEQ ID NO: 50051 - DNA, 807 bp, Zea mays
  misc_feature: Ceres CLONE 1462147-F
  misc_feature: Encodes the peptide sequence at SEQ ID NO. 50052
  misc_feature (412)..(412): n is a, c, t, g, unknown, or other
  misc_feature (425)..(425): n is a, c, t, g, unknown, or other
  misc_feature (428)..(428): n is a, c, t, g, unknown, or other
ggagctccccgcggtggcggccgctctattctagtggatcccccgggctgcaggaattcgcacgagaccattacctagaacatcctaatcgaaaaaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcccccaagtccttcgtgaagtccaccgtctccgcccacgacgtcgtcatcttctccaagtcatactgcccgtactgcaaaagagcaaaggccgtgttttaggaggttgaaattaaaaaaagagccatatgttgtggagcttttatantcccaccaccccncanaaattcaggatgccttacctgaaatagttggcaggggtaacggcccctcaagtttttgtccatgggaaagcaccggggtgggttctgaagaaactggtggactccctacaaaaagggaaaaactggttaagacttccaaacctccgaaacccaaggacaaccttttaaagggaatgcctacaacgggcacccctgttcctttggggttaaactcgggaacggggtttcacaaaaatcaaaaatgggtttcgggccccgggcttaccccgctacaagcttcaaaaagtcggatttttttctcgaaaggaaaaacgccaaaaaagtccccttgttttgtattaccacggggaatttttcgggtggcccccgaaaaaaaatg

SEQ ID NO: 50052 - protein, 62 aa, Zea mays
  misc_feature: Ceres CLONE 1462147-F
MVALLGRRIGVAAAAAAFIALVAFGSASSSPKSFVKSTVSAHDVVIFSKSYCPYCKRAKAVF

SEQ ID NO: 50053 - DNA, 755 bp, Zea mays
  misc_feature: Ceres CLONE 1462153-F
  misc_feature: Encodes the peptide sequence at SEQ ID NO. 50054
  misc_feature (661)..(661): n is a, c, t, g, unknown, or other
  misc_feature (670)..(670): n is a, c, t, g, unknown, or other
tagctggagctccccgcggtggcggccgctctagaactagtggatcccccgggctgcaggaattcgcacgagaccattacctagaacatcctaatcgaaaaaggccgagagttgtcaacgacgacgtctgccggcagtgctcctgctcctcctcctccttcccggccgccgcgcgagcttgggttagtgtctcttcttcgcggaggcctgtgagaggagccatcatcatggccgctgttgagactgttgtcctcaaggttgctatgtcatgcgagggctgcgccggggcggtcagaagagtgctctccaagatggaaggagttgaaaccttcgacatagacctcaaggagcagaaggtgacagtcaaaggcaatgtcaagcctgaggacgtcttccagacggtttccaagtcggggaagaggacctcgtactgggagggcgaagccacggccccggacgctgcggcggctccagaagccgaagcagctcccagcaccgcggcagaagcgcctcctgctgctccggcggcgccagagatcaccccagccaaagctgacgcctgatcgtcacgctattattcactcacatgtgatgctgtgcggctgcgactcctaaccctaaatctagaaatagctggggattgagtttgcattgcatcgtngtcctgccngtctagcaagtgacctatagaataatggattaacgatgacccagtgtgtgtatgattccccgtctgagaacaacacatcccttgg

SEQ ID NO: 50054 - protein, 111 aa, Zea mays
  misc_feature: Ceres CLONE 1462153-F
  misc_feature (7)..(68): Pfam Name: HMA Pfam Description: Heavy-metal-associated domain
  misc_feature: SWISSPROT Homolog: EC 3.6.3.4 Copper-exporting ATPase
MAAVETVVLKVAMSCEGCAGAVRRVLSKMEGVETFDIDLKEQKVTVKGNVKPEDVFQTVSKSGKRTSYWEGEATAPDAAAAPEAEAAPSTAAEAPPAAPAAPEITPAKADA

SEQ ID NO: 50055 - DNA, 728 bp, Zea mays
  misc_feature: Ceres CLONE 1462160-F
  misc_feature: Encodes the peptide sequence at SEQ ID NO. 50056
  misc_feature (571)..(571): n is a, c, t, g, unknown, or other
  misc_feature (572)..(572): n is a, c, t, g, unknown, or other
  misc_feature (585)..(585): n is a, c, t, g, unknown, or other
aaagctggagctccccgcggtggcggccgctctagaactagtggatcccccgggctgcaggaattcgcacgagaccattacctagaacatcctaatcgaaaactcgattcgatccgagcttacttctagggttcttggccccgctccaccgtcgcccatggcagacatgccaaccgagcggccttcatggagctgcagtcccggatgatagataccaccgcgaagatcaagcagttacaaacccaaatgcgttctaaagaaggggaaaagaagcgtgcctaccttactttggaggaacttcgccagttgccagatgataccaacacctacaagactgtcggaaaagtgtttattctggagccaaagtcagttctgttcaatgagcaggagcaaaagcttaatgacagtgagagtgcgatagcttcaatgcagacatccaaagactaccttgagaaacagcagggcgaagtggagaacaatattagggagctgcttttcacagaccccagacttgcgcgtcagatccctctcatgaccgttcaatgagagttgtttttctctccattaattnntttagatatttgnaatgtcgcagtttgatcagtcatgctgtggtctggcctatctgtgaacatgtgccgtctgtattttctaggggtttgctggggaaatgatgtgtccatctttaaaaaaaaaaaaaaagctatcgataccgtccaccccaaggg

SEQ ID NO: 50056 - protein, 119 aa, Zea mays
  misc_feature: Ceres CLONE 1462160-F
  misc_feature (1)..(106): Pfam Name: Prefoldin_2 Pfam Description: Prefoldin subunit
MELQSRMIDTTAKIKQLQTQMRSKEGEKKRAYLTLEELRQLPDDTNTYKTVGKVFILEPKSVLFNEQEQKLNDSESAIASMQTSKDYLEKQQGEVENNIRELLFTDPRLARQIPLMTVQ

SEQ ID NO: 50057 - DNA, 733 bp, Zea mays
  misc_feature: Ceres CLONE 1462165-F
  misc_feature: Encodes the peptide sequence at SEQ ID NO. 50058
  misc_feature (498)..(498): n is a, c, t, g, unknown, or other
  misc_feature (510)..(510): n is a, c, t, g, unknown, or other
  misc_feature (513)..(513): n is a, c, t, g, unknown, or other
  misc_feature (519)..(519): n is a, c, t, g, unknown, or other
  misc_feature (536)..(536): n is a, c, t, g, unknown, or other
  misc_feature (544)..(544): n is a, c, t, g, unknown, or other
  misc_feature (547)..(547): n is a, c, t, g, unknown, or other
aaagctggagctccccgcggtggcggccgctctagaactagtggatcccccgggctgcaggaattcgcacgagaccattacctagaacatcctaatcgaaaaatatatacggccactcccttgtcagcctgctcattggcacacacgcggacacaccacaggcgcgcaagcccaaccgatcgagcagctctagcatggcgagcggcggctactactacgaccagagcgcgggctacggcggctacagctactcggcggcgccgaggacgacgccgtcccacctcctggtgttcctggccaccgtggcgctgctgggcgccacgtcgctctactcgcgctacgagtccgcggtggagagcctggtggaccaggtgcggttcgccgtggtgctgtccccgctgctgctcctgctcgcggtccagtactgggcggccacggccggggtcccggcgccccggggcggcgccctcccgtcgctgctgggcggggaacagcccntctggtaccccngcngcggcngatggggccagcggaangcgcgtcntcntcgccgtggggcgtggcgctcgcgctcgccctggtgctgctcctcggcccctaccagtcggtgcttccggcgaatgggggtcccggtggtcccccgccggtgagcctaggccaggccaagccaggcccgtgtggggggatggaatccccacctttttggaaaggttgctcaacggaatagggagaa

SEQ ID NO: 50058 - protein, 151 aa, Zea mays
  misc_feature: Ceres CLONE 1462165-F
  misc_feature (102)..(102): Xaa is any aa, unknown, or other
  misc_feature (106)..(106): Xaa is any aa, unknown, or other
  misc_feature (107)..(107): Xaa is any aa, unknown, or other
  misc_feature (109)..(109): Xaa is any aa, unknown, or other
  misc_feature (114)..(114): Xaa is any aa, unknown, or other
  misc_feature (117)..(117): Xaa is any aa, unknown, or other
  misc_feature (118)..(118): Xaa is any aa, unknown, or other
MASGGYYYDQSAGYGGYSYSAAPRTTPSHLLVFLATVALLGATSLYSRYESAVESLVDQVRFAVVLSPLLLLLAVQYWAATAGVPAPRGGALPSLLGGEQPXWYPXXGXWGQRXARXXRRGAWRSRSPWCCSSAPTSRCFRRMGVPVVPRR

SEQ ID NO: 50059 - DNA, 720 bp, Zea mays
  misc_feature: Ceres CLONE 1462166-F
  misc_feature: Encodes the peptide sequence at SEQ ID NO. 50060
aagctggagctccccgcggtggcggccgctctagaactagtggatcccccgggctgcaggaattcgcacgagaccattacctagaacatcctaatcgaaaaacctcaaaattcacagtagccagatccagcagaattgagtgacaggctcaaacacaagctagaagataggtgcttagtgagttaaccagtgggatgtcgctggaagatagtttgaagaagagggtggccaagtgccgcagggagtatgacattatttacaagcagctaccggtgctgctagagaagatggaaattctatttcctacggggaagaagatggagagctccgagccggagaacaaatccgaagcaaagggggagccggtcgacccgctgcgagccatgacgccggcagaaataggggagcgctacaaggatctggcggacaccgtcaagggattcctcaaggatctggacgaggccgagaaggagatcgtcgcaggcacgagccaggcggcaacgccacctgcttcagtggaagacaagtaataatcaagagcagcagcagcacaaccgcacaaggagagggaggcctggatctgcatcaggagggtcatcatcccgtctaataataattactccgtattagtttcctttcgtcagtcatgtttcccagttggttaatcatctggatgttgggtgataatttagctgttctggtgtgttgtgattccgatcg

SEQ ID NO: 50060 - protein, 111 aa, Zea mays
  misc_feature: Ceres CLONE 1462166-F
MSLEDSLKKRVAKCRREYDIIYKQLPVLLEKMEILFPTGKKMESSEPENKSEAKGEPVDPLRAMTPAEIGERYKDLADTVKGFLKDLDEAEKEIVAGTSQAATPPASVEDK

SEQ ID NO: 50061 - DNA, 829 bp, Zea mays
  misc_feature: Ceres CLONE 1462167-F
  misc_feature: Encodes the peptide sequence at SEQ ID NO. 50062
  misc_feature (343)..(343): n is a, c, t, g, unknown, or other
  misc_feature (793)..(793): n is a, c, t, g, unknown, or other
ctggagctccccgcggtggcggccgctctattctagtggatcccccgggctgcaggaatttgcacgagaccattacctagaacgtcctaatcgaaaattcgcttccttcccagatcacgcgaaaggcgtgacgggggccaccgctgcggcgccgcccctcgaccctccgctgctccgcctgcgctggagaccatccatctggaagagatctctgatttacgggatggacggagccaagccagtggcggccgggaagcaggacctggaagaggcgctgctccgtatcgtgcagcagcaccaccaccagtccctctgccaacgacaacaaaccgctgatcaagtncttcatccctaggagatttctttcttcggttttaaatacagttgaatttgcaaacgggattggtaaaacaacccgcctcataatttgtgggaatttcaaattccgaaacctccaaaaactggaagaaaaatcagggatttccattggaaaaatatcaaaggcaccctatcccaaattttccccagtcctgaacttttgccgcgcgatacaaattttccaatttttatgaaaagcacccggggctattcgccccgcgagaagaaaattaatgggggtcgcggaaacccctctttttttggtaaccccgcgccccgcgagtttcccctcgctccgaagggagggcgcctctctctctctctctcaagggcgagagctatttaggtatcataaaagacgctgcggtggagggagagtggtcgcttcatgtggctgtggggggagagtgaatcncccagctgttgcaatgaaacaacaacaattcctctt

SEQ ID NO: 50062 - protein, 43 aa, Zea mays
  misc_feature: Ceres CLONE 1462167-F
MDGAKPVAAGKQDLEEALLRIVQQHHHQSLCQRQQTADQVLHP

SEQ ID NO: 50063 - DNA, 699 bp, Zea mays
  misc_feature: Ceres CLONE 1462170-F
  misc_feature: Encodes the peptide sequence at SEQ ID NO. 50064
  misc_feature (698)..(698): n is a, c, t, g, unknown, or other
tccccgcggtggcggccgctctagaactagtggatcccccgggctgcaggaattcgcacgagaccattacctagaacatcctaatcgaaaagttcctaagaggaggaagaacaccaaggactcactaccagcgtctctccgcgatccaaatcctcccgggaaagttcttggttgatcacttcctcctcaaccgcctcccaggttcttggagtagcttttgccactctcaccaggagatttcatgtcatgatcttgacgttctcatcccaactgctcttagacccctctgtgaacgttcatgcctggggaacctcgggctcgctgacccaggaaaagactagcgccctgaacgcgtcctcgtgggtaacgttcacaacagcctgaccactgtctggggtctgaatacccccttcagctatatgactgatcctcacctacctccacaaagagtttagctgcaatggtacagttgttcaggcatcccaacttggcaaagtcattcaactccaaggtgatcagaggaagatcgatctagacttccttgtacaggccgggattgtcacatcggaacacatccagattctgggtttctgagttcctgtcagaatccatatcaaaaatctatatgaaaaaacatctacgatcttgctggtgccagcatatctagaaagggccgcctactcctagtacggcatctnc

SEQ ID NO: 50064 - protein, 45 aa, Zea mays
  misc_feature: Ceres CLONE 1462170-F
MILTFSSQLLLDPSVNVHAWGTSGSLTQEKTSALNASSWVTFTTA

SEQ ID NO: 50065 - DNA, 716 bp, Zea mays
  misc_feature: Ceres CLONE 1462172-F
  misc_feature (534)..(534): n is a, c, t, g, unknown, or other
acccgcggtggcggccgctctacaactagtggatcccccgggctgcaggaattcgcacgagaccattacctagaacatcctaatcgaaaaatgctccggctgagtcaacttcaatggcccctgtgacctgtattgtctcgtatcagacggctcacctactagggttggtagcactcggagccaccgcaccgtacactgcagcccaagttctcctctgcctctgaaatatctcgccacctgactcgacagcgacaagatccaagaactcgctcgcgcgcacggacagggccggaacccagggatcgagactgaacatcagtccgagacgccatgaacgtggaggaggaggtcgggaggttcaaggaggagatccataggctcggccagcagtagcccgacccctcttacaaggtcaagtttggcgttcttttcaacgaccatcgctgtgcaaatatcttttaagcgctagttggcaccttgagggccgccaggaagaggaagatcttgacctacgaatgcaacctgcttctgcanggggtccatgacaacgtggaagataaccctgttgcccccgcctgagaaagctgtctctttgtacctgaaaacgacaccaagtttctccatttccatacgactccctttgttgggattcaggccgtgcctactcttgaaattcttctaaaacaataagggggctccctggaaaactggctatc

SEQ ID NO: 50066 - DNA, 775 bp, Zea mays
  misc_feature: Ceres CLONE 1462173-F
  misc_feature (248)..(248): n is a, c, t, g, unknown, or other
  misc_feature (269)..(269): n is a, c, t, g, unknown, or other
  misc_feature (285)..(285): n is a, c, t, g, unknown, or other
  misc_feature (339)..(339): n is a, c, t, g, unknown, or other
  misc_feature (350)..(350): n is a, c, t, g, unknown, or other
aagctggagctccccgcggtggcggccgctctagaactagtggatcccccgggctgcaggaattcgcacgagaccattacctagaacatcctaatcgaaaaatctacgttctactcccactcgcagtcgcggtagccggcggcggcggcggaggaaagcaggcaggccatggcgtcgtcgtcgtcgtcgaccccggcggccgtccgcgagatgcagaaggatctcgaggtccagcctacgtcctcagncagatccagaagacatcgccnagaaccaccaggtccngcagcagtacaccattcaggtcggcgaagacgagtctcgtccttcaggacctgnagcttgctcancgatgggggccaacttgttacagctcatcggaccggggctttgttcagcaggaccctcccggaggccaagggccaacgtcaaaacccccttccaggtattttcccccgagacttaaaccgaatgatcccggcccctcaaacttttggggaaaaaccccaaccccccagaggggattctttttttttttttttccccaaagaaggggggtgtttaaaacatagggtttttaaaaattttttttgtgggttaccaaaaaaaaccgagggggtggtttttttttttcccccccctcccccccgggtttttttttttggggggggaaaaaaatggtgttttatatttttttttctccccccccaaaaaaaaaaaaaaaaacgcttcttcaaaaaaaaaaaaatatttttttttttgcccccccaaaaaa

SEQ ID NO: 50067 - DNA, 787 bp, Zea mays
  misc_feature: Ceres CLONE 1462178-F
  misc_feature: Encodes the peptide sequence at SEQ ID NO. 50068
  misc_feature (13)..(13): n is a, c, t, g, unknown, or other
  misc_feature (15)..(15): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (311)..(311): n is a, c, t, g, unknown, or other
  misc_feature (423)..(423): n is a, c, t, g, unknown, or other
  misc_feature (457)..(457): n is a, c, t, g, unknown, or other
  misc_feature (463)..(463): n is a, c, t, g, unknown, or other
  misc_feature (464)..(464): n is a, c, t, g, unknown, or other
cggggggccccancnccaaaaacccaacnnnaaanccnnacccccaaaataacaggaactccccgcggaggcggccgctctacactagtggatcccccgggctgcaggaattcgcacgagaccttacctagaacatcctaatccaaaatcagcgcaacgattacggtaacgccgtcgccgccctacggctcaaatcttcgtcgtcatcttctccggcaacgagcacccaaggatggtggtccttcaaccagatcggttcctgagcgagctgacgagcatgtacgagcggagcacggagaagggctccgtcngggtcaccatgaagcgatcaactctcaagggcaaggcacagttgcggaagatggagaataaggggcaggaggtagagcacaggtgcctcgtccgcgcctccaatggttttanaacatctccacctcggtttctctaaaggagtacnaaacgnnggaacttcatacgcaacagttcttaaggcccatatgcatgctctgaacaaaacggagaggaaagacaagaagaaggctgcagatgctgagaaggcaattgagaccgcacccaagaagcagaagaaagcatcttcaaagaaatcttcggggtccaagtcataaggcgctcgcagaaatcagtgtcttctcccttctgttgttaccgcaccgcccgactaataacagtgtcgggaattttatcctggcttttatcccaatgtgtgtctgggagatcaaagcctgtgaaaacacttttatagagccgtggtcatcgaggcttgctt

SEQ ID NO: 50068 - protein, 71 aa, Zea mays
  misc_feature: Ceres CLONE 1462178-F
  misc_feature (4)..(72): Pfam Name: SRP14 Pfam Description: Signal recognition particle 14kD protein
  misc_feature (27)..(27): Xaa is any aa, unknown, or other
  misc_feature (64)..(64): Xaa is any aa, unknown, or other
MVVLQPDRFLSELTSMYERSTEKGSVXVTMKRSTLKGKAQLRKMENKGQEVEHRCLVRASNGFXTSPPRFL

SEQ ID NO: 50069 - DNA, 658 bp, Zea mays
  misc_feature: Ceres CLONE 1462179-F
  misc_feature: Encodes the peptide sequence at SEQ ID NO. 50070
  misc_feature (348)..(348): n is a, c, t, g, unknown, or other
tctgtcccagtggatcccccgggctgcaggaattcgcacgagaccattacctagaacatcctaatcgaaaaattagtgggttgagttgggtccaaggtttttatcgtcacgcgtcatcacaagcatactccatccagtacaatactgttggtctagccggcggcggccgcgtccctcatccaatcatcccctttccgcgatcaaaaccgagctagggttttaggtagtgggggagagggtgaggagcggacggaggcgcgccatggacaaccccgagatgcagcggttccttcagcaagagcagcaaacggcgatgatgaacgagatgggtggcaagctatagagaancagcctgggacaagtgcatcacttagcgctccccgggtagcaaagcccacgttcccggaggaaaccaaccctggcctggaacaaacctccgcccccaaagagttttcccccaaacaatgaacccgttaaatcaaattgcccaaacaacacttttttaaaaaaatataaaattaaaggcggccttctacaacccccaaaaaaaccccctttataaccttaattttacaaaaccccccccccaaagactttttcttttaacccccccctctttagaaaattttaaaaagattgctcactcctagaggaaaag

SEQ ID NO: 50070 - protein, 70 aa, Zea mays
  misc_feature: Ceres CLONE 1462179-F
CPSGSPGLQEFARDHYLEHPNRKISGLSWVQGFYRHASSQAYSIQYNTVGLAGGGRVPHPIIPFPRSKPS

SEQ ID NO: 50071 - DNA, 753 bp, Zea mays
  misc_feature: Ceres CLONE 1462184-F
  misc_feature: Encodes the peptide sequence at SEQ ID NO. 50072
  misc_feature (604)..(604): n is a, c, t, g, unknown, or other
  misc_feature (730)..(730): n is a, c, t, g, unknown, or other
  misc_feature (731)..(731): n is a, c, t, g, unknown, or other
  misc_feature (753)..(753): n is a, c, t, g, unknown, or other
aaagctggagctccccgcggtggcggccgctctagaactagtggatcccccgggctgcaggaattcgcacgagaccattacctagaacatcctaatcggaaaaatttaatcccaccacccccatgctctgttacattattgcctcttcctctcgccgcacccatcccaccatgtcctcttctctgttcctctccagcccccttttcaacctttgacgctgtagcttgagagcgagcttagtgcctaccatattctcctcctgagcgactgagcgctggtctccgataggctcgccatgcaggtgctctgcgacgtctgcggcggcgcgccggccgccgtgctcttctgcactgacgaggccgcgctctgctccgcctgcgaccgccgcgtccaccgcgccgacaagcgccgccgcatcccgctcgtccagccctgcggcgacgactccgccgccgccgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtncgggccaagctctccgccgcgctcgtcgaccaggcgccccctcccctgacgacgacgacgacgacgtcgccgagcccgacgctgtccccgcgcctgcgcggcaaagcctcgtctcttgagtcggcnngcgcagcagcatctccgactan

SEQ ID NO: 50072 - protein, 152 aa, Zea mays
  misc_feature: Ceres CLONE 1462184-F
  misc_feature (55)..(102): Pfam Name: zf-B_box Pfam Description: B-box zinc finger
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
  misc_feature (146)..(146): Xaa is any aa, unknown, or other
MQVLCDVCGGAPAAVLFCTDEAALCSACDRRVHRADKRRRIPLVQPCGDDSAAAAAAPLCDVCKERRGLVFCVEDRAILCPDCDDPIHSANDLTAKHTRFLLVRAKLSAALVDQAPPPLTTTTTTSPSPTLSPRLRGKASSLESAXAAASPT

SEQ ID NO: 50073 - DNA, 902 bp, Zea mays
  misc_feature: Ceres CLONE 1462195-F
  misc_feature: Encodes the peptide sequence at SEQ ID NO. 50074
  misc_feature (1)..(1): n is a, c, t, g, unknown, or other
  misc_feature (9)..(9): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (310)..(310): n is a, c, t, g, unknown, or other
  misc_feature (438)..(438): n is a, c, t, g, unknown, or other
  misc_feature (457)..(457): n is a, c, t, g, unknown, or other
  misc_feature (478)..(478): n is a, c, t, g, unknown, or other
  misc_feature (482)..(482): n is a, c, t, g, unknown, or other
  misc_feature (484)..(484): n is a, c, t, g, unknown, or other
ntttgtgtncccnnnccaanccccccnnnnnnnaaaaaannnnnaaatcctggagctccccgcggtggcggccgctctagaatagtggatcccccgggctgcaggaattcgcacgagaccattacctagaacatcctaatcgaaaagcgactgtgagcttcgttcgttcagttcatccgtgttcttgtttgccaggtcaacacacagaggatgtcgcgctgcgcaggcaactgtgggtgcggctcccggctgcaagtgcggcaacggctgcggagggcgcagcaagatgtacccggacttggctgagcangcgacaccaccaccccagctctcatcatggggggccgacccatccccgcgctcgcccagggcggcgttcaggacggccgccggagatgaggatttttttgtgctggtggtttaagggggggggcaatnccaacctcttgtatttttnttcgggccttcccccccaaancaananaaataaggatcttccggcagggaggcgacggccaccgacttatcagcctagatagaaggaactctcccgagcgtcccctccgcctggctttctctccggtcataatatggtgcgtcgcaccctcgcactccgccgcacggaagcggatctgcatcccctcactgtcaacttcatggacccacttcccgagcgctcccttcggccctaatcccctgggagacttctccccgcccccgtattaggacaacccactcgcgcgcccacgctcacttactcctcgaatctccctttggggggggactggttcgcgcactgacgtccctcgcgtgtgctctcacaagcatcgcgttctgcatcttctctgcatttcacgcatttgagagggcgcgggactcagtgcttgtgagtctgtttctgg

SEQ ID NO: 50074 - protein, 45 aa, Zea mays
  misc_feature: Ceres CLONE 1462195-F
  misc_feature (8)..(8): Xaa is any aa, unknown, or other
MYPDLAEXATPPPQLSSWGADPSPRSPRAAFRTAAGDEDFFVLVV

SEQ ID NO: 50075 - DNA, 721 bp, Zea mays
  misc_feature: Ceres CLONE 1462214-F
aagctggagctccccgcggtggcggccgctctagaactagtggatcccccgggctgcaggaattcgcccgagacccttacctacaacttccgaatcgattatacgcgtctcttccacagccacaaactctatccctcgactgtgccttcttgctcactctcctctgccccgaataggaaaagccctccaaaagcggttgcagatcaacctggctcaggtcgaggctccgtctgctgctgttgcggcgacgacccctgacgtggcgaccgtaacggaggcgtcggagctctctcggtaggatgaagggtccgcacaagctgcaccgaccttggacctctctggtacgacataccatttccttcccaaacccggtttctgcctgtggcacctccctccaaaggcgcaccccatctacacccccgaggagttttggggattgaatcatcatgttatccgcccactccttttgcctgggactgctggattttcgcctagcctcggctggatatgagccaatgttgaaagacccggagtgtgcaaatggtggcccccggtactgacccatgtcgcttaaaccctctctctgagatcaggtggctcgaaaacacgattgctctcgtcccgggagcagtttgatgaagcagatgacattttgaggacttgacgcgagagactacccaagaggagatcatctgatctataccgtcgacttcgagggtgg

SEQ ID NO: 50076 - DNA, 713 bp, Zea mays
  misc_feature: Ceres CLONE 1462217-F
  misc_feature: Encodes the peptide sequence at SEQ ID NO. 50077
aaagctggagctccccgcggtggcggccgctctataactagtggatcccccgggctgcaggaattcgcacgagaccattacctagaacatcctaatcgaaaactctctcgccccaaaaccagatcgccacgacaagggccgagggccccggaggggcgcgtagcaatggcggcaggctaccgggccgaggacgattacgattacctcttcaaggtggtcctgatcggcgactccggcgtcggcaagtccaacttgctctcacgcttcacgcgcaacgagttcagcctcgagtccaagtccaccatcggcgtcgagttcgccactcgctctctccaggtcgacgggaaggtcgtcaaggcccagatttgggagaccgccggccaggaacgataccgtgcaatcactaccgccccccaccgaggcgctgttggggcgttgcttgtatatgacgtcactcgccactcaacctttgagaacgttgagcgttggctgaaggagctgaggcgccacacacacccgaatatagttgttatgctggttggcaacaaatctgatctccgccatcttgtaacaattcaaaccgacgaaggaaaagcattcgcagagagggaatcgttgtacttcatggagacctctgcgcttgagtcgaccaacgttgagaatgattttgcaaaagtcctacctcagatctaccggattgtgaaacaaagagc

SEQ ID NO: 50077 - protein, 182 aa, Zea mays
  misc_feature: Ceres CLONE 1462217-F
  misc_feature (16)..(177): Pfam Name: Ras Pfam Description: Ras family
  misc_feature (16)..(130): Pfam Name: Miro Pfam Description: Miro-like protein
  misc_feature: SWISSPROT Homolog: EC 2.7.11.1 Non-specific serine/threonine protein kinase
MAAGYRAEDDYDYLFKVVLIGDSGVGKSNLLSRFTRNEFSLESKSTIGVEFATRSLQVDGKVVKAQIWETAGQERYRAITTAPHRGAVGALLVYDVTRHSTFENVERWLKELRRHTHPNIVVMLVGNKSDLRHLVTIQTDEGKAFAERESLYFMETSALESTNVENDFAKVLPQIYRIVKQR

SEQ ID NO: 50078 - DNA, 713 bp, Zea mays
  misc_feature: Ceres CLONE 1462220-F
  misc_feature: Encodes the peptide sequence at SEQ ID NO. 50079
  misc_feature (632)..(632): n is a, c, t, g, unknown, or other
ggagctccccgcggtggcggccgctctagaactagtggatcccccgggctgcaggaattcgcacgagaccattacctagaacatcctaatcgaaaactctgcagctctgctctgtttgcttactcttcccttccatggcggcatacgccggaaccctagttccacccttcctcaccgtccgcctcgcggtctcccacctcagatccattaccccggggtcctactccctgagccactgtctcccccgcctcgcggtcgcccgtgcggcctcccgcggaaacggagacggcgacggcgggcctccagcggagggggagaaggagcgccggcgctcgtcactcccagcgctgtcggagattgggtggggggaactgctatccccggaccccaccaacgccgtggctgcggtgctcacgggcgcgctcgtatgggctggcgcctcactgctgctgcagctcgcgctcatctccgcggcaatctttgcccccgctgtcaaatactcgtttgtcgccccgctcctgttattccacccttatcggcctgctgggatcgaacccgccttaaggaacaaaagctgtaaattcccactaaaccattcccgaggggaagatccgggtcgaggacaaaaaccnagggattttcaacgggtttccacttctttgtatgggcaccagcgagcaaaaattttttgtcttgcccacggcccttattgg

SEQ ID NO: 50079 - protein, 193 aa, Zea mays
  misc_feature: Ceres CLONE 1462220-F
MAAYAGTLVPPFLTVRLAVSHLRSITPGSYSLSHCLPRLAVARAASRGNGDGDGGPPAEGEKERRRSSLPALSEIGWGELLSPDPTNAVAAVLTGALVWAGASLLLQLALISAAIFAPAVKYSFVAPLLLFHPYRPAGIEPALRNKSCKFPLNHSRGEDPGRGQKPRDFQRVSTSLYGHQRAKIFCLAHGPYW

SEQ ID NO: 50080 - DNA, 758 bp, Zea mays
  misc_feature: Ceres CLONE 1462225-F
  misc_feature: Encodes the peptide sequence at SEQ ID NO. 50081
  misc_feature (377)..(377): n is a, c, t, g, unknown, or other
  misc_feature (380)..(380): n is a, c, t, g, unknown, or other
ggagctccccgcggtggcggccgctctagaactagtggatcccccgggctgcaggaattcgcacgagaccattacctagaacatcctaatcgaaaaatcaggccgtcctaggctagccagagccacaccaacgcctaaacgctcgccatggcctcctcctccttcttcttcttcgacgccgagccggtctacgactacgagcctagcctgctgcccacgatggacgcctgcgcgctctgcgccaagccgctgggacgcgactgcgacatcttcatgtacagaggggacacgcccttctgcagcgaggagtgccgcggcgagcaaatgcggctcgacgccgtccgcgccaggcaggccgcccagtccgccggacggangcngcagcagcagcagcagtactcctccagaacgaaatccaagcacccagagaccatggaaggtatccgtggcgacttgatgaacggccggaacctgcatgggtctccagaaccccaaaatttctggccctgaggaaacctcaatgggagcgggggaaaattaggaattctcatttccccgcccggttgtcccccgccgaaaaccgtgcccaaaggggggcccaattttttcgggggacggaaccccaggaaaaaggggcccttccccgggaaaaaaattcccccccgaaaacccctgcgggggggtttttgcacaggggaaaaaccccccctaaacccccccccctttggggggcgccacttttggtgccgagggggggg

SEQ ID NO: 50081 - protein, 120 aa, Zea mays
  misc_feature: Ceres CLONE 1462225-F
  misc_feature (12)..(67): Pfam Name: DUF581 Pfam Description: Protein of unknown function (DUF581)
  misc_feature (77)..(77): Xaa is any aa, unknown, or other
  misc_feature (78)..(78): Xaa is any aa, unknown, or other
MASSSFFFFDAEPVYDYEPSLLPTMDACALCAKPLGRDCDIFMYRGDTPFCSEECRGEQMRLDAVRARQAAQSAGRXXQQQQQYSSRTKSKHPETMEGIRGDLMNGRNLHGSPEPQNFWP

SEQ ID NO: 50082 - DNA, 873 bp, Zea mays
  misc_feature: Ceres CLONE 1462228-F
  misc_feature: Encodes the peptide sequence at SEQ ID NO. 50083
  misc_feature (1)..(1): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (464)..(464): n is a, c, t, g, unknown, or other
  misc_feature (482)..(482): n is a, c, t, g, unknown, or other
  misc_feature (761)..(761): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (816)..(816): n is a, c, t, g, unknown, or other
  misc_feature (829)..(829): n is a, c, t, g, unknown, or other
nccaaaacccccccccaacacccctaannnccccnnnnnnaaaccccccaacaaactgggactccacgcggtggcggccgctctataatagtggatcccccgggctgcaggaattcgcacgagaccattacctaaaacatcctaatcgaaaaacaccccaagaacgtgatcctgctggcgtgcgacgccttcggcgtgctcccgccggtgagcaagctggacctggcgcagaccatgtaccacttcatcaacggatacaccgccttggtcgccggcacggaggaaggcattaaggagccacaggccaccttctccgcctgcttcggcgcggccttcatcatgctccacccaactaagaacgccgccatgctccccgagaaaatgcataaataccggcgcccagggtgggttgttaagaatttaaaaatctgggaggaagggaacgttgttggtaaaaacccctnccttccccccccccccanaaaaaaacaaacaaaccccttcccactacgggggaaggtttccacccttccaacttacaaaaaaaaaccgaaggtcttttttggcctgggaaaaactcccaactggaaaattaaggggggtttccccccaaatataatgcccttgacacaaaatacaaaacattggtaaaaggaacaagcggccccctcaccaagagaaaaccttctctaagaggtctgcgcgggttcttttatagaaaacacgcggggtgttgcgtctgtcaagatgggggggcaaanaatttgaaaaaactcccccccttaactgtaggttgaccccannnnnnnnnntgtnttgatgagattanatatggatgaaaaatgtagtaggaattactcgctgtttgtgctg

SEQ ID NO: 50083 - protein, 138 aa, Zea mays
  misc_feature: Ceres CLONE 1462228-F
  misc_feature: SWISSPROT Homolog: EC 4.1.1.49 Phosphoenolpyruvate carboxykinase (ATP)
  misc_feature (77)..(77): Xaa is any aa, unknown, or other
  misc_feature (83)..(83): Xaa is any aa, unknown, or other
MYHFINGYTALVAGTEEGIKEPQATFSACFGAAFIMLHPTKNAAMLPEKMHKYRRPGWVVKNLKIWEEGNVVGKNPXLPPPPXKKQTNPFPLRGKVSTLPTYKKKPKVFFGLGKTPNWKIKGGFPPNIMPLTQNTKHW

SEQ ID NO: 50084 - DNA, 763 bp, Zea mays
  misc_feature: Ceres CLONE 1462234-F
  misc_feature (409)..(409): n is a, c, t, g, unknown, or other
ctggagctccccgcggtggcggccgctctagaactagtggatcccccgggctgcaggaattcgcacgagaccattacctagaacatcctaatcgaaaaattccccaatcccaccgccaggctccgcacgcgcctcggaacctagcccagtcgactccttcagatccggcgggatcgccggctcctaccctcgtcgccacgttccggcatctcggctccccggcgtcctctacccgacttctacacctgccatcttccccaggcggcgtcccgacgaatcgcttggtcgacaggctacatcaccaccaagtcagcatcgacgactcgaaggattcgtgtcgtcgtcgatcgccgatagccggtcgccgggtcgcggtcgcctcttcgtagatcgaaatggttctgtgatnatcctgggtgcaggtcgctgtatttcatctgaaatctgaaaaaagtccgggtcttatcccgggaaaaaaaggccttttttttattccggaaaaaagggaccatacccccccacccggcggggggggtgggggttatcccctttaaagagggaaagggggatcttttctttccccaaaaaaaaaaaaaaaaattttttttccccccccccccctcggggggggggcgggacccatattcccctaaaaggggggtttatacccgccccccgggggcgtttttttaacacccggggggggggaaaaacccgggtcccccacaaaataagggcggggagaacccccccttttttgggg

SEQ ID NO: 50085 - DNA, 798 bp, Zea mays
  misc_feature: Ceres CLONE 1462235-F
  misc_feature: Encodes the peptide sequence at SEQ ID NO. 50086
  misc_feature (316)..(316): n is a, c, t, g, unknown, or other
  misc_feature (317)..(317): n is a, c, t, g, unknown, or other
  misc_feature (429)..(429): n is a, c, t, g, unknown, or other
ctggagctcaccgcggtggcggccgctctataactagtggatcccccgggctgcaggaattcgcacgagaccattacctagaacatcctaatccaaaactctctcttcgtcgcgccggcgtagcacgactccgactcggccatggagacgcccccagctctcctattcccttcgccctcttcggcatcttctccgccgtcatccgcgcagggagaggcggtggtcctcttcaacgtctgcgacagctacgtgcggtgaccggaccaggcagaccgtgtcatcggcacactccttggatgcctcctccccgatggcnnacgtcacgtacgcaactcctacgtggtctcccacagcgagtcagccgaaccagtcgccatcgacgtcgacgtacacctaacatgaaacccccccacccggaaggtgaccccnaaggaatccatcgtcgggagggtccccgactggatttggaggttccggggggaaagaaggcttacccgggaggtcaattcacgggaagaaaaaaagccccctccctttttaaattaaaaccggggtttccaaaggggggaaagtttccaaaaaggcttagttttcttccaaacgggcccccgggggaaaggaacacccgggcggaatttcggaaaaccccccggggataaaaaaaaaagggggcaaaaaggggggttttaaaaccccaaactccacagggggaaaaccccccccagggtggggggaggggggggcccccgggggaaaatatttaaaacccccccccccgggggggggcggcgggcacat

SEQ ID NO: 50086 - protein, 38 aa, Zea mays
  misc_feature: Ceres CLONE 1462235-F
METPPALLFPSPSSASSPPSSAQGEAVVLFNVCDSYVR

SEQ ID NO: 50087 - DNA, 753 bp, Zea mays
  misc_feature: Ceres CLONE 1462237-F
  misc_feature: Encodes the peptide sequence at SEQ ID NO. 50088
  misc_feature (662)..(662): n is a, c, t, g, unknown, or other
  misc_feature (711)..(711): n is a, c, t, g, unknown, or other
  misc_feature (712)..(712): n is a, c, t, g, unknown, or other
  misc_feature (739)..(739): n is a, c, t, g, unknown, or other
  misc_feature (751)..(751): n is a, c, t, g, unknown, or other
ggagctccccgcggtggcggccgctctagaactagtggatcccccgggctgcaggaattcgcacgagaccattacctagaacatcctaatcgaaaaatttcagtccattcccaacttcgtccaatcgtccccgtcaacaccggcgcttccttccttcctccctccgtacatccctctctctccctctctcctgccctcttcgcctcttctgcccagccatccctgacgacgcgaggcggcaaataacctctccggggacgaggccgatggagtcgacctccggcgaagacgctcccaagcgcaacccgctcccgtccgccctcgtctccaacctcgagtccgtgcttgctgcccgccgcccggccgcggccgaggtcagcaccgccgccgcagccggcgaggttgaagcctcggctccagaggatgccccctctggagatggggcgccggcgaggcccatcgtgctgctgacctgtgccggggggatccggtccgcgggtctcgcggcgctcgtcgacgccctcgttaccggcgcccgctgcgacgtccacgtgtgtgctcccgaatcggacaagccagcctgtggccactcaattaccatccgtgaaaacatcactgcgacatcggtggatttcacaggtgctaaagcttttgagaatcangcacgccggttgactgtgtctcgttggccttatctgggaaggtgttccnntggtcgtctcctgctttggtgatcagncgtatcacacanga

SEQ ID NO: 50088 - protein, 155 aa, Zea mays
  misc_feature: Ceres CLONE 1462237-F
  misc_feature: SWISSPROT Homolog: EC 3.1.3.5 5'-nucleotidase
  misc_feature (132)..(132): Xaa is any aa, unknown, or other
  misc_feature (149)..(149): Xaa is any aa, unknown, or other
MESTSGEDAPKRNPLPSALVSNLESVLAARRPAAAEVSTAAAAGEVEASAPEDAPSGDGAPARPIVLLTCAGGIRSAGLAALVDALVTGARCDVHVCAPESDKPACGHSITIRENITATSVDFTGAKAFENXARRLTVSRWPYLGRCSXGRLLLW

SEQ ID NO: 50089 - DNA, 736 bp, Zea mays
  misc_feature: Ceres CLONE 1462240-F
  misc_feature (360)..(360): n is a, c, t, g, unknown, or other
  misc_feature (600)..(600): n is a, c, t, g, unknown, or other
  misc_feature (605)..(605): n is a, c, t, g, unknown, or other
  misc_feature (653)..(653): n is a, c, t, g, unknown, or other
  misc_feature (736)..(736): n is a, c, t, g, unknown, or other
acccgcggtggcggccgctctagaactagtggatcccccgggctgcaggaattcgcacgagaccattacctagaacatcctaatcgaaaaacgatgccgttgcgcacctcttctctctcgccgccccgagacccccacgcttccctctccgcccccgaactgtggcgcctccccccgccgccgcagcgatgccactcgcggcagagcccgacgacgctcatgaggaaagggagaatcagcagctgctaattacgacgaagggagggcccgggcttgagggactggtggtggggagctactgccacgatgtgctaatccggggcgggcgcatagtgggggagacgctcggcggggctgccncccttcgtgtccaacgtgctcgacgccgcttcgccccagggcgccgcgctcaacgagacatccccctttgtcgttgtggccaaggtgggtcacgacttcatctacgcccgcgcggcggcgtccgcgcggcatccgcctctgctctgctcgtccccaccacctccttccacgcccagttctcggagaacgccgcctcggcgcacgcccccgaccgggagctccggcgccggcgcccgtgcnacccnatctaccccgccgacttttcccgacgcgcttcgctacggctcgctgtncgcgtcccccggggagtgctacccgagagctcgagcgatgatcagctctgccgcacgtgctcgtggaccgcagcgctgatccn

SEQ ID NO: 50090 - DNA, 774 bp, Zea mays
  misc_feature: Ceres CLONE 1462241-F
  misc_feature: Encodes the peptide sequence at SEQ ID NO. 50091
  misc_feature (689)..(689): n is a, c, t, g, unknown, or other
ggagctccccgcggtggcggccgctctagaactagtggatcccccgggctgcaggaattcgcacgagaccattacctagaacatcctaatctaaaaatcataccggcgggcggcgcggggcagctaatcggcaatccggcttcgcctcgtcgcagtccaatccgcactcaccgccgccctcccgcccctcacctgcccgcggcagtgtcggagtaaaccctaccggacctatcgtcacgcgactgcgggagttgcttgcttcttctgccgctctctcgctccgtcccttccgcccatggagacctcgctgcgcttgcgcagtggcggcggcctccgcatcccacgcaaggagaagctgcccctcggccacagctcgctgctgcaggctcatgcggagctcgaactcaacacaagcccgccggaagtactaccccgagtaatcccctctctttggcaggcatttcaacccgcagtttcagccaatcccggaatggggtccagttgcccaagggggaaaaccccccctaactttttcccgccaaaaaagccgcccggtccaaaccaaaaaaggggttccaaggccaaaccctaaaggggccccctttcccccaaaaaaatttaaaccaaaaaaaaacagtgggcccccttgaaagggggggggaccatttttattttaaaaggggccaaanaaaagggccaaaagggtgtaaaaaaaagtggggaaggggggtctttttttccccaccaaaaaaaaggtgggccccaaaatttttt

SEQ ID NO: 50091 - protein, 98 aa, Zea mays
  misc_feature: Ceres CLONE 1462241-F
METSLRLRSGGGLRIPRKEKLPLGHSSLLQAHAELELNTSPPEVLPRVIPSLWQAFQPAVSANPGMGSSCPRGKTPPNFFPPKKPPGPNQKRGSKAKP

SEQ ID NO: 50092 - DNA, 800 bp, Zea mays
  misc_feature: Ceres CLONE 1462242-F
  misc_feature: Pfam Name: PHD Pfam Description: PHD-finger
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (424)..(424): n is a, c, t, g, unknown, or other
  misc_feature (426)..(426): n is a, c, t, g, unknown, or other
  misc_feature (427)..(427): n is a, c, t, g, unknown, or other
  misc_feature (432)..(432): n is a, c, t, g, unknown, or other
  misc_feature (751)..(751): n is a, c, t, g, unknown, or other
aataacgaatacgagtatgagtgaagtatacctcaanaatnnctnnnnnncatcaaactggtactccccgcggtggcggccgctctagactagtggatcccccgggctgcaggaattcgcacgagaccattacctagaacatcctaatcgaaatacaccgcggacgagttttggatcgggtgtgacatgtgcgagcgacggaaccatggccagtgcgccaagatacctcctgctagggcagagagcataaaccattacgaatgcccgagctgcagctccaagagggcgaggcagtaacaaaacccatgaatgcaggaagcctccgaatgtgggaggtaaggtgaacaagaggcgcattgcaaagtatgccggcaggagaaggcccagagacctccatttacaagattagaactatattggtatntnnccagngcgttatggtgaccttgttacgtatggtgggcccacccgacgaaagatcagacatttggccaccggaggcacttacttaaatgcccctagatgtacctgggggtaaaagaagaggaactcacgttttatccaatatggcgaggtttgtttctaaataaaaaaaaaaaaaacattatccaataccgtcgaacttccaaggggggggcccggttacccaacttcccacctacaaatgggttcgtattacgcggaggggacacccgggctgaaccgtttttccccaccggatgttggactgggaataaaacccggcgggcgngttccctccgaacttaaacaccgccgcgcttactcagcgatgagtgtgg

SEQ ID NO: 50093 - DNA, 757 bp, Zea mays
  misc_feature: Ceres CLONE 1462244-F
  misc_feature (239)..(239): n is a, c, t, g, unknown, or other
  misc_feature (244)..(244): n is a, c, t, g, unknown, or other
  misc_feature (245)..(245): n is a, c, t, g, unknown, or other
  misc_feature (317)..(317): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (360)..(360): n is a, c, t, g, unknown, or other
  misc_feature (371)..(371): n is a, c, t, g, unknown, or other
  misc_feature (374)..(374): n is a, c, t, g, unknown, or other
  misc_feature (375)..(375): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (504)..(504): n is a, c, t, g, unknown, or other
  misc_feature (600)..(600): n is a, c, t, g, unknown, or other
  misc_feature (601)..(601): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (666)..(666): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
ggagctccccgcggtggcggccgctctagaactagtggatcccccgggctgcaggaattcgcacgagaccattacctagaacatcctaatcgaaaaatcaccaactagaatcactcaacacgcacgggccaggcccagctcagaggcaaaaacccacaccacacttcgttccccttgtcccaattgctcctccacttcccccaccgcccaccagtgatctcgccgccgcgacgcgaggncaccnnacggcccggcgcccgggcccggcctttcccctccccagaaaaagtatccccccgtgcgcccgaatcacctcntaattnnncgtctagccgctgcgtttccagaagtcgcgacatngccgcctcggnggnntcctccctgcccagccccgggggaacccgccccccttctttttttttttcgggtttttttctggggccccccaaaaaaggggagcccaccccctttccccccctccgggggtttcccnnngggtggggnagagaaataaagagaacccccccccctctttttttttttttttttgtttataagaaaagaaaagagcccccccccccccccccccccccccctccnngcgggggggaggggagaaaaaaggggaagannnnnnnnnnnttnnnnnnnnnnnnggtggggggntccccnnnnnnnnnnnnnnnngcgggccgcgctcccgccccnnnnnnnnnnnnnnnnnnnnnnnnnnnnngnnnngggagagggaggagag

SEQ ID NO: 50094 - DNA, 771 bp, Zea mays
  misc_feature: Ceres CLONE 1462253-F
  misc_feature: Encodes the peptide sequence at SEQ ID NO. 50095
  misc_feature (328)..(328): n is a, c, t, g, unknown, or other
  misc_feature (363)..(363): n is a, c, t, g, unknown, or other
  misc_feature (455)..(455): n is a, c, t, g, unknown, or other
tggagctccccgcggtggcggccgctctagaactagtggatcccccgggctgcaggaattcgcacgagaccattacctagaacatcctaatcgaaaagaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatncaccaccaccagaagtgccgccacctcgtcgaccnatacctagaggctacccgcggcgtgggttggggcaaggatgcccgcccgccctgactccacgagcccagaaaaacccgtcaggccgaattancggcgctgctgccctggcttcccgggctgctgttcctggattggaaaagtgatctgacccttccatgagttaaaaggaataccccggaaactggggaaatcccccttttaatcctaaagcggggaaaaaactcaaaaaaaactttgcccaaaaaattttggggaggcaaattgttccccccaacttgttttttggaaaacccccaaaagaaaaccctggtgggcctgttttttaaaaaccgcttttaacaagggggggttttgtttttttttttcccggggttttgtcgcggaaaaaaaaaaaaaaagttttttct

SEQ ID NO: 50095 - protein, 92 aa, Zea mays
  misc_feature: Ceres CLONE 1462253-F
  misc_feature (63)..(63): Xaa is any aa, unknown, or other
  misc_feature (75)..(75): Xaa is any aa, unknown, or other
MVRKAKVEFDEQPPDNFDPKNPYADPVAMLEYREHLVREKWIQIETAKIIRERLRWCYRIEGXHHHQKCRHLVDXYLEATRGVGWGKDARPP

SEQ ID NO: 50096 - DNA, 783 bp, Zea mays
  misc_feature: Ceres CLONE 1462256-F
  misc_feature (279)..(279): n is a, c, t, g, unknown, or other
  misc_feature (285)..(285): n is a, c, t, g, unknown, or other
  misc_feature (293)..(293): n is a, c, t, g, unknown, or other
  misc_feature (294)..(294): n is a, c, t, g, unknown, or other
  misc_feature (307)..(307): n is a, c, t, g, unknown, or other
  misc_feature (327)..(327): n is a, c, t, g, unknown, or other
  misc_feature (349)..(349): n is a, c, t, g, unknown, or other
ctccccgcggtggcggccgctctagaactagtggatcccccgggctgcaggaattcgcacgagaccattacctagaacatcctaatcgaaaatttttttttctctctccccgtctgcctcgccctccacaccaggccacgccacacacaggatagcgagcgggagcgacggcggcggcggaggagctagggttttgatccggcctcgccggctaggctgcgccgcctcgacgccgaagccatggacagggagcttctagagacgttttgacgcgccaanaaagcngccgacgnnagcgcaggggacngcaactcgccggaagctggncgcttgctccacgccctgcggnggctgcccaaaattcgggtaaaacggaaatcttcgtttcgacgcaggtggcaaaccccttcaaccccttaataagcttcttccctccgggtatcaagcggttggcgccaacttttttggggacgggaaaaaggtttcccctttaaaaacccggaaaaaaaaaggggcgccccaaaaaaggaaaaaaacaggggccctctccaaaagggttaaaaaagggagcgcccccaaaaaatttaaaaaaattcctccccccacactttaatttttgaaaaaaaaagtgggggtttttgggggccaaacccccccccgtgggcggggtggaaaacaccctcctggggggtgtcccccccctccccgtggggggggggggggggtttcacaaaaaaataattatgctccctctcttaaaaagagccctccccccctctcccc

SEQ ID NO: 50097 - DNA, 769 bp, Zea mays
  misc_feature: Ceres CLONE 1462260-F
  misc_feature: Encodes the peptide sequence at SEQ ID NO. 50098
  misc_feature (371)..(371): n is a, c, t, g, unknown, or other
  misc_feature (422)..(422): n is a, c, t, g, unknown, or other
aagctggagctccccgcggtggcggccgctctagaactagtggatcccccgggctgcaggaattcgcacgagaccattacctagaacatcctaatcgaaaaacgagcccttctcgtcctcagatctagcgcctccttcaccctgctgctggccggcgagctcctcagcgtgcaagatcaggaagaagacaaaaaaacgttatagtgaagaggaggggttgattgctgcattcaaaagtgtcggggataccttatccaatgctactgagaaggttgccacaggggacaccagatgatcttttttgatagtttgataaacctttcaggttttgagcagacccacatatctctgtatttcaattatctggtggngcaccctcacattgctagagccttcaacaagttgccattcgaccacaagtnaacccggcctcgcaatttcgtcagtgaaaactttctaggagtgtgagggcacctggaaggtaggcttgaagggttcttttgcttgaaccacttgaacatgaactgtgatctatgtgtaaccaggagtgtgagggcagctagaaaataggcttggaagggttcttttgcttcgactacttcaaaccatgaaatgtggtcctaatatgtcaacgaattttgcttgaacatgcaaatttgggggaagccttaaacttgaaaagaaaaaaaaaaaggcttaccgaaaccgtccaactccgggggggggccgggaacccaatttccccctaaagggaatctaatacccccgc

SEQ ID NO: 50098 - protein, 58 aa, Zea mays
  misc_feature: Ceres CLONE 1462260-F
  misc_feature (27)..(27): Xaa is any aa, unknown, or other
  misc_feature (44)..(44): Xaa is any aa, unknown, or other
MIFFDSLINLSGFEQTHISLYFNYLVXHPHIARAFNKLPFDHKXTRPRNFVSENFLGV

SEQ ID NO: 50099 - DNA, 725 bp, Zea mays
  misc_feature: Ceres CLONE 1462270-F
  misc_feature (679)..(679): n is a, c, t, g, unknown, or other
ggagctccccgcggtggcggccgctctagaactagtggatcccccgggctgcaggaattcgcacgagaccattacctagaacatcctaatcgaaaactgaggcctccaaatgtggatccagtcataccttctccagatctgttgtcctctcacctaggtgggcttcgtcttgccactagtctcctcctcgggctcgtcggtgcagccgcggtgggcgcgacttgcggcgtgcagaagaagcggaggctcggctggtgttggtactagaggaggaggaggcgagttcttaaaagatgatggaggggagatagactaggaccaccaacatctgcacgaggtggtgaatgggttccctaggagcttctccatcggctggcgtttcagctcccgcaagtcgcactcggaagtggatttcatttaccctttctcctcagggtggccctcgatctagagacaacgtctatctccagcgagagcgataccgttgaggcgcctatccgctccggacacaacgtccgcagtgatgggcaacctccagggcctgaacggtgccaccgtaggcttctcggtggccggcagcacggaggaggcgactgaagaggaggacatgcgggactgcgagggatgcgctcgccgatggccaaagtcggggctgaagcgctgagctggggctgtgcancgccgagaagatggaggcgaagcgagtcactccatcacgctgtgca

SEQ ID NO: 50100 - DNA, 819 bp, Zea mays
  misc_feature: Ceres CLONE 1462272-F
  misc_feature: Encodes the peptide sequence at SEQ ID NO. 50101
  misc_feature (367)..(367): n is a, c, t, g, unknown, or other
  misc_feature (819)..(819): n is a, c, t, g, unknown, or other
ccccgcggtggcggccgctctatcaatagtggatcccccgggctgcaggaattcgcacgagaccattacctagaacatcctaatcgaaaaagaagatggtgcgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgaggggcatcaccccaaccagaagtgccgccacctcgtcgaccaatacctaaaaggctacccgcgggcgtggggtgggggaaggtattcccncccggcttggactcccccaaccccaaaaaagactgtgaactgcccaaaaaacggggcttgtggccttggttttttgggccgtctgtctcctgggattggagaggggaaaccggacccttttcctttgaatttaaacggaataaccccgggaaatgggggggaagccccctctttataatgtttcaaacctttggatatcaattttttccaattaattttttggtactaaaaaaaaattctattgtggggggaataagttgtttctcctcccgcgctttggttacatgtgaccatacgtttaatatatggaacctcccggggtgttcttctttgtgtgtcaccaatattatcttttttcatcaaaggggggcgctttcgcgctcccactaatattcggcgtaaagactcgttgtctttgtgaggaaatctacaagtacgccgccttttgtttn

SEQ ID NO: 50101 - protein, 149 aa, Zea mays
  misc_feature: Ceres CLONE 1462272-F
  misc_feature (91)..(91): Xaa is any aa, unknown, or other
MVRKAKVEFDEQPPDNFDPKNPYADPVAMLEYREHLVREKWIQIETAKIIRERLRWCYRIEGHHPNQKCRHLVDQYLKGYPRAWGGGRYSXPAWTPPTPKKTVNCPKNGACGLGFLGRLSPGIGEGKPDPFPLNLNGITPGNGGEAPSL

SEQ ID NO: 50102 - DNA, 795 bp, Zea mays
  misc_feature: Ceres CLONE 1462276-F
  misc_feature (71)..(71): n is a, c, t, g, unknown, or other
  misc_feature (73)..(73): n is a, c, t, g, unknown, or other
  misc_feature (238)..(238): n is a, c, t, g, unknown, or other
  misc_feature (339)..(339): n is a, c, t, g, unknown, or other
  misc_feature (373)..(373): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (428)..(428): n is a, c, t, g, unknown, or other
tactgctggagctccccgcggtggcggccgctctagactagtggatcccccgggctgcaggaattcccacnanaccattacctagaacatcctaatcgaaaaagaaaggaaagcggtgcgagcggaggaggcaaccaaagcgcctcttgcttgattagcgaagcgcgagagcagtggcgtccctgtcgtgcgcctccacgctgccctggacccccgcctcctacccgcggccctcggnggggtgctgcctcccggcctctcgccggggtccgtcgctggtctttttcccccaggggagggggaagaactcccgccaggtttttttgacaaccaacttanaataggcgggcaaaaattttttttcccccttttnagagggaaaagaaaaggggcccccccttctttctttnnnncccccccccccctanccacaaaaaaaaaaaaatcttttccctcgagtgggggggggggcgctagaagaatttccaccttcaagacccccccaccccataagataacctctcccccccctagtccctatttccctctccgccctcccgcgtttttgcttaaccccccccccagcgcgcgcggcaccgttggccccccacggtcctccctttctacctctcccgtgccccccgcacctatccattgttagggtgcgcggccctctatatatgccccgccccccccctttacctacgctgtctatgtcgccgcgctcccccgccccatatatatggtcaccgcccagcgctcccattggcctgtacccgtccgcccttgttcttg

SEQ ID NO: 50103 - DNA, 829 bp, Zea mays
  misc_feature: Ceres CLONE 1462281-F
  misc_feature: Encodes the peptide sequence at SEQ ID NO. 50104
  misc_feature (27)..(27): n is a, c, t, g, unknown, or other
  misc_feature (28)..(28): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
aaataatcttccccatatacaccgtcnntcnnnnncggaaacccccaaactggagctccccgcggtggcggccgctctttaatagtggatcccccgggctgcaggatttcgcacaagaccattacctaggaacatcctgatctaaaaataataaatcgaggcctttttctaagagggaggacgcaaggggaacgggcgaaaaacggtcaaccagggcgatggcgcagtatccccctccctgccctcccgttgctcagatccgaagccattaaaaccaacggatctcacctcggggagcggccgccccatattgacaactgagagggaaaacccgcagacattagatgagatgcgaagggaagaaacctaaaggagctggtcctaaggggctggcaagcggagggatagcgctggggacacaaaatacagggggcgcaccaaaggggaggtaacccccccctcttcggagcgaacttcgcgggggaggggagcccggaaccccccacccaagcaagatcccagaaactcttctaaatatgccctctgcctgccgccaaccacgaaggcgggaaaaaggtggaagccgctccttcccacgagggaggggggtcggggcaccctgggatcaagaagggggcggccactcaatgccgtcgaaaggcggaaagggtaaaaccccgatgcgatgttggttttcccagggcacgccagggtataaaaaccccggcccgtcatatatggatcaaccattggggggcaggagcgggggaattgttgtaccagtggagaaataagcacggattttgaaggtggcgggcgctatattttt

SEQ ID NO: 50104 - protein, 35 aa, Zea mays
  misc_feature: Ceres CLONE 1462281-F
MRCEGKKPKGAGPKGLASGGIALGTQNTGGAPKGR

SEQ ID NO: 50105 - DNA, 733 bp, Zea mays
  misc_feature: Ceres CLONE 1462286-F
  misc_feature: Translation starting site: 297
  misc_feature (376)..(376): n is a, c, t, g, unknown, or other
  misc_feature (412)..(412): n is a, c, t, g, unknown, or other
  misc_feature (413)..(413): n is a, c, t, g, unknown, or other
  misc_feature (423)..(423): n is a, c, t, g, unknown, or other
  misc_feature (637)..(637): n is a, c, t, g, unknown, or other
  misc_feature (645)..(645): n is a, c, t, g, unknown, or other
  misc_feature (686)..(686): n is a, c, t, g, unknown, or other
aagctggagctccccgcggtggcggccgctctagaactagtggatcccccgggctgcaggaattcgcacgagaccattacctagaacatcctaatcgaaaaaacgtcttgggtcgtgctcgtgcagctctaggctttttttgaggaatcggtaagcgcggagggaggacgggagagagagataggcgtgccttcgtcgtccgtgccggcgcgtggcgtggtggccgtgccgaccgtccgtccaccccctctcctcttcccggcgccggcgacagcgggagggactccctgggaggaatggccgtggtgagggctccgctcggcgcggtggcggtggccgctctcggcgtcgccatcttcatgccgggggtgggagnggcgcaggcaccggtgtccgcgcccaccagcgaccnnccattgtgcnacctgggggatcgcggacatccttatgctgggggccctggggctcccctaccagaaccacccgctggaagcggcctccccctacaagctcttttaatttcggctcgttttcgtttgggtttgggggtgtcgggtgataataggaattcccggtcgcccgagatggttaagtgaggctgggggggtttcgaattgtttaggattaggattatttnattttggngagtttcctggggattaaaaccctggctttcccccgtgggnttcgggatggaaagaaaagccccatcttccttcgggctaaatgcgca

SEQ ID NO: 50106 - DNA, 706 bp, Zea mays
  misc_feature: Ceres CLONE 1462289-F
  misc_feature: Encodes the peptide sequence at SEQ ID NO. 50107
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
cccccgggctgcaggaattcgcacgagaccattacctagaacatcctaatcgaaaaataagagcttctgagtctagacactagatacagtaagccttagcaccaacagaggttagtatctcaacaaggatacttcaaatatgtccgcctcacgcagctcctctcccaactccatctcacagtggagccagaaagagaacaagatgtttgaagaggcactcgcatactacggcgagggcacatccaaccggtgggacaaggtgtccagagccatgggaggcatcaagtctgctgaggaggtgcgctgccactatgaagatcttgagtannnacccaagatgattgaatcatgccacgtgccttagggcacccccaagacacatggattctggaccttgagttgaaatgttcgacggctcacgggaggcagaaaacaaggctctatcgaatctaagagggacctaggcccttgagggaagccaagaaattcacccctgggtgggaaaataaaatgatgaaaacggggtgcatatgtatgagataagcttatgagccagttttatgttatcccggcgggtagtaaggattaactggaaccgtccccggctggcacgattttgttttcttcccccggatcgcaggttatttgccggatggaaagccccgtggtcacgcgactgaatacctaaaaaaagttataatcgtct

SEQ ID NO: 50107 - protein, 74 aa, Zea mays
  misc_feature: Ceres CLONE 1462289-F
  misc_feature (63)..(63): Xaa is any aa, unknown, or other
  misc_feature (64)..(64): Xaa is any aa, unknown, or other
MSASRSSSPNSISQWSQKENKMFEEALAYYGEGTSNRWDKVSRAMGGIKSAEEVRCHYEDLEXXPKMIESCHVP

SEQ ID NO: 50108 - DNA, 715 bp, Zea mays
  misc_feature: Ceres CLONE 1462294-F
  misc_feature: Encodes the peptide sequence at SEQ ID NO. 50109
  misc_feature (407)..(407): n is a, c, t, g, unknown, or other
  misc_feature (410)..(410): n is a, c, t, g, unknown, or other
  misc_feature (715)..(715): n is a, c, t, g, unknown, or other
tggagctccccgcggtggcggccgctctagaactagtggatcccccgggctgcaggaattcgcacgagaccattacctagaacatcctaatcgaaaaacccatggcactggcatccccctctctccctctccccaccacaccacctccctcctcacaagccatagccgccgcctctttctgtgcttgccctctcgccatcttcgagtacgacgagaaggcggtgatggagctggacgagcaggccttcctggaggagatcctctccctgcggagggacgcctgggactgcaatgccatgggggacttcttcgccccggccgccatggactgcaccttccaggaccgccaccaccaggcgcccaccgtcagcgtcctccccaccttcaccgcctcctacccccacccncanccgcagccggcggcggcgcccggcttcgactgcctcagcgaggtctacggcgccgccgcgttcggcgggcccaatgctggtgactacggcggcgagatggggttccttgacgtcgtcgagcccaaggcggcgtcggcggcactggtggacggcgccgcgggcctcggggcctgcaaggtggagcccggcctgaccgagagcggcggcccgttcggcgctggcgctggcgctgccccgccgccggcccctgcgtccaaaaagaagagggtcgagggggagcccgtccaagaacctgatggccgagn

SEQ ID NO: 50109 - protein, 204 aa, Zea mays
  misc_feature: Ceres CLONE 1462294-F
  misc_feature (103)..(103): Xaa is any aa, unknown, or other
MALASPSLPLPTTPPPSSQAIAAASFCACPLAIFEYDEKAVMELDEQAFLEEILSLRRDAWDCNAMGDFFAPAAMDCTFQDRHHQAPTVSVLPTFTASYPHPXPQPAAAPGFDCLSEVYGAAAFGGPNAGDYGGEMGFLDVVEPKAASAALVDGAAGLGACKVEPGLTESGGPFGAGAGAAPPPAPASKKKRVEGEPVQEPDGR

SEQ ID NO: 50110 - DNA, 720 bp, Zea mays
  misc_feature: Ceres CLONE 1462303-F
  misc_feature: Translation starting site: 204
  misc_feature (383)..(383): n is a, c, t, g, unknown, or other
tccccgcggtggcggccgctctagaactagtggatcccccgggctgcaggaattcgcacgagaccattacctagaacatcctaatcgaaaaagcttcgtcatccctcgtcgtcggattgtacgctccagctctccaagatttgccttggcttgccgtgccctgcgggagccaagccaaggacggctagcgctcgccacgcgcgatgtccgggcttcctccggccgcgcgaccgccgctaccgtctccctgcgcctcttcctccgttgttcgggcgaaggtagcgtcggcatgctgctccagcctaaagcagtcgcgcccaggccgaagtgctgccgcgccttctgtcgtcgttgtgttgtaagacgagccggtcttgacaacngcattcctccccaacattttcacccaaaaggctgcctgctgctattctcaccagaattttgaaagccagtttcaaaaggtgcatcgttggtccggaggggttgaatcggttgccacgacatggaaggaaaacccctataaccgggaaacactcatttacctgaaggacctccagagaaacggacttgccccggaaggaggaattgtcccccccccccccccatgtgaaacggaaaaatgtcccggttttcgaaaaaaaaatcccccccaaagaggatctggttaccttcccgccccccggctcgtcggaaggacgaaacgcaaggttcctttgctta

SEQ ID NO: 50111 - DNA, 688 bp, Zea mays
  misc_feature: Ceres CLONE 1462304-F
  misc_feature: Encodes the peptide sequence at SEQ ID NO. 50112
  misc_feature (450)..(450): n is a, c, t, g, unknown, or other
  misc_feature (688)..(688): n is a, c, t, g, unknown, or other
aaagctggagctccccgcggtggcggccgctcttgaactagtggatcccccgggctgcaggaattcgcacgagaccattacctagaacatcctaatcgaaaaacgtttttcacccggccgcctcgggggctcagggctcaggcaggccgataccctccccaatccccaccggcaccgaggcgctggccgacgaggccagcatgaagccgcgggcgctcctggagcgcctggcccgccccttctcctcctcccgccgctcctcctccgaccagtcccgccgcgacagggaggaggaggcggacctggaggcgatcgcggcgcgggagcagcgcgcgttcaggtacgagaccctggcggcggcgacgcggagcttctccgagaagaaccggctcgggcagggcggccccccccttttctaccggggccgcctggaggacggccgcgacgtcnccgtcaagcgcctgggcgccggctcgcggcagggcgcccgggagttccgcaacgaggccacgctgctgtcccgcgtgcagcaccgcaacgtggtcaacctcatcggctactgcgcccgcggggcggaggacaagctgctggtgtacgagtacgtgccccacgaagacccttgaaaagatcctcttctcctcctcctcttccggccggtgagaggccccctcccttccttcctttctcn

SEQ ID NO: 50112 - protein, 140 aa, Zea mays
  misc_feature: Ceres CLONE 1462304-F
  misc_feature: SWISSPROT Homolog: EC 2.7.11.1 Non-specific serine/threonine protein kinase
  misc_feature (84)..(84): Xaa is any aa, unknown, or other
MKPRALLERLARPFSSSRRSSSDQSRRDREEEADLEAIAAREQRAFRYETLAAATRSFSEKNRLGQGGPPLFYRGRLEDGRDVXVKRLGAGSRQGAREFRNEATLLSRVQHRNVVNLIGYCARGAEDKLLVYEYVPHEDP

SEQ ID NO: 50113 - DNA, 773 bp, Zea mays
  misc_feature: Ceres CLONE 1462309-F
  misc_feature (1)..(1): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (399)..(399): n is a, c, t, g, unknown, or other
  misc_feature (417)..(417): n is a, c, t, g, unknown, or other
naactctggagctccccgcggtggcggccgctctagaactagtggatcccccgggctgcaggaattcgcacgagaccattacctagaacatcctaatcgaaaaactactctctctctctgcctgcaaagctgcttgatccatcatcgatcacatcactccaccagccgcagcgcaggaacgtacgactcatggcagatcgcgaccgcagcggcatctacggggggggcgcctacgggcagcagcaggggggcggcccccccatgggtgaccagggaagggcatgatcccccacaaggggccgaaggggtccctggcgctttatgtggcaaccctgtccccccgggggggctgctctttttttccccccccccgggggaagaagggggaannnnnnaaancctttcacaccccccatntagtaaaaaaacaataatttttaatgcggggggggggtggcaacagcgttccggggtccccccgcgggggggatgtgctcgacgcatacaccctacaatggtgcaacacaggggggctgagggtttcggtacaccccagaacccgcacaagaatctactccaggtgttcgcgccccctatattccacacccccccatttcccaccaccgcacacttcaccccctcgttatccccccccttccccaccctccgagacacgcatatcccagctcaaagcataaagacctcgctctgtcgtgctctcctccttcctgccaagctcacacctcccttcgtgggggctctagtgacctgtc

SEQ ID NO: 50114 - DNA, 696 bp, Zea mays
  misc_feature: Ceres CLONE 1462312-F
  misc_feature: Encodes the peptide sequence at SEQ ID NO. 50115
ggagctccccgcggtggcggccgctctagaactagtggatcccccgggctgcaggaattcgcacgagaccattacctagaacatcctaatcgaaaaatcctttgctcctcttcaaacgctcgagaaagagagagagactaaatcctccctcgaaaccctagcatagccactgccttcccgcacgctaggaaggggaagatatgggcgccgaggaggacgccgctgcacgccgcgagcgtctccgcgccctccgtgccgccaaggacctcctctccacccccgacggcgccccaaccccttccaccgacggagaacaccaaaatggcaaccatgagatggcagaagagccagaattaccaggtcatcaggatgcacctggtgaggctgctaaagaggatggtagccccactgaggaggccgaagaggttgaagatgatggtgagcttccagccatgaagttcagaaactaccttccccatgatgaacaacttcgaggaggcaagctggctccagtgtctcttccccagtttgaagacccatttagtgccgaaactgcagagccaaaggaagtggagaacctttttggaaacatagcacccaggaacccaaatggggatctgaaacctgatgggcaaaaaaaaattgataaactggaaggggcccccccaaaaggttgggtgaaaatggccttggaaa

SEQ ID NO: 50115 - protein, 165 aa, Zea mays
  misc_feature: Ceres CLONE 1462312-F
  misc_feature (4)..(163): Pfam Name: cwf18 Pfam Description: cwf18 pre-mRNA splicing factor
MGAEEDAAARRERLRALRAAKDLLSTPDGAPTPSTDGEHQNGNHEMAEEPELPGHQDAPGEAAKEDGSPTEEAEEVEDDGELPAMKFRNYLPHDEQLRGGKLAPVSLPQFEDPFSAETAEPKEVENLFGNIAPRNPNGDLKPDGQKKIDKLEGAPPKGWVKMALE

SEQ ID NO: 50116 - DNA, 728 bp, Zea mays
  misc_feature: Ceres CLONE 1462313-F
  misc_feature: Encodes the peptide sequence at SEQ ID NO. 50117
  misc_feature (291)..(291): n is a, c, t, g, unknown, or other
ctggagctccccgcggtggcggccgctctagaactagtggatcccccgggctgcaggaattcgcacgagaccattacctagaacatcctaatcgaaaagtgtccccctcgtttccgctcttctgctcctcgcgccgccgcagcgacccgacgacaggtaatggcttccgccgcggtgctccggaacgccggatctcgccgcctcttctcctaccccaccctccgtgctgctgcaatctcgggacccgccgtgctaccagatgcgcccgtggcggcgtcggtggcggcccanccgcccccgctggcctggacactctgggcgatgtccatggccaccttcaccgcacgaggccccatgtgacgtcggcaccctgggcacgtcgatcacgcaaaaccgttcccccccccttttccaagggaatttcctcccgggaattgcttgcaaagagcttaggggccaattcccccccttggccccccccagggggacgggaaaaactgcaaaagggggggtggggaaaaccctaagggcccccccctaaaaaaaaatttcaaccgggcccccaaggggggatttttttaaaaccttggtttcagggttttttgtaaaaaaacctcccccccccccccaagagattgtttaaagagggcgccaaaaccttttttccggggtgtttttttttttgtgggggggggtggctctccacgccccggggttggtctctctag

SEQ ID NO: 50117 - protein, 66 aa, Zea mays
  misc_feature: Ceres CLONE 1462313-F
  misc_feature (44)..(44): Xaa is any aa, unknown, or other
MASAAVLRNAGSRRLFSYPTLRAAAISGPAVLPDAPVAASVAAXPPPLAWTLWAMSMATFTARGPM

SEQ ID NO: 50118 - DNA, 767 bp, Zea mays
  misc_feature: Ceres CLONE 1462323-F
  misc_feature: Encodes the peptide sequence at SEQ ID NO. 50119
  misc_feature (1)..(1): n is a, c, t, g, unknown, or other
  misc_feature (322)..(322): n is a, c, t, g, unknown, or other
  misc_feature (403)..(403): n is a, c, t, g, unknown, or other
  misc_feature (404)..(404): n is a, c, t, g, unknown, or other
  misc_feature (762)..(762): n is a, c, t, g, unknown, or other
nactagctggagctccccgcggtggcggccgctctagaactagtggatcccccgggctgcaggaattcgcacgagaccattacctagaacatcctaatcgaaaaattctgcagtatggctcgccgactctgccgtctccctcgcctctttcccctcgtctcgtctgcatccgccgccgccgccccaagacctcatcacctccccttcgccgtgaaccctaaccccgcgcccctcgccccctccttctcgtcgtcatcgccgcccgcttttccgggcccccatcgcctcttctcttccacgagtgggtcaagcatggtggtcntgggctccccttactccttcaacagcatcttttcaaaggggccagattattagctaccaccaggcggggaggggggcgccnnccctgctgtgtattatgtcaccccaatgtcccctttagtataaaaaaataacccgccaccatccccagaaaccagtgtacaaagctgacattgaatgtgaaggggtgggaaatcaactccgtgatcctcacatatgggcaaaggccacctctccactttattccgagggggacaaaataaggcaaccgcggggcgccgaccaaagaaaataagactgccccggaaaggctccacaggcggcgaggagccctaaaaaaaaccccccccgcccggggggggaagggcaagcctccccgcaaaaaaagctctcccctcacctccacctgcgaggcgagaccggcatacaattgtcactccncgccg

SEQ ID NO: 50119 - protein, 86 aa, Zea mays
  misc_feature: Ceres CLONE 1462323-F
  misc_feature (70)..(70): Xaa is any aa, unknown, or other
MARRLCRLPRLFPLVSSASAAAAPRPHHLPFAVNPNPAPLAPSFSSSSPPAFPGPHRLFSSTSGSSMVVXGSPYSFNSIFSKGPDY

SEQ ID NO: 50120 - DNA, 764 bp, Zea mays
  misc_feature: Ceres CLONE 1462324-F
  misc_feature: Encodes the peptide sequence at SEQ ID NO. 50121
aaagctggagctccccgcggtggcggccgctctagaactagtggatcccccgggctgcaggaattcgcacgagaccattacctagaacatcctaatcgaaaaagtgcagcgcacaacgcaccgttctcgaaactcacgacccctctgtctcgtctcgccgcaacctcatcctatccgtctcaccctcatccccgtttaatatataccgttccgccgttcgtcccctctggccctctctccatccccagcccacgaccctccgccaccagccatcgtctgcatcagatctcccgcccgtccgttacatcccagggcgacgcggccgcggccatgacgccatcctcagctctcgccctcgcgcaccacgccgcggtatccccgctcccgtcctccacgccgcggccctcccccaggtccagctctctgagcctgggcccgggctccgccgggctcgggccgcgccggctcgtcgcggcggcgcccccacgggcgttcttctcctcgtccccctaccagccgccccagccggaggggttctcgcagcaccgcgagtacggtctggtccccatggtcatcgagaccacctcccgcggggagcgcgcctacgacatcttctcgcgcctgctcaaggagcgcatcgtctgcatccacgggcccatcgccgacgacacggcctcgcttgtcgtcgcgcagctgctcttcctcgagtccgagaacccgctcaagcccgtccacctctacatcaactcccccgggggcgtcgt

SEQ ID NO: 50121 - protein, 144 aa, Zea mays
  misc_feature: Ceres CLONE 1462324-F
  misc_feature (86)..(144): Pfam Name: CLP_protease Pfam Description: Clp protease
  misc_feature: SWISSPROT Homolog: EC 3.4.21.92 Endopeptidase Clp
MTPSSALALAHHAAVSPLPSSTPRPSPRSSSLSLGPGSAGLGPRRLVAAAPPRAFFSSSPYQPPQPEGFSQHREYGLVPMVIETTSRGERAYDIFSRLLKERIVCIHGPIADDTASLVVAQLLFLESENPLKPVHLYINSPGGV

SEQ ID NO: 50122 - DNA, 762 bp, Zea mays
  misc_feature: Ceres CLONE 1462329-F
  misc_feature: Encodes the peptide sequence at SEQ ID NO. 50123
  misc_feature (505)..(505): n is a, c, t, g, unknown, or other
  misc_feature (506)..(506): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaaccagccggtgttggtttcagcttgtattcccactctgtcgcacagcgtcgcccgtcgccgctgagatcctaggaagaaatggagctctctcgcaagctcttcacggccgtcctcctcgtcatgctgctgctgctgtccgcagaggtcgggccggtggcggtggcggaggcgcggacgtgccagtcgcagagccacaggttccggggcccctgcctccgccggtccaactgcgccaacgtctgcaggaccgaggggttccccggcggcaggtgccgcggcttccgccgccgctgcttctgcaccacgcactgccactgattcgctcgcccagcggccggctggcgtcgccgtcgatcgcgtcgcgaccagtccatgggctcatgcatgaataacagggtgtgcnncgtttgtgttgtgatgccaaattgtatcctccgtcttgggtgaagcaccggcctgctgttgaacgtacgtctgcctctgttccatgttcgggattttcatancaaatgctggctccattcgaaatcaaaaaaaaaaaaaaaagcctttccatcccccccacctcggggggggggcccgggacccattcccccttaagggggccatttagccccgccctgggcgccgtttttaaacgccgggagtggaaaaacctgt

SEQ ID NO: 50123 - protein, 79 aa, Zea mays; identical to SEQ ID NO: 41078
  misc_feature: Ceres CLONE 1462329-F
  misc_feature (32)..(78): Pfam Name: Gamma-thionin Pfam Description: Gamma-thionin family

SEQ ID NO: 50124 - DNA, 746 bp, Zea mays
  misc_feature: Ceres CLONE 1462330-F
  misc_feature: Encodes the peptide sequence at SEQ ID NO. 50125
  misc_feature (297)..(297): n is a, c, t, g, unknown, or other
  misc_feature (354)..(354): n is a, c, t, g, unknown, or other
  misc_feature (359)..(359): n is a, c, t, g, unknown, or other
  misc_feature (373)..(373): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
aaagctggagctccccgcggtggcggccgctctagaactagtggatcccccgggctgcaggaattcgcacgagaccattacctagaacatcctaatcgaaaaaccacgctgtgagtgactcggtcgcatcttccccattctccatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcanggagccctttcagtctgaggccgcgtcccgcgagaagggtcatttctccatttccangtggnacgatggcaagcangaaaaagccactgtcccgcacagatcggatgaccaagggctggcgcatggggaattagtcttcctacaaatgaattgaacgcgccttgcaagttccgggactgttattaattgggctgattggaaccaagcggaaaaaaaaaacttttgggaaagggctttaaaaggccggggtttccgggaatgcctccccccaaaggggaaagtgagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 50125 - protein, 84 aa, Zea mays
  misc_feature: Ceres CLONE 1462330-F
  misc_feature (9)..(57): Pfam Name: ATP-synt_Eps Pfam Description: Mitochondrial ATP synthase epsilon chain
  misc_feature (34)..(34): Xaa is any aa, unknown, or other
  misc_feature (53)..(53): Xaa is any aa, unknown, or other
  misc_feature (55)..(55): Xaa is any aa, unknown, or other
  misc_feature (59)..(59): Xaa is any aa, unknown, or other
MSATTAAVPFWRAAGMTYIGYSNICAALVRNCLXEPFQSEAASREKGHFSISXWXDGKXEKATVPHRSDDQGLAHGELVFLQMN

SEQ ID NO: 50126 - DNA, 790 bp, Zea mays
  misc_feature: Ceres CLONE 1462332-F
  misc_feature: Encodes the peptide sequence at SEQ ID NO. 50127
  misc_feature (338)..(338): n is a, c, t, g, unknown, or other
  misc_feature (411)..(411): n is a, c, t, g, unknown, or other
  misc_feature (749)..(749): n is a, c, t, g, unknown, or other
aagctggagctccccgcggtggcggccgctctagaactagtggatcccccgggctgcaggaattcgcacgagaccattacctagaacatcctaatcgaaaagttcgctaaacctcgcgcacagaaacacaagcgagtaccagagcagctaggagtggtcagcaatggcgcagcttaaagcagccgccgacgagcagcaggaggcggcgctgcacggcgtcgcctccggcggcgggaacgagagcaacaagaaggcgcgcgcggggctctgcggcctgctccgcgagcgcaaggtggtggacctggcgcgggccaagcggcggctggtggaggttcccntacacgcgacgctggcgcacacggccaacgcgctcctggcagcgcgcgtctctgccgctgctgcagccctggnccgcgcatcagcgtgatggagttcaagaggaatgtggctgagtaccgcgcgagcccaggcttggggtccccgggcgcaaccccacggaactggcaccctgtcgccgggaacccgaaccccccgggttgccgcccccccttgacaaaaacaaaaccagcccccgggatccgcccttggaactttctcccagagaaacaccccccgggagggaatagagggggggaaaatcaaaacccctgccacgcggtttggggggggccaaaaagaaaaggccccctggcggggggggggtgcccccccccaaaccccccgggggagggggggggggcccctccccngaagacactggtttccccacattttggcgcggggggcccgg

SEQ ID NO: 50127 - protein, 87 aa, Zea mays
  misc_feature: Ceres CLONE 1462332-F
  misc_feature (59)..(59): Xaa is any aa, unknown, or other
  misc_feature (83)..(83): Xaa is any aa, unknown, or other
MAQLKAAADEQQEAALHGVASGGGNESNKKARAGLCGLLRERKVVDLARAKRRLVEVPXHATLAHTANALLAARVSAAAAALXRASA

SEQ ID NO: 50128 - DNA, 737 bp, Zea mays
  misc_feature: Ceres CLONE 1462338-F
  misc_feature: Encodes the peptide sequence at SEQ ID NO. 50129
  misc_feature (647)..(647): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (727)..(727): n is a, c, t, g, unknown, or other
aagctggagctccccgcggtggcggccgctctagaactagtggatcccccgggctgcaggaattcgcacgagaccattacctagaacatcctaatcgaaaactcttgctcataccgcgacgctctatctctttcgccgagctcctcgaaaccctaggagcgtgcttgaccggcggcggcgaggtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccgtccgccattgccggcaagctcggatctctccctttccaggcctgcgagcatcagatcgtcaccgtcgactgccagccatcgggtccccagggaggcatgctcgtcttcgtctccggttccatacgcaccggcccccgagagcaccccatcaagttctcccaggcattccatttgctgccggccgctgggtccttcttcgtgcagaatgacatgttccgcctgaactatggctaaagacagccgatactcttgtgatgaaggaattgatttagggtttcatgttgaaacgatgaatacttaatggtgccgctactctgggcnccttttgtaacttctatggtggctggctccactgaatacagaaaatgcnnnnannnaaaaaaagnnncaagtgtnnnntntaattctggt

SEQ ID NO: 50129 - protein, 124 aa, Zea mays
  misc_feature: Ceres CLONE 1462338-F
  misc_feature (8)..(121): Pfam Name: NTF2 Pfam Description: Nuclear transport factor 2 (NTF2) domain
MAMDPDAVAKAFVEHYYRTFDTNRAALVGLYQETSMLTFEGQKFQGPSAIAGKLGSLPFQACEHQIVTVDCQPSGPQGGMLVFVSGSIRTGPREHPIKFSQAFHLLPAAGSFFVQNDMFRLNYG

SEQ ID NO: 50130 - DNA, 760 bp, Zea mays
  misc_feature: Ceres CLONE 1462344-F
  misc_feature: Encodes the peptide sequence at SEQ ID NO. 50131
  misc_feature (1)..(1): n is a, c, t, g, unknown, or other
  misc_feature (375)..(375): n is a, c, t, g, unknown, or other
  misc_feature (636)..(636): n is a, c, t, g, unknown, or other
naaagctggagctccccgcggtggcggccgctctagaactagtggatcccccgggctgcaggaattcgcacgagaccattacctagaacatcctaatcgaaaaaatcaacctgccgccgcccgccagcaccaaacttccatccgccccgagctctgcctccgccgccgccgcgccatgaggcctctcgacgagaaggagacgactcaggtattcgagaagctgttcaagttcacggggcccaacctgaagcacctcctggagcgccccgcagtggagggccccgacgcggagcccggccgctactgcctccggcttcaccgcaatcgcgtctactacgcctccgaggcgctcgtgcgccgcgccacccgcgtgtnccgaccgcgcctcgccgggcgtggggacgcccatcggcaaagtcaccccacacgggcgcgtcccaccttagggtcagggcgctcgaccctcttggtggccaacccgcggcgcccggttttggttcaaacccgaaaccgaggggtcctttcctttttggaaattccctggccaaaatttttcttccttggaaaacccgaaacaccaaaggccggggaaggggggggcccatggtccggggggaaacccccccccggggtccnttttgcggggggggccccaaatttttggaggaggccccccccccccccctcttgtgccacccctgagccgggggggaaccccccccggggaggaacactttggggggagacccaaattgtgggg

SEQ ID NO: 50131 - protein, 195 aa, Zea mays
  misc_feature: Ceres CLONE 1462344-F
  misc_feature (67)..(67): Xaa is any aa, unknown, or other
  misc_feature (154)..(154): Xaa is any aa, unknown, or other
MRPLDEKETTQVFEKLFKFTGPNLKHLLERPAVEGPDAEPGRYCLRLHRNRVYYASEALVRRATRVXRPRLAGRGDAHRQSHPTRARPTLGSGRSTLLVANPRRPVLVQTRNRGVLSFLEIPWPKFFFLGKPETPKAGEGGGPWSGGKPPPGVXFAGGAPNFWRRPPPPPSCATPEPGGNPPRGGTLWGETQIVG

SEQ ID NO: 50132 - DNA, 777 bp, Zea mays
  misc_feature: Ceres CLONE 1462347-F
aaagctggagctccccgcggtggcggccgctctagaactagtggatcccccgggctgcaggaattcgcacgagaccattacctagaacatcctaatcgaaaaaagacgatctgcgaaacaaacactaggtccgtttgcgagacaaacccaaaaagacaagctacaaagtcactgaccgaccgctatggcctctaggcagaacactcatgaggagcgcgcctaggccgacgcgcggcgcgccttgcattgactagctcgggcgcggaaccagcacctctagaaggcggaggtgaacgcccgctcggccgcggacgagatcacgcgctcccacaccgaccacgatgccaccggtggcgacgacctcctggagagcgtgcaggacggctccaggtccttggccagcgccttgggccgcaccttcggaggcgccaaggactccaccgtggacaagacctcgcacaccgcgcacaccacgggcgacaagctctgcaagtacagggactacaccaccaacaaggcccgggaggccaacgactccgtctcgcgtaggaccggcgacaccgcgagaagccacccggaacaacctgggcgagtacaaatacagcaccgtggagaacgcgacggagaccaacgacacgacggctccgaatacgacctagacatcgtacgcgaccagaacaagctcgtcgagtacaacgacacgctcgcgatcaacgcaccttaggcagccgacaccaccgcctgctaggcgagggacgtcaacgacgcgacgatgca

SEQ ID NO: 50133 - DNA, 770 bp, Zea mays
  misc_feature: Ceres CLONE 1462351-F
  misc_feature: Encodes the peptide sequence at SEQ ID NO. 50134
  misc_feature (406)..(406): n is a, c, t, g, unknown, or other
  misc_feature (412)..(412): n is a, c, t, g, unknown, or other
  misc_feature (575)..(575): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (626)..(626): n is a, c, t, g, unknown, or other
  misc_feature (650)..(650): n is a, c, t, g, unknown, or other
  misc_feature (667)..(667): n is a, c, t, g, unknown, or other
  misc_feature (704)..(704): n is a, c, t, g, unknown, or other
aagctggagctccccgcggtggcggccgctctatactagtggatcccccgggctgcaggaattcgcacgagaccattacctagaacatcctaatcgaaaaatcggcattcagcagccacctcttaccaccccaacgtgatggcggtgagcaacaacatcacggcatgcgtgacgctgctggcgctgatctgcgcggtgcccgtgatcgcgtcgggggtgtggttcgcgtcggcgcagggcgaagagtgcgcgcgcctggcgcggtggcccgtggccatcctgggcgggctgctcctgctggccgcgctggcgggcttcgtgggcgcgtactggaaccggcgcggcctgctggccttctacctcttccccatggcgtcgctcgtggtgctcctcatcgcgctccccnccttcnccttcgccgtcacccgcgggtccggcgcctaccccgtgctcggccgcgcctacgacgactaccgcctcgacggcttctccatgtggctccgcgggtacgtctccgaacgaccccgggcgctgggacaaggtcaaggccttgctcgccgtcttccaaacctgcnaagaactccctgggccagggcccccttcaccaggcccaannnnntctttcngtcgcacctcttcccgcttccagncggggtgctgcaagcgnccgtccgtgtgcggtttcagctacgtgaggccaaacngtgtggtccgcccccgcgggcccgccggtggttgaaccctaacttgcgggctggggaacaacgacc

SEQ ID NO: 50134 - protein, 210 aa, Zea mays
  misc_feature: Ceres CLONE 1462351-F
  misc_feature (3)..(142): Pfam Name: Tetraspannin Pfam Description: Tetraspanin family
  misc_feature (90)..(90): Xaa is any aa, unknown, or other
  misc_feature (92)..(92): Xaa is any aa, unknown, or other
  misc_feature (146)..(146): Xaa is any aa, unknown, or other
  misc_feature (159)..(159): Xaa is any aa, unknown, or other
  misc_feature (160)..(160): Xaa is any aa, unknown, or other
  misc_feature (161)..(161): Xaa is any aa, unknown, or other
  misc_feature (163)..(163): Xaa is any aa, unknown, or other
  misc_feature (171)..(171): Xaa is any aa, unknown, or other
  misc_feature (177)..(177): Xaa is any aa, unknown, or other
  misc_feature (189)..(189): Xaa is any aa, unknown, or other
MAVSNNITACVTLLALICAVPVIASGVWFASAQGEECARLARWPVAILGGLLLLAALAGFVGAYWNRRGLLAFYLFPMASLVVLLIALPXFXFAVTRGSGAYPVLGRAYDDYRLDGFSMWLRGYVSERPRALGQGQGLARRLPNLXRTPWARAPFTRPXXXFXSHLFPLPXGVLQAXVRVRFQLREAKXCGPPPRARRWLNPNLRAGEQR

SEQ ID NO: 50135 - DNA, 770 bp, Zea mays
  misc_feature: Ceres CLONE 1462352-F
  misc_feature: Encodes the peptide sequence at SEQ ID NO. 50136
aaagctggagctccccgcggtggcggccgctctatactagtggatcccccgggctgcaggaattcgcacgagaccattacctagaacatcctaatcggaaaatctgctctcttcccccgtcttcttcccaagctgccacgttgcctccctccgctccagcggcccatggcctccatggcgttcgccctggcgggggccttcaagggcctctccctggcgcccaccaccaccacctcttccttcccgcgctgcgaccgcgcctcgctctccgtcggcggcgcagcgggcgtgccggcggtgccggtgccggcgcggcggctcaccatccagatggcgcacaagaagggggccgggagcaccaagaacggtcgcgactccaagggacagcgcctcggggtcaagatataccgccaccacctcgccaagcccggggccatcatcatccgccagcgcggcaccagggtctatcctggaaataacgttggaatgggcaaggatcacacactcttttctttgatagatggactcgtcaagtttgagaagtatgggccggacaagaaaaaggttagtgtttacccatatgagaaggagcctgaaaacccaaacagttacagagcaaggaagagagagtacttccgcatgcggcgtgaacggaaaaaggcgagagccgagggcgccgctgagcctcagttggtactacctgctgttgaagaaaactctgaggtcagcgcggactgctgaaaaagttccctgtgtggtgtttctctttt

SEQ ID NO: 50136 - protein, 191 aa, Zea mays
  misc_feature: Ceres CLONE 1462352-F
  misc_feature (57)..(137): Pfam Name: Ribosomal_L27 Pfam Description: Ribosomal L27 protein
MASMAFALAGAFKGLSLAPTTTTSSFPRCDRASLSVGGAAGVPAVPVPARRLTIQMAHKKGAGSTKNGRDSKGQRLGVKIYRHHLAKPGAIIIRQRGTRVYPGNNVGMGKDHTLFSLIDGLVKFEKYGPDKKKVSVYPYEKEPENPNSYRARKREYFRMRRERKKARAEGAAEPQLVLPAVEENSEVSADC

SEQ ID NO: 50137 - DNA, 798 bp, Zea mays
  misc_feature: Ceres CLONE 1462360-F
  misc_feature: Translation starting site: 186
  misc_feature (215)..(215): n is a, c, t, g, unknown, or other
  misc_feature (288)..(288): n is a, c, t, g, unknown, or other
  misc_feature (290)..(290): n is a, c, t, g, unknown, or other
  misc_feature (340)..(340): n is a, c, t, g, unknown, or other
ggagctccccgcggtggcggccgctctagaactagtggatcccccgggctgcaggaattcgcacgagaccattacctagaacatcctaatcgaaaagcttctcgcgcgatcgtctcggcctctcgggattctagagtggcggccggctctccgcctgttcttgtcgtcgctgctcctttcccaggatgtcggaacgttctgagagcgcaactganaagattatgagcagcatcatggataccattgctgacaaccttcctaagcagaagtctggggaatttgatccangntcagtctctgacaaagtgaagaaatagctgtttggtcgtcagaagacttngcatggagttctgggttgtggaaaacctgctgatggtgctgtatggaggaacaaaaagaattctcgagtggtcctggctcttgcaaaagctattttgggttttctttgaggggcctcgacaacccctttcgggcaattggttcctttgcccttggtttgggaagggttcccccttttttttgggccactttccaaaatggtaaaaagggggttccctttcttggggcccccaaattaatcccccgaaaaattttttggaaaattgcgctttaaaacggggcccaaaaaaaaagactcggtggttctcccaggaggttttgtggaaaaaaaataactttttttttgggcccccaccagaggggggcgccgcgaaaaaaaaaaaaggccccccccccggagcaatatagggggggtgttttgctccccccccccccgcccctaaaaaaaaaaaacaaaaa

SEQ ID NO: 50138 - DNA, 774 bp, Zea mays
  misc_feature: Ceres CLONE 1462363-F
aaagctggagctccccgcggtggcggccgctctataactagtggatcccccgggctgcaggaattcgcacgagaccattacctagaacatcctaatcgaaaaaatcctaccccgcggggggaattctctctcagttctctcggcgacgactgggagaccgccgccgccgccatcctactccaggtgccctgagaactcgatcggagtcttcgctggcgaccaacacccaccagctatcaggtgtacaaccatgtacttcaccatgtccgcccctgcaatgtctctatgatcctccagctacggtagacgccccgttcgctagctgaggacctcctggttcctgtgagcaggtggcgtgtttagatgttgctttcaacatgccaaaacccaatgggcgtcggttggcctccccccccccttccggaggttctaaggagggaaattgagttccccccgggggggggaaggggacccacccactccgggcggcggaactccggagtcccctgaagtgcgaaaaattttgagtcgggaccgctccctgggccccaaaaaaaaaacatgtgcgaaaaccattgtgctcccacacaaacttctttttgttgtatttggaaaaaactcccccccagggggcccccaagaaaaagagagaaatctcccctccgggggaaatttcggcggggcaaaaaacatgcggcgctcttttgggcaaaaaaaggaggggaggggggggcatctctcacccccccctcatgaaaaaaaagaaaaacaaaa

SEQ ID NO: 50139 - DNA, 753 bp, Zea mays
  misc_feature: Ceres CLONE 1462365-F
  misc_feature: Encodes the peptide sequence at SEQ ID NO. 50140
  misc_feature (427)..(427): n is a, c, t, g, unknown, or other
  misc_feature (579)..(579): n is a, c, t, g, unknown, or other
  misc_feature (689)..(689): n is a, c, t, g, unknown, or other
  misc_feature (690)..(690): n is a, c, t, g, unknown, or other
agagctggagctcaccgcggtggcggccgctctagaactagtggatcccccgggctgcaggaattcgcacgagaccattacctagaacatcctaatcgaaaaatcggactaggtagaccacacttcccttcacctctcatcggcgctctttcccttcctcgcagtcccaggtctcggctcccctctcagtcaagccgtttcatttcctccctcctacaaatatcctgatatggacgacgacgacgactccccgcctcatgagtcggcggcggcggcggcggcagacctatcgctgacactggcgccggcgccggcgctggcgcctcccgcgccgcctccggcgctgcccgccgtcgcctccgacggaggcgtggcgacggcgcgcgtcaacggcaaggacgtgcgcctgttcccgtgcctcttctgncacaagaagttcctcaagtcgcaggcgctcgggggccacccgaacgcgcacaagaaagaacggaagcgtcggctggaacccctacttctacatgaccccgccgcacccgcagcccaatgcggggccgggcaagccacaccgccccgccgggnggggggggcctccctccccgccgccgaacgcgggcccacgtggtaccccccccgtgcgcggcggccggcccccgtaagatttaccacaatcgccctaaaaaaagggatannagaaaggggggggtggggggaataaaggccccacccccaaaagaagggctcgctcggtaggaa

SEQ ID NO: 50140 - protein, 161 aa, Zea mays
  misc_feature: Ceres CLONE 1462365-F
  misc_feature (66)..(66): Xaa is any aa, unknown, or other
  misc_feature (117)..(117): Xaa is any aa, unknown, or other
  misc_feature (154)..(154): Xaa is any aa, unknown, or other
MDDDDDSPPHESAAAAAADLSLTLAPAPALAPPAPPPALPAVASDGGVATARVNGKDVRLFPCLFXHKKFLKSQALGGHPNAHKKERKRRLEPLLLHDPAAPAAQCGAGQATPPRRXGGASLPAAERGPTWYPPRARRPAPVRFTTIALKKGIXERGGWGE

SEQ ID NO: 50141 - DNA, 770 bp, Zea mays
  misc_feature: Ceres CLONE 1462368-F
  misc_feature: Encodes the peptide sequence at SEQ ID NO. 50142
  misc_feature (349)..(349): n is a, c, t, g, unknown, or other
  misc_feature (402)..(402): n is a, c, t, g, unknown, or other
  misc_feature (509)..(509): n is a, c, t, g, unknown, or other
ggagctccccgcggtggcggccgctctagaactagtggatcccccgggctgcaggaattcgcacgagaccattacctagaacatcctaatcgaaaactattgtagtgatgtcaaaaggcacaccatatacacagcaatcttataaagtcagtgattcctttccatttaagtggataaacaagaaatggaaagaaggttttcatgtgactgcaatggcaacatcaggcaatcgatgggctatagtcatgtcccgcagtgctggattttctgagcaggttgtggagttggacttcttgtacccgagcgagggcatccatagacgctgggacaatggcttccgtattactgncatggctgccacgatggatcagtctgcgctgatcctaagcaagcaaggcgtcncccaagaaacgagacacagagactctgcggactacacagtttcccaatcaacatgtcaaggaccagtgggccagaatccctacctttgctggaaatgctaggccagnccgtggcctaaaatccccggtggtgaccaaactggtggttgaggaaatttgaagtttttaacccccggcacccacataaccaccaaggattttcctcttgcccacccgtgggaattggaagggtaaaaattccatgttttgcccaaaacttttccggggggggcccccaaaaaaagcgggaaaggtgggggaaactttttggaagcgttaacccccccaaaacccccaataaaaaaaaaagttgggggggggtttcccaca

SEQ ID NO: 50142 - protein, 131 aa, Zea mays
  misc_feature: Ceres CLONE 1462368-F
  misc_feature (81)..(81): Xaa is any aa, unknown, or other
  misc_feature (99)..(99): Xaa is any aa, unknown, or other
MSKGTPYTQQSYKVSDSFPFKWINKKWKEGFHVTAMATSGNRWAIVMSRSAGFSEQVVELDFLYPSEGIHRRWDNGFRITXMAATMDQSALILSKQGVXQETRHRDSADYTVSQSTCQGPVGQNPYLCWKC

SEQ ID NO: 50143 - DNA, 782 bp, Zea mays
  misc_feature: Ceres CLONE 1462372-F
  misc_feature: Encodes the peptide sequence at SEQ ID NO. 50144
  misc_feature (418)..(418): n is a, c, t, g, unknown, or other
  misc_feature (588)..(588): n is a, c, t, g, unknown, or other
  misc_feature (626)..(626): n is a, c, t, g, unknown, or other
  misc_feature (691)..(691): n is a, c, t, g, unknown, or other
  misc_feature (780)..(780): n is a, c, t, g, unknown, or other
  misc_feature (782)..(782): n is a, c, t, g, unknown, or other
aaagctggagctccccgcggtggcggccgctctataactagtggatcccccgggctgcaggaattcgcacgagaccattacctagaacatcctaatcgaaaaacacaccacaccagcacccagcctccccaacgatgacggcggcggcggcaccggcggtcgctagcagggtgtgggagtgggaagggaaggtggcgtcggcggtggccgaggcgacggcggacgaggcgtgggcgctgctgtcggacttcctggcgttccaccggtggcacccgcgcgtggccgcgtgccgcctcgcgtccggcaccccgcgcgcgccgggctgcgtgcgctactgcgagggcaccgccaccgccgccgacggtgagtaggcgcccgactgggcgcacgagaccctgctggagtatgattcccaccnccgcttcttccgctacgagatgaacgacaacaacatgggcttcggcctcttcttccccacgttccgcgtcatcccgggccgccccggcgggtgctagctgcgctgggagttcgagtgccagcccgtgcgcggcacgcccagggacgcgctcgtggcgccgcctgcgggcngggctccacagcattggcgacccgcgtgcctgaccacnttctcaccgctagggccgccacccctggcgtggtgcccgccggggcccctgggtgaacttcctcntctccaagctccccacgtctcatcgcccgccgactgagttaccgggtcggatgggcggcggccaagggcaaacccaacagcgttcccancn

SEQ ID NO: 50144 - protein, 78 aa, Zea mays
  misc_feature: Ceres CLONE 1462372-F
MTAAAAPAVASRVWEWEGKVASAVAEATADEAWALLSDFLAFHRWHPRVAACRLASGTPRAPGCVRYCEGTATAADGE

SEQ ID NO: 50145 - DNA, 751 bp, Zea mays
  misc_feature: Ceres CLONE 1462373-F
  misc_feature: Translation starting site: 238
tggagctccccgcggtggcggccgctctataactagtggatcccccgggctgcaggaattcgcacgagaccattacctagaacatcctaatcgaaaagctccaaccaaacttccggtcttctcttctccactaccacccgcctgcccgcgcgccttctcctccaccactgccccgtcgtggaataggggcaagttcaggcatctcgcttctgtcctggtcgaggggatcggaaaaaaatgggctcggaggcggactgcaacaggatcaggggcccgtggagccccgaggaggacgacgcgctgcggcggctcgtggagcggcacggcgcgcgcaactgcacggttatcgggcgcgagatcccaggggcgaactaccaaatcgtgccgcctgcactggagcaacaaccccccaccacaggcggagcgccgggccttcccggacggaggaggacgcggccatcatccgcgcccaagagtgcttcggcaaccggtggagcgccatctagccctcctcccagggcgcgaccaaaaacgccgttaacaaaaactggaaatggtccctcaaccgcaaagttgccgccgtggccgccccgtccggttcctccaaagaccaatcgcgccccacaaaagggtcatccccctccccgaaaaaccttcggggtccggggtcccggtcccaacgaaacgaccttggcccctatcgccgcccagaaatatcgccccggggcccggtcccccacttttccaaccc

SEQ ID NO: 50146 - DNA, 816 bp, Zea mays
  misc_feature: Ceres CLONE 1462382-F
  misc_feature: Encodes the peptide sequence at SEQ ID NO. 50147
  misc_feature (654)..(654): n is a, c, t, g, unknown, or other
  misc_feature (657)..(657): n is a, c, t, g, unknown, or other
  misc_feature (658)..(658): n is a, c, t, g, unknown, or other
  misc_feature (661)..(661): n is a, c, t, g, unknown, or other
  misc_feature (662)..(662): n is a, c, t, g, unknown, or other
  misc_feature (672)..(672): n is a, c, t, g, unknown, or other
  misc_feature (700)..(700): n is a, c, t, g, unknown, or other
  misc_feature (706)..(706): n is a, c, t, g, unknown, or other
  misc_feature (718)..(718): n is a, c, t, g, unknown, or other
  misc_feature (770)..(770): n is a, c, t, g, unknown, or other
  misc_feature (806)..(806): n is a, c, t, g, unknown, or other
aagctggagctccccgcggtggcggccgctctataactagtggatcccccgggctgcaggaattcgcacgagaccattacctagaacatcctaatcgaaaacgttttctctgaccctttccttcccttcccttgttttgatggcgccaccgcgagccgccgccggcgtgtcaattcctgctgatcctgccgccgacagtccagaggcagagtcggagagcaagctgcggcaaggtgcagcagacgcgcggtggctcgaaaccctctccgagccggagctcgatgtgctggtgagcctgaaggaagtggccgtcacgcgggcttccgatgccggccatcctggcctcgccgacacggtcttctatttccgggcgctgcgggctctcggggttgggttgctggaagaaatttaaacacccccccaaggaaaccccacttgaagcaacctgtttgaaaggaaaggcctttccaaaaaaacccgaagcccccccaaaaactccaaacgccccccccaaatgtgtcccccccaaaaaggaaaatactcccccccgggggggaaaaaaggaaaaaagggggcgccttgaatccgggggggtggaaaactgcgcccctttttgttcccttttcccggggagaaaaaaaattttccttctcntcnnccnncaaaaaaaanataaagacaaaggggcggcgggtgtttnttttcnaaaacccccccnaccacataaaagacgcgcgttttcttttttttaaacaaaaaaaaccacactncgcgcccgcgcggcgaaaagaaaaaaaaaaaataanttttcctctc

SEQ ID NO: 50147 - protein, 90 aa, Zea mays
  misc_feature: Ceres CLONE 1462382-F
MAPPRAAAGVSIPADPAADSPEAESESKLRQGAADARWLETLSEPELDVLVSLKEVAVTRASDAGHPGLADTVFYFRALRALGVGLLEEI

SEQ ID NO: 50148 - DNA, 810 bp, Zea mays
  misc_feature: Ceres CLONE 1462384-F
  misc_feature: Encodes the peptide sequence at SEQ ID NO. 50149
  misc_feature (426)..(426): n is a, c, t, g, unknown, or other
  misc_feature (427)..(427): n is a, c, t, g, unknown, or other
tggagctccccgcggtggcggccgctctagaactagtggatcccccgggctgcaggaattcgcacgagaccattacctagaacatcctaatcgaaaaaaagcgcacctccatttcaccaactcgatcttgcatctatggtttcttctcctccctcttgtcctccgcgaatatgcggaaccaacatggtgaagggagggaagatccggacgcgaggacagaacgaggctgacgacgacaagcgcgagctcctcttcaaggaagacgggcaggcgtacgcgcaggtgacccggatgctcggaaacgggcggtgcgaggccatctgcgtcgatggcacgcgccgcctctgccctgtccggtgtaagatgcttaggaaggtctggattgggggtggggacatcgttctagtactgttccccccccccccnngacagaaagggcaaccttaatcctccagtacattcaccacaaagccacgccctggctcagggcctagggggagtttcctggactcgcttgtgggctcaagaagggaggtccaactcccttgggccccctaggagggccgagggagggcaggtgatttacttcaattttcaaaggaccaggtaacttccgcggcgaatttaatacatttttggttcctgagtttccgagttctgtgtttttggttcacgttggcgggagatgttttcggcttgggcttgtgccgcgctccctcttatattttaacctggacgcgagaagctcgccaagcgtagcgggatccttttaaacccacgggttctaattggctacaaatacccccaaac

SEQ ID NO: 50149 - protein, 87 aa, Zea mays
  misc_feature: Ceres CLONE 1462384-F
  misc_feature (26)..(84): Pfam Name: eIF-1a Pfam Description: Translation initiation factor 1A / IF-1
  misc_feature (82)..(82): Xaa is any aa, unknown, or other
MVKGGKIRTRGQNEADDDKRELLFKEDGQAYAQVTRMLGNGRCEAICVDGTRRLCPVRCKMLRKVWIGGGDIVLVLFPPPPXQKGQP

SEQ ID NO: 50150 - DNA, 799 bp, Zea mays
  misc_feature: Ceres CLONE 1462390-F
  misc_feature: Encodes the peptide sequence at SEQ ID NO. 50151
aagctggagctccccgcggtggcggccgctctagaactagtggatcccccgggctgcaggaattcgcacgagaccattacctagaacatcctaatcgaaaatgggactgagacacggcccggactcccacggggggcagcagtggggaatcttggacaatgggcgaaagcccgatccagcaatatcgcgtgagtgaagaagggcaatgccgcttgtaaagctctttcgtcgagtgcgcgatcatgacaggactcgaggaagaagccccggctaactccgtgccagcagccgcggtaagacggggggggcaagtgttcttcggaatgactgggcgtaaagggcacgtaggcggtgaatcgggttgaaagtgaaagtcgccaaaaagtgccggaatgctctcgaaacaattcacctcgactgaaacagaggagagtgaaatttcgggtgaggggtgaaatccgtaaatctacgaaggaacccccaaagcgaaaggcagttctcggggtccctaacaaaccctgggtgccaaaacctgggagacgaaaaggattaaaacccctgtgaacccccggccgaaaaaaaaaaaaaaaaattttttccatcccccccaccccgggggggggcccgggcccctttccctcctaatgggggcctaataccgccctccccggggcccttttttaaacccctgggttgggaagaaacctcggggtaccccaataaaatcccgttgaagaaaaccccccttttcccaggggggaaaataaaaaaagaaaccccccaaatctctctttcaaaa

SEQ ID NO: 50151 - protein, 40 aa, Zea mays
  misc_feature: Ceres CLONE 1462390-F
MTGLEEEAPANSVPAAAVRRGGQVFFGMTGRKGHVGGESG

SEQ ID NO: 50152 - DNA, 804 bp, Zea mays
  misc_feature: Ceres CLONE 1462391-F
  misc_feature: Translation starting site: 541
  misc_feature (804)..(804): n is a, c, t, g, unknown, or other
ggagctccccgcggtggcggccgctcttacctagtggatcccccgggctgcaggatttcgcacgagaccattacctagaacatcctaatcgaaaaatctcaaatctgtccatgggctgacaagaccccgcgcgctgaaagcatttgcgtggtggctgctgcacgcagctgggcgcggagttcgtgggcacgttcatcctcatcttcttcgcgacggcggcgcccatcgtgaaccagaagtacggcggagcgatcagcccgttctgcaacacagcgtgcgcggggctggcggtggcgaccgtcatcctgtccactgggcacatctccggggcagcacctgaacccgtcgctcagtatcgccttttttaccctgcacaccttcccctggctgcatgtgataaaggggccccccccccccaacccaggcatccctctgccccgccttcgcgctccagggcggcccccaccacttcctatccggacgggttcccgtgccccgacgccacaggctcaaccggcccaagagtactacgccgaattcatgatctcgttcaacctcccctttgtcgtaaacggacttggccccccactccccgggttaggggtgaaactcgccctggaatcccggggagagccggccaaaatccctgaaaaatcgatcttacaccaggttccgaagaacgggccgggttcccatgaaacctagatgaagtaactctaccaactcggcagtgggttgagcagaaaaactaccgggtggctccgtgatttttacttgccggggtcccgaacctctgaggcctcn

SEQ ID NO: 50153 - DNA, 797 bp, Zea mays
  misc_feature: Ceres CLONE 1462398-F
  misc_feature: Encodes the peptide sequence at SEQ ID NO. 50154
  misc_feature (433)..(433): n is a, c, t, g, unknown, or other
  misc_feature (474)..(474): n is a, c, t, g, unknown, or other
  misc_feature (712)..(712): n is a, c, t, g, unknown, or other
ggagctccccgctgtggcggccgctctagaactagtggatcccccgggctgcaggaattcgcacgagaccattacctagaacatcctaatcgaaaagattccaagctgctctcgtccctagaaacaaagcagctcctccgcggggcggcgaactactacccatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgacggaggctacttttcatgcataatgaccttcccccagaactatcccaacagccccgcatcagtangaatttacttctgggatgtggcatccgaattgtttatccgnatggggctgggttgcatttccattcctcatccacctggggaaaaacccaattggttatggaccttgcaggcgacggtggaaaccctggccaccggttgaaaattatattttgagaaactttttcaagggcccttaagcccaaaggaggatgccccccaaaaattttaaccctccccaggtttgaaaaaaaaccggggataattccaaaaaaagtgttggcgttgggcccccggtcccnaaaaatactttaaaaagaaaaccgggggattaaaaaatccccccccgggggggggtaattaaacaaaatttccccgggccttttt

SEQ ID NO: 50154 - protein, 120 aa, Zea mays
  misc_feature: Ceres CLONE 1462398-F
  misc_feature (11)..(119): Pfam Name: UQ_con Pfam Description: Ubiquitin-conjugating enzyme
  misc_feature: SWISSPROT Homolog: EC 6.3.2.19 Ubiquitin--protein ligase
  misc_feature (75)..(75): Xaa is any aa, unknown, or other
MAGTPSQASLLLQKQLKDLAKNPVDGFSAGLVDDSNVFEWQVTIIGPPDTLYDGGYFSCIMTFPQNYPNSPASVXIYFWDVASELFIRMGLGCISIPHPPGEKPNWLWTLQATVETLATG

SEQ ID NO: 50155 - DNA, 766 bp, Zea mays
  misc_feature: Ceres CLONE 1462399-F
  misc_feature: Encodes the peptide sequence at SEQ ID NO. 50156
  misc_feature (766)..(766): n is a, c, t, g, unknown, or other
aaagctggagctccccgcggtggcggccgctctagaactagtggatcccccgggctgcaggaattcgcacgagaccattacctagaacatcctaatcgaaaactgcatctgcatgcaataagcagccgcgttagtgctgccgtgcagagagtacttccatgctgctcctggccgtgccggccgtgctggccgggttcctcaaggcgttccggctcgccttcctgctttggccgctcaacctcgcgctcccgccggcgcgcgacttgccgcgggcctgcatcacggtccgggccatcgcgtccttctacgccgccgggctgcggggctacgtcgccggcgcccgccgcggggtgcagctgctgcaggcgcggagacagctgggccagcagcaacagcaggacgccgccgcctcctcctcggcgctcggcgtggcgtggacgcgcgaggatgccgatgtcgtcgcccatgccatgctcgccttcgacgacatctactgatgatctgctaggggatcttcttcgaacggttatgttagcatgccgttatatgatctcttggccgctcctttggttaattttatcgtgcgtaattaaggatcatagcttcgttcctcccaacatatcctgtttcctcagaactttccatgtcgcgtggccgctttttggtcctctctcgctcgttttctgcatataaactctattctttttcggccttgtacatacaattgaactggtgcaaattttttggtctgctggaatgtaacgtn

SEQ ID NO: 50156 - protein, 112 aa, Zea mays
  misc_feature: Ceres CLONE 1462399-F
MLLLAVPAVLAGFLKAFRLAFLLWPLNLALPPARDLPRACITVRAIASFYAAGLRGYVAGARRGVQLLQARRQLGQQQQQDAAASSSALGVAWTREDADVVAHAMLAFDDIY

SEQ ID NO: 50157 - DNA, 793 bp, Zea mays
  misc_feature: Ceres CLONE 1462406-F
  misc_feature: Encodes the peptide sequence at SEQ ID NO. 50158
  misc_feature (367)..(367): n is a, c, t, g, unknown, or other
  misc_feature (399)..(399): n is a, c, t, g, unknown, or other
  misc_feature (458)..(458): n is a, c, t, g, unknown, or other
aagctggagctccccgcggtggcggccgctctagaactagtggatcccccgggctgcaggaattcgcacgagaccattacctagaacatcctaatcgaaaaaaaaaggataggagaataaggaaaaaacaatggcggtgctactccgccgcgccgcggcgctcctcgtcgtggctgctgtctgcgcggacggcgcctccacgttctactcctccgaccccaacctcggatccgcccgcgtcgtcttccagacgaattttggtgatattgagtttggcttctttcctcatgttgcacctaagactgtcgaacacattttcaaacttgtgcggcttggatgctacattacaaatcacttctttccgggnttgacagggtttcgttgcacaagttgctgatngtatgtcaggtcgaaccccccctatgaatgaggagcagaaaaaagagcggaagaaaacnattggtggtgaatttagtatgggcaagcttgtcagggaaattccttcccctggggaagggcattttgatccaaacaggggtgggcccttccctttcaattcttcggggaaattcccccctttttgaggcccatttttctttttttgaggggcccctaaagggggaaaatattgtaataaacaaagagggtctcccccccaaaaaaaggtttttttttagcgccaaaaggggtacccccccctcccccttttttttttatatttttttaaaaagggtggaaaaaaaaaattttttcccggagaagaatttttttaacccccccgaagtgggggggg

SEQ ID NO: 50158 - protein, 88 aa, Zea mays
  misc_feature: Ceres CLONE 1462406-F
MAVLLRRAAALLVVAAVCADGASTFYSSDPNLGSARVVFQTNFGDIEFGFFPHVAPKTVEHIFKLVRLGCYITNHFFPGLTGFRCTSC

SEQ ID NO: 50159 - DNA, 769 bp, Zea mays
  misc_feature: Ceres CLONE 1462408-F
  misc_feature: Encodes the peptide sequence at SEQ ID NO. 50160
  misc_feature (379)..(379): n is a, c, t, g, unknown, or other
  misc_feature (420)..(420): n is a, c, t, g, unknown, or other
  misc_feature (421)..(421): n is a, c, t, g, unknown, or other
  misc_feature (444)..(444): n is a, c, t, g, unknown, or other
  misc_feature (645)..(645): n is a, c, t, g, unknown, or other
ggagctccccgcggtggcggccgctctagaactagtggatcccccgggctgcaggaattcgcacgagaccattacctagaacatcctaatcgaaaaaggtagcatcctcgcgccctgtcgtgtcgcctccgcctctgagttcagctcgccggcagccgccgcccgcaatggaggccctccggaaagcggaggcggagctcacggtgtacgtgcacccctccaacgccaagcgcgtccggcatgccgtatcccgccagcttagcgcgcttctcttcacgtatgtggaccgttttgatggcgtgttgctgatgcatgaagtttcattccttattggcaaagacaaagagggcaaatcctttatatggaaaggagtgaccgnaatgatcaaattgctgaacccgtttcttatgccacaaccannaatggcttggtgccatatttcancgtccaagtggatgcccccccgctgctcttctctccccacccggacatgatcctggaagggaagggtgaaatgctggggaaggaggcaattcatgcccttggattagggggttttctcagggggcaattatgtcctgaaagatattaggttccaatttccatttgcaacaaggtgtggagggaaaatttggtgagccctcncagaaaaaaaaacttttcgatttggaagaaggaacaatgcaataaggttttttttgtccacaagggtgtggattctgcaaattgaagttggccgaacttaccggggatcctctcactccccccc

SEQ ID NO: 50160 - protein, 108 aa, Zea mays
  misc_feature: Ceres CLONE 1462408-F
  misc_feature (71)..(71): Xaa is any aa, unknown, or other
  misc_feature (85)..(85): Xaa is any aa, unknown, or other
  misc_feature (93)..(93): Xaa is any aa, unknown, or other
MEALRKAEAELTVYVHPSNAKRVRHAVSRQLSALLFTYVDRFDGVLLMHEVSFLIGKDKEGKSFIWKGVTXMIKLLNPFLMPQPXMAWCHISXSKWMPPRCSSLPTRT

SEQ ID NO: 50161 - DNA, 778 bp, Zea mays
  misc_feature: Ceres CLONE 1462411-F
  misc_feature: Encodes the peptide sequence at SEQ ID NO. 50162
  misc_feature (358)..(358): n is a, c, t, g, unknown, or other
ggagctccccgcggtggcggccgctctagaactagtggatcccccgggctgcaggaattcgcacgagaccattacctagaacatcctaatcgaaaaaagatgctccgccgcgccgcccctacgtcggctgcactctgccgccgcgcgctctctaccacgccatcctcttcccgcaccgcggcggaaaccgcggcggtctcctctgagttgaactccgtcctcctccgctcgctcaaggagcactacctcgaggtctgcaagatgacgccgccgcccaaggtcagcccgcccaagcccttcaccatcgtcaaaggcgccctggaccagccgtcgggccccgtgctgcgccgcgaatacngcgaagacggaaagggagatctcatctccgtcgccagggtcgccaaaatcctggcccgcggggccgaattctgatccgaacgggaccggaaaggccggggtaatgagggggtcaataaccaaattcctcctcccacgtgaaattttccaacccgggaaaagagaaaccaaaacaatttcctttgggggggtacccggaacccttggggaaaaatttggggggccccccaaaaaaaaaacccccccccctttgggggggaaaaccccccgaaggaaagagaccggggggttttttccccaaatttggaaaaaaaggtggggggagccttcttttttttttatccccccccgaaaaaaaaaacccctccttcccccccccggtgttgtttaaaaaaaaccacccttttgtgcgggggggaga

SEQ ID NO: 50162 - protein, 110 aa, Zea mays
  misc_feature: Ceres CLONE 1462411-F
  misc_feature (87)..(87): Xaa is any aa, unknown, or other
MLRRAAPTSAALCRRALSTTPSSSRTAAETAAVSSELNSVLLRSLKEHYLEVCKMTPPPKVSPPKPFTIVKGALDQPSGPVLRREYXEDGKGDLISVARVAKILARGAEF

SEQ ID NO: 50163 - DNA, 782 bp, Zea mays
  misc_feature: Ceres CLONE 1462414-F
  misc_feature (242)..(242): n is a, c, t, g, unknown, or other
  misc_feature (246)..(246): n is a, c, t, g, unknown, or other
  misc_feature (247)..(247): n is a, c, t, g, unknown, or other
  misc_feature (262)..(262): n is a, c, t, g, unknown, or other
  misc_feature (388)..(388): n is a, c, t, g, unknown, or other
  misc_feature (421)..(421): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (524)..(524): n is a, c, t, g, unknown, or other
  misc_feature (532)..(532): n is a, c, t, g, unknown, or other
  misc_feature (533)..(533): n is a, c, t, g, unknown, or other
  misc_feature (594)..(594): n is a, c, t, g, unknown, or other
  misc_feature (699)..(699): n is a, c, t, g, unknown, or other
  misc_feature (701)..(701): n is a, c, t, g, unknown, or other
  misc_feature (702)..(702): n is a, c, t, g, unknown, or other
  misc_feature (705)..(705): n is a, c, t, g, unknown, or other
  misc_feature (707)..(707): n is a, c, t, g, unknown, or other
  misc_feature (709)..(709): n is a, c, t, g, unknown, or other
  misc_feature (771)..(771): n is a, c, t, g, unknown, or other
aaagctggagctccccgcggtggcggccgctctagaactagtggatcccccgggctgcaggaattcgcacgagaccattacctagaacatcctaatcgaaaaaaggcccagtccgatgactctggccctataactctgagccccatcggagactcggagtcgggggcgccagcgtctcgcctcgccgtcagcagcagcagcagctgcacctccattccacggcttccgtcgtgcgcttcgtnctgnncacccaacaaaaagngccgacggcgacggcagggggaggagatgaagctgaagcagctggagggcctcttgggtggcctgaccagttctccgaccccagctggagctggagcaatatgcaaagggcccctaacatccccgncccggaaagctccttcctggggcaaaaaaaaanttccaaggactaactggcaaaagggaacccaaacctccccgggggggtggggcccctcggggttgtggccaatcttttttcnnnnnnnnaagacagcccaggnaggtagannaaacccccccgagttttttaggtttttcaaaaaaaaatcctttgttgtgggggagggggtnttttttttggggtggggcccaaaaaaaaatataatgagagaggcgcccctttttttttggggttttttaaaacccccccccccctcaaaaaagaaaaggtgggcncnnccncncnccctccctcctccgctgccgggggggggggtgcccaaccaatttttttttccacaacaaaantcctcataaaa

SEQ ID NO: 50164 - DNA, 808 bp, Zea mays
  misc_feature: Ceres CLONE 1462417-F
  misc_feature (411)..(411): n is a, c, t, g, unknown, or other
  misc_feature (412)..(412): n is a, c, t, g, unknown, or other
  misc_feature (423)..(423): n is a, c, t, g, unknown, or other
  misc_feature (425)..(425): n is a, c, t, g, unknown, or other
  misc_feature (429)..(429): n is a, c, t, g, unknown, or other
  misc_feature (430)..(430): n is a, c, t, g, unknown, or other
ccagctggagctccccgcggtggcggccgctctataactagtggatcccccgggctgcaggaattcgcacgataccattacctagaacatcctaatcgaaaaatccctgtctcccccctccctcttaactgcaagcaagcaatgggggctcccaaatgggtgggtgcgccattggcgctgctgctcgtcctgcaactactcggcacgatctgagacggacgatacaccactgcggccgacttggctacgccctcagtgagggcccccccacgtaccccccagagggagaggaggaaccccacctacccaacgccactaggcagcgggccccaacacacaagatgaacacttctgatctttttagttgtggaccaaccaacctcatcgggactgtttgatttggtgaatacnnccccccacccnanaaannaaaaaaataaaaacataaaccaattaaatagttaatgagaccccagcaggcttacaaaaacaaaaacctcctccaaatcgacacgtaaagggcctggagacgccatttcaaaaggacgaagtcaacggccaatgctaacaaccacatgataaaggaaaatgcaatacaaccaaaccaccccctgttattttacttttatatctcttattctgtgttctttatatcatcgcagcaagggagaatatttttgatgactctcaatcaaccaactgggtgtagtactcctcggaattagataaacccctgcgctgttaaacgcgttaaagtcgcatatctcggcatttagaataatggctcctctctatgttggatatttat

SEQ ID NO: 50165 - DNA, 859 bp, Zea mays
  misc_feature: Ceres CLONE 1462419-F
  misc_feature: Encodes the peptide sequence at SEQ ID NO. 50166
aagctggagctccccgcggtggcggccgctctataactagtggatcccccgggctgcaggaattcgcacgagaccattacctagaacatcctaatcaaaaaacaaacttcaaagtaattgcgcgcgacctcccgcttgttctgttcgtcaaggcggatgcgtctcttgttctcctaagtctccggaggctggcgaggacaggaacctgcccggatgttctggaattggaacacgagaatccggcttcttcttcctcctctgctatcggggcagcagttttgatatctaagaagcccagcaagaggtagaaggaggctcctcctccatcgaacccaacgatagcttccgtttcccaaagctagtttcttgatgaaaaaaaaggttttctttgaaaacatggtggaaaggcaaaaaaacccccccccccacaaagcagaaggacggaaaactccctaagccttttgacttccgaaggcgcttcctgggagagacagcctccagggtattacaaactgagatttgagggctccgggggttgtgtgatcttttaacccctcttggaaccttgttaagagctgcttttaaggcaccttttcgcccggtaattgggtttggttttggcggaaccccccctcttatttaataccgggtgcccaaattttataaaaagggaaacacccccccttttacacttttttgtgcacactgatggttccccacacggggtaagaagaggagggggaaacacccccccacactggggagggccctcctaaaaaaaatggtttatagtctcctctccagtgcgaaaatttttatttttacaaaaagagaacgtatcgtttcttcgaaaaaaagg

SEQ ID NO: 50166 - protein, 101 aa, Zea mays
  misc_feature: Ceres CLONE 1462419-F
AGAPRGGGRSITSGSPGLQEFARDHYLEHPNQKTNFKVIARDLPLVLFVKADASLVLLSLRRLARTGTCPDVLELEHENPASSSSSAIGAAVLISKKPSKR

SEQ ID NO: 50167 - DNA, 772 bp, Zea mays
  misc_feature: Ceres CLONE 1462421-F
  misc_feature: Encodes the peptide sequence at SEQ ID NO. 50168
cagagctggagctccccgcggtggcggccgctctagaactagtggatcccccgggctgcaggaattcgcacgagaccattacctagaacatcctaatcgaaaaaagttcccaactgccaacgacaagccaagccagccgggctggatcccagacccagagccttctctcctcctctcccatttaaccaccatcggcagcaccaccactgccactacgcgcgaggcacggcacggcacggcacgaccgagctccagtctgcccccgcccccgcccccatccgcacgtccgccttgatccggcaaatggcgtcgccggcgcggcggctcctgcagaccaactccgtgcagtacccgacgctccccgcggccgacccgccgagcgcgctggccgtcgactccgacgtggtggtcatcctcgccgcgctcctctgcgcgctcatctgcgtcgtggggctggcctccgtggcccggtgcgcgcgctcccgcgccgcgcccgccgccgccgccaggagggggctcaggaagaaggcgctcagggcgctgccgagcctcgcgtacgaggacgccgtggcggcccgggccggggccggggacggggccggggacggggcggcggaggtcctgccggagtgcgccatctgcctgtcggagttcgcgccacgggaggaggtccgcgtgctgccgcagtgcggccacgcctttcacgtcgcctgcatcgacacctggctcgccgcccactcctcctgtccctcgtggccgccgcgtcctcgtt

SEQ ID NO: 50168 - protein, 156 aa, Zea mays
  misc_feature: Ceres CLONE 1462421-F
  misc_feature (110)..(151): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MASPARRLLQTNSVQYPTLPAADPPSALAVDSDVVVILAALLCALICVVGLASVARCARSRAAPAAAARRGLRKKALRALPSLAYEDAVAARAGAGDGAGDGAAEVLPECAICLSEFAPREEVRVLPQCGHAFHVACIDTWLAAHSSCPSWPPRPR

SEQ ID NO: 50169 - DNA, 770 bp, Zea mays
  misc_feature: Ceres CLONE 1462427-F
  misc_feature: Translation starting site: 456
  misc_feature: SWISSPROT Homolog: EC 2.3.1.12 Dihydrolipoyllysine-residue acetyltransferase
  misc_feature: SWISSPROT Homolog: EC 1.2.4.1 Pyruvate dehydrogenase (acetyl-transferring)
aaagctggagctccccgcggtggcggccgctctagaactagtggatcccccgggctgcaggaattcgcacgagaccattacctagaacatcctaatcgaaaaatcctctctgctttccaccaccctataccaaaccagccaaagccctccactcctccccgcctccgcctccgacgtcgaacattcttctccaatggcgacggcccccgcatccctctcgctctccgcctctaccctgcccacccggctccgtgccgcagcggtgctggcgggcatgcgctggaggcagccgcagcgcgggcggatggtggtgcgcgccaagatccgggagatcttcatgccggcgctgagctccaccatgacggagggcaagatcgtctcctggtccgctggagagggtgatcgcgtctccaaccccccaccccgtcgtggtcgtcgagtctgacaaggccgacatggacgttgagaccttccacgacggcatcgtggcggtggtcctcgtccaggctggcgagtcggcgccggtgggcgcgcccatcgcgctgctcgcggagtcagaggaggaggtgccgctcgctctcgccaaggctcaggagctctccaacgggcagccgcagcaggcgcctcctgctccgacggaggatgccgcagcgacgccgccccctccttctgctccggccactgctcccacgccggtggccgtgggtacgaggggcattgccagcccgcaccgctagaagctgcctaagcagcacagggtgggaccttgc

SEQ ID NO: 50170 - DNA, 819 bp, Zea mays
  misc_feature: Ceres CLONE 1462430-F
  misc_feature: Encodes the peptide sequence at SEQ ID NO. 50171
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (418)..(418): n is a, c, t, g, unknown, or other
  misc_feature (457)..(457): n is a, c, t, g, unknown, or other
cagctggcgcgcnaacannnnacnnnnnnnnnnnnnnnnnntcaaagctggagctccccgcggtggcggccgctctagaactagtggatcccccgggctgcaggaattcgcacgagaccattacctagaacatcctaatcgaaaaaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctcctccatcgccaccaccgccgtcgcccaccagcacgccgtgccctccgccgccgtccagctccggtggaaagngccccaagaacgcgctgaaactgggcgtgtgcgccaacnccctgggcctcgtcaaggcgtccatcggcaaggtgcccaccgactcgtgctgcccactgctggacgggctcgccgacctggaggccgccgtctgcctctgcaccgcgctcaaggccaacgtgctcgggcgtcaaccctccacttctccctcaaggttcccctgcttcctcaactactgcgggaaggagcgccccccaggggcttcctgtgcccccacaaattaatactagtgcgctagctccgtcactcagcttcagattgccatgcaaaaatcgcgggatcctccccctttccttcgggggccccccaccgaaatgaccaggccctctgccccgaccgcttcctgtgggaactggcacccc

SEQ ID NO: 50171 - protein, 148 aa, Zea mays
  misc_feature: Ceres CLONE 1462430-F
  misc_feature (63)..(144): Pfam Name: Tryp_alpha_amyl Pfam Description: Protease inhibitor/seed storage/LTP family
  misc_feature (62)..(62): Xaa is any aa, unknown, or other
  misc_feature (75)..(75): Xaa is any aa, unknown, or other
MASVTRFPAVALVLLLAASAFLASEVAACGGCPKPTPPPSPPPPSPTSTPCPPPPSSSGGKXPKNALKLGVCANXLGLVKASIGKVPTDSCCPLLDGLADLEAAVCLCTALKANVLGRQPSTSPSRFPCFLNYCGKERPPGASCAPTN

SEQ ID NO: 50172 - DNA, 740 bp, Zea mays
  misc_feature: Ceres CLONE 1462432-F
  misc_feature: Encodes the peptide sequence at SEQ ID NO. 50173
  misc_feature (411)..(411): n is a, c, t, g, unknown, or other
aaagctggagctccccgcggtggcggccgctctagaactagtggatcccccgggctgcaggaattcgcacgagaccattacctagaacatcctaatcgaaaactaatactccatcgggagtttctgggagtggtaaacgtcggttttctgaggaaccgggacaatcccagtacagggatcgagctgcagaaagacgaaatctgtatggatcatctcatggcactgatactgttggattggattcaactggtgactatccgtcccgaaagggttcaagtgagatagggtcgatgccgtttcctcctggtgtgggtgaacgttccagtggtgaaattggcaacagcgaaaactatgaagttattaccgctgataaagcaatcgatgaaagcaatgtgggcaaccgcattctanccatcctgcggtggcaggagggactgggtctcggaaaggatgccagcggtatcaaggaaccagtccaggcaaaatccgtcgacgccagggctggactgggaagtcagcagcggaagcctgatccatcccttgaagcccaagccggggacagctacaaaaccatcatccagaagaaggccatggcaagattcaaggagatgtcctagctacactagtttatctattttattgctgcattttgtagcccgtttttaacagcatgcattttttttgattgctcacggggtttttaaataaactgagccgccgaattggggatttctcatccc

SEQ ID NO: 50173 - protein, 108 aa, Zea mays
  misc_feature: Ceres CLONE 1462432-F
  misc_feature (32)..(76): Pfam Name: G-patch Pfam Description: G-patch domain
  misc_feature (41)..(41): Xaa is any aa, unknown, or other
MPFPPGVGERSSGEIGNSENYEVITADKAIDESNVGNRILXILRWQEGLGLGKDASGIKEPVQAKSVDARAGLGSQQRKPDPSLEAQAGDSYKTIIQKKAMARFKEMS

SEQ ID NO: 50174 - DNA, 777 bp, Zea mays
  misc_feature: Ceres CLONE 1462433-F
  misc_feature: Encodes the peptide sequence at SEQ ID NO. 50175
  misc_feature (425)..(425): n is a, c, t, g, unknown, or other
aaagctggagctccccgcggtggcggccgctctagaactagtggatcccccgggctgcaggaattcgcacgagaccattacctagaacatcctaatcgaaaaaaggtcaggcacaaacacgcggggacgaagcacacaacaaagctgcagatcccccatggcaggctccacctccctcgttccccttcccgtccccgcccctccatctcgccaccgcttccacacgtccacgtccgcatccccccgccacctgcgcccctcccctgctacacgcctccgcgctgcccggcgtcggcatcccgacgccgacgttgtcgtcccagatgcccgcccctgggtcggcgatctatcgggcgccgccgcgtcctaccgggaccgaagtgaggaggacgaagacgacgcagatgaagaccaccactaccacnaggaccgcagcctggacctactggcccggttcctgcactccgtattcaggaaggcctcacgccgcgcgcgccgagctgccaggtccgtgctgccgccttccgtccccgccgagctggggaagtttttcggccaatggagtgcttgtcctgacgctcctatggatcccgaagggtcttctcgaaggggcctgcacattaggaaacatggtgtttgcaagcatccgtccttgtcagagtatatggtcctggggtgacattcttcaaaaaaaaacggttccagctttattgcccgggaacaacaacgaagaaaacctgatggacgcaaatccaagaccgctgggttattattttg

SEQ ID NO: 50175 - protein, 173 aa, Zea mays
  misc_feature: Ceres CLONE 1462433-F
  misc_feature (90)..(90): Xaa is any aa, unknown, or other
MAGSTSLVPLPVPAPPSRHRFHTSTSASPRHLRPSPATRLRAARRRHPDADVVVPDARPWVGDLSGAAASYRDRSEEDEDDADEDHHYHXDRSLDLLARFLHSVFRKASRRARRAARSVLPPSVPAELGKFFGQWSACPDAPMDPEGSSRRGLHIRKHGVCKHPSLSEYMVLG

SEQ ID NO: 50176 - DNA, 812 bp, Zea mays
  misc_feature: Ceres CLONE 1462444-F
  misc_feature (414)..(414): n is a, c, t, g, unknown, or other
aagctggagctccccgcggtggcggccgctctagaactagtggatcccccgggctgcaggaattcgcacgagaccattacctagaacatcctaatcgaaaaaagaaaaacacacggacttcagtagttgcagtgccggctgcctccctctcgcgtgcgctcgccctgtgcctctcgcgtgcggaagctaggcaaaccgccggcgccctagctaggtgcccaggccatcgtcggtcccttcgccaagccatcgtcggggtctcggggattagcacccgcacccacaagatggccacaccgaacggtccttctgcttctccgatggtgtaccctgtctacctttctggggtattccccagcaagcggggatgatcaggctcaaggtcaaggaatatatgcatacaacaccaccagntaacaacggcaattggaatgggttgctatgctccaaaccacaatcattcccctcacttacaatattcccaacaaaaagctttggtgccccctgctggtgaaaagaaatttcccggatgcctacgcgcccaaaatttcccccaaaaacaaaatttgtgggaggggggtttacccttcctttttccccttggattggcccccgaaaaaaaaaaaaactcgcagggggggtttctcttggccccggggggctaaaaaagagggttttttctcccacacagggtggcccccctggttttctttttaaacaccccggggtttttccctctttttttaaaaggcccccccggggggggggggggggtgtttttcccccccccaagctttctctttgtaaaaaag

SEQ ID NO: 50177 - DNA, 783 bp, Zea mays
  misc_feature: Ceres CLONE 1462445-F
  misc_feature: Encodes the peptide sequence at SEQ ID NO. 50178
  misc_feature (441)..(441): n is a, c, t, g, unknown, or other
tgttatgtcacacacaacaaaatgtaatattttttgcccgctcttttcaaaactggagctccccgcggtggcggccgctctttaatagtggatcccccgggctgcaggttttcttgcctgatgaggcgcattgacgctctgaaccaaaagtcaacgtctctaacgttgacaacagggtgctgagagcggacatggagaccctaagagctaaggtgaagatgggagaggactccctgaagcgggtgatagagatgagctcatcagtgccgtcgtccatgcccatctcggcgccgacccccagctccgacgctccagtgccgccgccgcctatccgagacagcatcgttggctacttctccgccacagccgcaaacgacgatgcttcggtcggcaacggtttcttgcgactgcaagctcattaatagcctgcatccatggtcntcggtggaactctgaccgccacacacctcaaccgagtagcagcagccacgcattgcccgggggccatggagctcatccagacggcgatgggatccatgccgccgacctccgcctccggatctacaccgccgccgcaagattatgagctgctgggtccaaatggggccatacacatggacatgtattaggcactgcgggtttcttgatcgctggagacattttatttgcaggtgtcgcttgataaggctggttgtctcaatcttctttgacgtgaaatccaaataactcacaattaaaaaaaaaaaaaaaaaagcttattcgataccctgcgacctcgagcgg

SEQ ID NO: 50178 - protein, 76 aa, Zea mays
  misc_feature: Ceres CLONE 1462445-F
METLRAKVKMGEDSLKRVIEMSSSVPSSMPISAPTPSSDAPVPPPPIRDSIVGYFSATAANDDASVGNGFLRLQAH

SEQ ID NO: 50179 - DNA, 737 bp, Zea mays
  misc_feature: Ceres CLONE 1462449-F
  misc_feature: Translation starting site: 246
  misc_feature (737)..(737): n is a, c, t, g, unknown, or other
ctggagctccaccgcggtggcggccgctctagaactagtggatcccccgggctgcaggaattcgcacgagaccattacctaaaacatcctaatccaaaacccgttctcctctctgctatccgcgcccaaatcacgccgtatgtgcgcgtgtccatctgcgcgcatctccccagatccagtctagtcgctccaccacgccgaccccgacccgacaccggctaccacacggatccactgtgctctccatggccgtgaaagggcacgatcttgcgccgacctcgaccatgctctaccgaggaaggtccgcgtggttccctctcctgcatcccatgatccagatgccgccacaccatgctcgagggtcggggccgacaaatccgaatacccgcactctgcgtcacgtggatcttcaaaatcacgctggagctcgactccaaatcacgaggcgagaccatgaagtggctgctaacacatgcttgacatgctctcccctccagcccatctcgttagaggcagatcgtgcgcgtacagcgacttgtctgcctagatcatggcagcatcctctccgctgaacgaccaagagtactgagttgtgctctgctgcgggcgctactaccaatggatggattgatcaataagcacgcgacgatgtatcgcactactaggcaactctcagatctgctgctgtacccgtagactgacgggaattgagtccttgtccgatgaacctaatagcn

SEQ ID NO: 50180 - DNA, 719 bp, Zea mays
  misc_feature: Ceres CLONE 1462450-F
  misc_feature: Pfam Name: Anticodon_1 Pfam Description: Anticodon-binding domain
  misc_feature: SWISSPROT Homolog: EC 6.1.1.9 Valine--tRNA ligase
gctcttgaactagtggatcccccgggctgcaggaattcgcacgagaccattacctagaacatcctaatcaaaaacatcgataaggtcagcagaagctatgataagtttttcttcggagatgctgctagagaaatatatgattacttctggggggattttgctgattggtatattgaagctagcaaaacacggctttaccactcgagtgacaagatcgctgctgctacagcccagagtgttctggtgtatgtgtttgaaaacatactgaagttattgcatcccttcatgccattcgtcactgaagaattatggcaggcatttccatacagaaaacaagcatttatggttactccctggcctaccactgaccttcctaaagatttgaccccccgcgaacggttccagaatttgcaatcattgataagaggaatcagaaatgttcgagcagaatattctgttgagccagctaaacggatatcagcttctgttgttgctactgcggatgtcctggaatacgtatcaagggagaagcaggtcctagcattactttcaaagcttgacgttcagaacgtacattttactgaatcagcaccagccgatgcaaaccagtcggttcacattgttgctgatgaaggtttggaaggctatctaccttgggccgaaatgtttgacgtgctcgaagaggttaaaccgctcttcaagcgcctcttccagatgcg

SEQ ID NO: 50181 - DNA, 753 bp, Zea mays
  misc_feature: Ceres CLONE 1462452-F
  misc_feature: Encodes the peptide sequence at SEQ ID NO. 50182
  misc_feature (415)..(415): n is a, c, t, g, unknown, or other
aaagctggagctccccgcggtggcggccgctctagaactagtggatcccccgggctgcaggaattcgcacgagaccattacctagaacatcctaatcgaaaaccgttcacgttcctgcttttcccctgtcctgcggttttggcctttttgcccccggcttcctggcggcaacgaaacaaccagtcggttcggtcgatgcttcgcgagttggaattggacgccggccgacccgctgctcaatccgtcgagttcgacatggctactcccttggttgctgggttgtcagtggctgccgctgcattaagcggaagatacatgattagagcatggcaagccttccggacccaggcggcaatgccgcgggtgcgccgcttctaccctggtggattccagggggaaatgaatcgaaccccanctgcattgatcctcggcgtcagagaacgtgctacagtggacaagatcaaggaggctcacaggagggtcatggtagctaaccaccctgatgctggtggcagccattacgtcgcttccaagatcaacgaggcaaaggacatgctgatgggaaaagggaagtccgggtcttcgatcttttagctgacacaaagctcattctgctgtggcgtgatcaggctgtagctttttcaagggactgacagttgcacgtttcaaatttcttaacaatgctctgctgcttgtaccatctatcatagaggatacagatacagatactgaatttgatcaacttattatctg

SEQ ID NO: 50182 - protein, 112 aa, Zea mays
  misc_feature: Ceres CLONE 1462452-F
  misc_feature (57)..(109): Pfam Name: DnaJ Pfam Description: DnaJ domain
  misc_feature (54)..(54): Xaa is any aa, unknown, or other
MATPLVAGLSVAAAALSGRYMIRAWQAFRTQAAMPRVRRFYPGGFQGEMNRTPXALILGVRERATVDKIKEAHRRVMVANHPDAGGSHYVASKINEAKDMLMGKGKSGSSIF

SEQ ID NO: 50183 - DNA, 724 bp, Zea mays
  misc_feature: Ceres CLONE 1462453-F
  misc_feature: Encodes the peptide sequence at SEQ ID NO. 50184
  misc_feature (408)..(408): n is a, c, t, g, unknown, or other
ctccccgcggtggcggccgctctagaactagtggatcccccgggctgcaggaattcgcaccagacctttacctaaaacatcctaatcgaaaaaggaaatcccctctggtctccccgtcccccattccacccgccgccgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaattggagtgaacactattcctggtattgaggaggtcaacatcttcaaggatgatattgttatccaattccaaaaccctaaagtgcaagcatccattcctgcaaaccaccccntagtcagtggagtaccccagacaaaaagtctacaagaccttctgccaacaattatcaaccaactgggccctgataacctggagaacctcaagaggcttgctgagcatttccagaagcaggtacctggtgccgaagccatcgccagtgcagctgcacaggatgatgacgatgtccctgagcttgtcccaggagagacatttgaggaggctgcggaggtgaaggaggtgcctgaagcggaaccggaagagaagaaagagtcggaattttgttgcgtgtcctatccattgtttgtgaatggtcgttttggtgtaccata

SEQ ID NO: 50184 - protein, 187 aa, Zea mays
  misc_feature: Ceres CLONE 1462453-F
  misc_feature (34)..(92): Pfam Name: NAC Pfam Description: NAC domain
  misc_feature (83)..(83): Xaa is any aa, unknown, or other
MNVEKLKKMAGAVRTGGKGSMRRKKKAVHKTATTDDKRLQSTLKRIGVNTIPGIEEVNIFKDDIVIQFQNPKVQASIPANHPXVSGVPQTKSLQDLLPTIINQLGPDNLENLKRLAEHFQKQVPGAEAIASAAAQDDDDVPELVPGETFEEAAEVKEVPEAEPEEKKESEFCCVSYPLFVNGRFGVP

SEQ ID NO: 50185 - DNA, 962 bp, Zea mays
  misc_feature: Ceres CLONE 1462454-F
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (580)..(580): n is a, c, t, g, unknown, or other
  misc_feature (632)..(632): n is a, c, t, g, unknown, or other
  misc_feature (671)..(671): n is a, c, t, g, unknown, or other
  misc_feature (672)..(672): n is a, c, t, g, unknown, or other
  misc_feature (687)..(687): n is a, c, t, g, unknown, or other
  misc_feature (689)..(689): n is a, c, t, g, unknown, or other
  misc_feature (691)..(691): n is a, c, t, g, unknown, or other
  misc_feature (739)..(739): n is a, c, t, g, unknown, or other
  misc_feature (741)..(741): n is a, c, t, g, unknown, or other
  misc_feature (742)..(742): n is a, c, t, g, unknown, or other
  misc_feature (768)..(768): n is a, c, t, g, unknown, or other
  misc_feature (814)..(814): n is a, c, t, g, unknown, or other
  misc_feature (854)..(854): n is a, c, t, g, unknown, or other
  misc_feature (898)..(898): n is a, c, t, g, unknown, or other
  misc_feature (899)..(899): n is a, c, t, g, unknown, or other
  misc_feature (952)..(952): n is a, c, t, g, unknown, or other
ggaggggggtttttttgttgggttnnncncaccccnnnttcaagctgggctccccgcggtggcggccgctctagaactagtggatcccccgggctgcaggaattcgcacgagaccattacctagaactcctaatcgaaaaattcactacgcccccgaatacccgaaggcagacgccgccgtggtcgggcgtcttccggcgggccgtttgctgctcgcgcggccggattgaggcggcgcggcgatggatgacgggtcggcgaaacacgcgaggcagcttcttgtccgcatcttggcggaggaccccctccccggcctcgccgccagattgggctggactcgcgacccaatgggggcgttttgcgcagatccggtcccttcgcgcctcctgcagagacagggtgggctttggagggcagatttacactgcgcatcgcttctaagctatgtatctgaagaacatgccccccccaggacgctttacggattagtgctgccatccattgtctcggagggcgcttctcgcgaccaccgtccgcggcccctaactcagtgacgaggtaaactaaatgcctcgccctnatgcaaaactgggggtggtttgcatcccccaccctgaggagcgcgccgccgnttagccgggctctcgtctcccaccacctcccaccctgtnngtcatccacgttggntncnccttctttcacgagccctggctgctcggaattccctcccgagtagcgngnncgggggcttacgggcccgcgctttgngtcggcccggcagacaccgcgcgccgcctttccctgtgggcctggncatctgtcccggccggcgccccgagcgagcggtccacggnttccccccctgcgctcgttatcccccacccaccccctctgtatnntctaccctcgctcacctcgtgcgcgggggtcccccctgcccccactctacgcncatagcgcac

SEQ ID NO: 50186 - DNA, 756 bp, Zea mays
  misc_feature: Ceres CLONE 1462461-F
  misc_feature: Encodes the peptide sequence at SEQ ID NO. 50187
  misc_feature (373)..(373): n is a, c, t, g, unknown, or other
  misc_feature (387)..(387): n is a, c, t, g, unknown, or other
aaagctggagctccccgcggtggcggccgctctagaactagtggatcccccgggctgcaggaattcgcacgagaccattacctagaacatcctaatcgaaaaacgcttcccgttccttctcccagacagacagactccccagtccccacacaccaccatttccccccactccgcccatccgtccgtctccgtggctcgcctccacgccccgtaccggcgatggccgccgaggcagcgtgctgcgacgacagcgcctgctcgacgcccttcgtgagcgcgccgtccagccccgcccgggacagggacagggaaagggacacctacccgtcccacttcttcttcagcgcgccgaccagccccacccgcggcaggnacgccgccgtcccngacctggacttcgacttcgacttcgacttctcgtcgcgcttcccgtcgccgtccgccgccgccatgtgctccgccgacgagactcttcaccaacgccagatccggctcgcccccgcgctgcttcttcacccggacggggacccggaaccggacccggaccccgcccgggggcccaacaaagaaacaacaccaggggaaggcggggaaaaaaccgggcggtggggacccctccctgggcggagaggggccttttttccccttcccccacacggggggccgccccccatcccggtggcaaacccaacccccgggagaaaaaaaaaaaaaaaccgggggggggggcgttttttttttttgttccacaacccc

SEQ ID NO: 50187 - protein, 179 aa, Zea mays
  misc_feature: Ceres CLONE 1462461-F
  misc_feature (52)..(52): Xaa is any aa, unknown, or other
MAAEAACCDDSACSTPFVSAPSSPARDRDRERDTYPSHFFFSAPTSPTRGRXAAVPDLDFDFDFDFSSRFPSPSAAAMCSADETLHQRQIRLAPALLLHPDGDPEPDPDPARGPNKETTPGEGGEKTGRWGPLPGRRGAFFPLPPHGGPPPIPVANPTPGRKKKKNRGGGRFFFLFHNP

SEQ ID NO: 50188 - DNA, 759 bp, Zea mays
  misc_feature: Ceres CLONE 1462464-F
  misc_feature: Translation starting site: 310
  misc_feature (663)..(663): n is a, c, t, g, unknown, or other
  misc_feature (745)..(745): n is a, c, t, g, unknown, or other
ctccccgcggtggcggccgctctagaactagtggatcccccgggctgcaggaattcgcacgagaccattacctagaacatcctaatcgaaaagttgagagaaacctgcaggatgccatgtccgttgcaaggaacattttgaaaaatccaaaactccttcctggaggtggcgctacagagctgactgtatcagcaacactgaagcaaaagagttcttcagttgaagtggccctatgaagctgctgctctagcatttgaggcaattccaaggactttggcccaaaattgcggtttgaatgttattaggataatgacacaacttcaaggaaagcatgctaatggtgaaaatgcgtgggttggcattgatggaaggactggtgatattgtcgatatgaaagagcgaaagatctgggattcctacagtgttaaagcacaaacgttcaagacagcaattgaggctgcttgcatgcttttgagaatcgatgacattgtcagcggtatcaagaagaagcaggctcctggagcctcagctccaaagcaaccccaaattgaaactgagggcgatgctgacaatgagcagatgattccagagtagaggctgtggcgaacctgcactggcaaagttatttactagtgtcaaggtagcacttcgagcagagttcanttttggtggttagccttagcttaaagatgcacctttgtttatatagtttgatgagtggtacgaggggtttggggatccaagnttttgagtgtggtt

SEQ ID NO: 50189 - DNA, 853 bp, Zea mays
  misc_feature: Ceres CLONE 1462465
  misc_feature: Encodes the peptide sequence at SEQ ID NO. 50190
aaattgtaaccgtgttgcaacttgcaaccggcctatctccttgcccgcgaagccatggcggatgcccccgcgatggcctcatcaccaccggcgtccgctgacgacggcggtccatcctcgccttccgtagccgtccctcgtgtacttccctccagattgctcctagacaccccgcctccttccagcggtagggcgcggggcccgcggggcggcagtgcggctgcggcgtcggggcgcggcggcagtgcggctgcggcgtcgaggcgcggcgggcgaggcggaggcacgaggagggagtccactttgccggctgcggcttcaaacggtacaggagggaggaggccggagcgggactggctcgccgaggcggttatgatgatcgggcggccagtcgaggacgcgggactggcatccgccgacattcttcagctggcgatggcgaagggccctatgttcgagtggctgagctactggccggaggaggggtacctcaaggaagatcatccctactgacgcacggtgcttttcctctgctcgggtacggcaaaatcgttgatggcttcttggggtattgcaaaggcagcagcttttatcggcgtggcttgttcagtagtactagtagttaactagttatcatttttacctaattagttcagtcgaagcctccagggacgtttgtgtcactactcactagattgtatgggaagaaaaatgcgcagttccaactactctgcatgcccagaatttgcaatttgactagtttggcgaacggatccttagtactgtatgaagcttgtaatgaaaaaaaatgggcggaacatgagtcctaatctttgcaaaaaaaaaaaaaaaa

SEQ ID NO: 50190 - protein, 152 aa, Zea mays
  misc_feature: Ceres CLONE 1462465
MADAPAMASSPPASADDGGPSSPSVAVPRVLPSRLLLDTPPPSSGRARGPRGGSAAAASGRGGSAAAASRRGGRGGGTRRESTLPAAASNGTGGRRPERDWLAEAVMMIGRPVEDAGLASADILQLAMAKGPMFEWLSYWPEEGYLKEDHPY

SEQ ID NO: 50191 - DNA, 715 bp, Zea mays
  misc_feature: Ceres CLONE 1462466-F
  misc_feature: Encodes the peptide sequence at SEQ ID NO. 50192
  misc_feature (715)..(715): n is a, c, t, g, unknown, or other
tccccgcggtggcggccgctctagaactagtggatcccccgggctgcaggaattcgcacgagaccattacctagaacatcctaatcgaaaagatccaattccaccctcgttctcaggcactgtcacacagacacagctgacctgccactgccaggaaagtaggtcgaggatgccccgcagcggcttctcggggtccttcaggtcgcccaagatcgacgtcgtcatcgacatgggaaaccccttcctcaaccgcaccgtcgacggcttcctcaagatcggcgccgtcggcgcctgcaaggtggctgccgaggagaccttcgagtgcctccacaggggggatgtttcgaagcacaaggttgagcatgccctgaggaagatgtgcaaggagggcgcatattggggcactgttgctggagtttatgtgggcatggtgtacggcgtggaaagggtccgtggccgcagtgactggaagaacgcgatgatcgggggcgccttgtccggcgccctgatctccggcgccagcaacagcgacagaggcaaggtcgtcaaggacgccatcaccgccggcgcggtcgccacagccgtcgagttcatcaactgcattacctagccgagcaaggagcaactgcatttgcagtgccattgtcgtgcaaaatatgaataaagtacttgccatgtccagctcataaaccactccacaccttcagtcttcgtn

SEQ ID NO: 50192 - protein, 146 aa, Zea mays
  misc_feature: Ceres CLONE 1462466-F
  misc_feature (18)..(146): Pfam Name: Tim17 Pfam Description: Tim17/Tim22/Tim23 family
MPRSGFSGSFRSPKIDVVIDMGNPFLNRTVDGFLKIGAVGACKVAAEETFECLHRGDVSKHKVEHALRKMCKEGAYWGTVAGVYVGMVYGVERVRGRSDWKNAMIGGALSGALISGASNSDRGKVVKDAITAGAVATAVEFINCIT

SEQ ID NO: 50193 - DNA, 755 bp, Zea mays
  misc_feature: Ceres CLONE 1462477-F
  misc_feature (440)..(440): n is a, c, t, g, unknown, or other
  misc_feature (472)..(472): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (498)..(498): n is a, c, t, g, unknown, or other
  misc_feature (499)..(499): n is a, c, t, g, unknown, or other
  misc_feature (505)..(505): n is a, c, t, g, unknown, or other
aaagctggagctccccgcggtggcggccgctctagaactagtggatcccccgggctgcaggaattcgcacgagaccattacctagaacatcctaatccaaaagaaatttaggaagcaaacaaaagctccgctgccttgtctgcaatggcgtctggcgcttttcccacgagcgccaactgcccttctcgctctcctccataggcagaccccgcgctcccccaacgccgctccgccgaccccagtcatatctcccgccccccagctgaggcaatggggtcctcgtcctccccgtccccgccgccgccgcccatgatcgggcgggccgggaacctcaccgtcttcatcacgccgccgtctcctgctagcacgccgcgttgcgctttgcgcacgccgccgcccgagtctccgcgctccgatttctctacacccacccgacagangatagcccccgtcgcctccccttctccctcgncgcagaaacacgnnnnaaaaaaaaanncccccntatcgcggcgcctgcggtggtgtccaccccgcccccgccgtcagctcctggaaggtcgcgccaccccccgtgcatgtgccacccccccaatacaaaaaggcccccgccggaagcagccccaaacgaacgccttttgcttcctttggaacccctcccccggtcccgaaaccccaccccacccccccaaaaaacgggcacaccgggtccggttgaacccccccaaaacacgggcccccccccccacaccccc

SEQ ID NO: 50194 - DNA, 763 bp, Zea mays
  misc_feature: Ceres CLONE 1462478-F
  misc_feature (431)..(431): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaatctcacagaccgacaacgccctagggaagcagcaagcgcacacgtaaacgtacacatacctcggcgagcaaaagggaaaacgctgatcggatgaactaagcccgcagccatgccgacggcgacgggcacggccacgggagctcctcgccaagcggcgctcttcctgccgctgctgctgctcctgctcggcctcaacgcgacgtccggccgccgccgcgcgcgcgggcgtcgccgtggaacccgagctcacgtgcaccaagccgtcaccggtccgcagaagcgcagcgtgaagcgcccggcccggtacctcgagcccgacgattccgggntcagcctaccggaatgcctggttcagcctccccgggatggggcctcccggtggaccgcctttaccggtgcccaggggtggtatccccccgccgctgggggcgccaccgtgaaggccccaaaaggcgcctgtaaaggaaaaagtacccggccccaaaaggggtttccccaaaaaaggnccccgaaaaggatttgtgggcccttggggagcgttttttccccccccctggggagtaattgggcccccccccggtgttaaacacccccccctttttttgggtgcaacaaaagggaggggggggggccccactcacttttgtgtttttagccccca

SEQ ID NO: 50195 - DNA, 776 bp, Zea mays
  misc_feature: Ceres CLONE 1462482-F
  misc_feature: Encodes the peptide sequence at SEQ ID NO. 50196
  misc_feature (373)..(373): n is a, c, t, g, unknown, or other
  misc_feature (511)..(511): n is a, c, t, g, unknown, or other
aagctggagctccccgcggtggcggccgctctataactagtggatcccccgggctgcaggaattcgcacgagaccattacctagaacatcctaatcgaaaaataatactccatcgggagtttctgggagtggtaaacgtcggttttctgaggcaccgggacaatcccagtacagggatcgagctgcagaaagaccaaatctgtatggatcatctcatggcactgatactgttggattggattccactggtgactatccgtcccgaaagggttcaagtgagatagggtcgatgccgtttcctcctggtgtgggtgacacgttccagtggcgaaattggcaacagcgaaaactatgaagttattaccgctgatanaccaatcgatgaaagcaatgtgggcaaccgcattctacaccacatggggtggcaggagggactgggtctcggagaggatgccagcggtatcaaggaaccagtccaggcaaaatccgtcgacgccagggctggactggnaagtcagcagcggaagcctgatccatcccttgaaacccaagccggggacagctaccagaccatcatccagaaagaaggccatggccagattcaaggagaatgtcttagctacactgttttatctattttattggcgcattttgtagtccgttttttacaccatgcatttttttgtttgctcgtgtggtttttaaataaactgatccccatgaattgggatttatcatcctgaaaaggggcactacataattccaaaacctgcaag

SEQ ID NO: 50196 - protein, 108 aa, Zea mays
  misc_feature: Ceres CLONE 1462482-F
  misc_feature (32)..(32): Xaa is any aa, unknown, or other
MGWQEGLGLGEDASGIKEPVQAKSVDARAGLXSQQRKPDPSLETQAGDSYQTIIQKEGHGQIQGECLSYTVLSILLAHFVVRFLHHAFFCLLVWFLNKLIPMNWDLSS

SEQ ID NO: 50197 - DNA, 748 bp, Zea mays
  misc_feature: Ceres CLONE 1462483-F
  misc_feature: Encodes the peptide sequence at SEQ ID NO. 50198
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (488)..(488): n is a, c, t, g, unknown, or other
  misc_feature (490)..(490): n is a, c, t, g, unknown, or other
  misc_feature (491)..(491): n is a, c, t, g, unknown, or other
  misc_feature (555)..(555): n is a, c, t, g, unknown, or other
aaagctggagctccccgcggtggcggccgctctagaactagtggatcccccgggctgcaggaattcgcacgagaccattacctagaacatcctaatcgaaaaacactctcactgcgattccgctctcacccacctcctcttcctctcccctcccgggatcacgaggcgacgccacccgcgagattgacgggagccgatagatctgcgcggctacgctacgcagtcacactgcgctcacctgacctgactccgctctgttcatgccgcggaggtagagtccgcgggccggcggtggccacggccagcctcctcggccgtcgggatgaagccgcggaggttcggctacggctacggctacggctacggccgggtcaggcgcgcggcggcgctgctgctgctgctgctgctctgcctctgcctcagcagcctgttcctcctggctctccatggctcctccacgccgctgggaccccgcgnnncgcggcgcngnncgcgaaacaaaaattgccaagcgcaggcggaggtcaaggaggcccccctgccccgggggactcnagggtcgcttctcttcatggggggaaaccgcttccggttgaattggctgggaggccttcttccggggggaaaggagggagggtttccctcccgggcatccgggcggggttctgggttccaaaacccccttgattccaatttttaaaaccggggggaaaaaaaacccccggggaatggggggaggaacttaccc

SEQ ID NO: 50198 - protein, 125 aa, Zea mays
  misc_feature: Ceres CLONE 1462483-F
  misc_feature (52)..(52): Xaa is any aa, unknown, or other
  misc_feature (53)..(53): Xaa is any aa, unknown, or other
  misc_feature (56)..(56): Xaa is any aa, unknown, or other
  misc_feature (57)..(57): Xaa is any aa, unknown, or other
  misc_feature (78)..(78): Xaa is any aa, unknown, or other
MKPRRFGYGYGYGYGRVRRAAALLLLLLLCLCLSSLFLLALHGSSTPLGPRXXRRXXRNKNCQAQAEVKEAPLPRGTXGSLLFMGGNRFRLNWLGGLLPGGKEGGFPSRASGRGSGFQNPLDSNF

SEQ ID NO: 50199 - DNA, 756 bp, Zea mays
  misc_feature: Ceres CLONE 1462484-F
  misc_feature: Encodes the peptide sequence at SEQ ID NO. 50200
  misc_feature (1)..(1): n is a, c, t, g, unknown, or other
  misc_feature (473)..(473): n is a, c, t, g, unknown, or other
  misc_feature (510)..(510): n is a, c, t, g, unknown, or other
naaagctggagctccccgcggtggcggccgctctagaactagtggatcccccgggctgcaggaattcgcacgagaccattacctagaacatcctaatcgaaaaattcccaattcctcatctgcttcgcttccccccaaatcgaatcctcatcgctccgtctatatggcgactctaaccatgcagccgatcggtcccacccctgctccggctgcgcagcaagacccgagcaagggagagaatcctcctaccgtggatggtagcgatctgggtgacatcgactcgggctgggttatcctcaagaactcggatgtcgtttccgcggatttggcagccgccgccgtcggtggcggtcagcgtctaggctcttctacgattcctagctgggcacggtgggttctcgaaggtgtggtttaaccgctcgtgccgttctacaacagagttaggcatctcgaaaaagaaacggttggattcntggaaatgctgttggagtgtggaacatttacctgaantaacaaaaaaacttacctgggaaaggggcctaaaccactttcctgaaaaaggggtcccggcaaaacgcttgggaaaaggtgaaaccttgcctaaagtaatggataaataatccaaaaaagttaaaacctcccctaaaaaatccacagggcccgggaaaaattgggcgccgtgtgggacccgccccccccggacttgtaaagagaactttttaaaaaacccctctaagggggggtgtgagccaaaaa

SEQ ID NO: 50200 - protein, 83 aa, Zea mays
  misc_feature: Ceres CLONE 1462484-F
MATLTMQPIGPTPAPAAQQDPSKGENPPTVDGSDLGDIDSGWVILKNSDVVSADLAAAAVGGGQRLGSSTIPSWARWVLEGVV

SEQ ID NO: 50201 - DNA, 777 bp, Zea mays
  misc_feature: Ceres CLONE 1462488-F
  misc_feature (649)..(649): n is a, c, t, g, unknown, or other
  misc_feature (663)..(663): n is a, c, t, g, unknown, or other
  misc_feature (664)..(664): n is a, c, t, g, unknown, or other
  misc_feature (675)..(675): n is a, c, t, g, unknown, or other
  misc_feature (743)..(743): n is a, c, t, g, unknown, or other
  misc_feature (770)..(770): n is a, c, t, g, unknown, or other
aagctggagctccccgcggtggcggccgctctagaactagtggatcccccgggctgcaggaattcgcacgagaccattacctagaacatcctaatcgaaaaatgatgattgtttgttttctaagctcgttcgccctctcttttctctccgtccaacgacggcgcgattcagatccaggcatacaggccatccttccgccgccgcggactgcgcctaatcttccttctccagcagccgggcgttcccgtcgtcctcgatcgtcccctggactggatcgcaacggagatccagccggacctgcggtggtcccttccttttctcgcgacgagagtctgtcagatgatgacccagaaaatgaaggtttccggaaatgtgagtgtgtgattcagtagatttcttgtgtgcacaacaagcctgacaggaacatctcctcatgggaagcccatgtcctgctgagaaggatatgccgtatgttcttctgggaaggatatgccacacccagtgatttcattgcaactggaacgatcgatgacagtcaaaacaaagcaaacggtgatgagtcgatattgtgctagattatttgttggttctacgcttaactagtctgctcggcagggttatagtttcgatgcccacctgtacaataccnagatcccattcctnntcttttgttgncatgttttggttctctgaacttcccatcactttttcacgcccgctgtaccatatgaggctgccctggntactctgccatgggatggtgggatccntgtaaaa

SEQ ID NO: 50202 - DNA, 766 bp, Zea mays
  misc_feature: Ceres CLONE 1462489-F
  misc_feature: Encodes the peptide sequence at SEQ ID NO. 50203
  misc_feature (746)..(746): n is a, c, t, g, unknown, or other
tggagctccccgcggtggcggccgctctagaactagtggatcccccgggctgcaggaattcgcacgagaccattacctagaacatcctaatcgaaaactatataaaccgaccccaacgcatccattatattcagcttcttgatctcacacgaaggcatggcgacggagatccagggctactacgatgacggcaccgccgtggtgtcgttcgacgtgcacaacatcgacaccacgctgacgaacttgggcagcgtggtggagtggtggctgggtgagacctatcgcctccaccaccgcggccacatcgccggcctcgacgtggagtggcgccccgctcgcgtgccgggccccgtccccgtcgccgtgctgcagatctgcgtcgaccaccgctgcctcgtattccagatcctccaagccgactacatccccgacgccctgtccaggttcctcgccgaccgccggttcaccttcgtgggggtcgggatcagcggcgacgtcgcaaagctgcgggccgggtacaggctgggggtggcgagcgccgtggacctgcgcgttctcgctgccgacacgctggaggtgcccgagctgctccgcgcggggcttcaaacgctggtgtgggaggtgatgggcgtgcaaatggtgaagccgcaccacgtgcgcgtcagcgcctgggacacgcccacgctgtcggaagacagctcaagtacgcctggcgcgacgctttcgcctccgtcgagtcggccggnagctctacgaagcgactaca

SEQ ID NO: 50203 - protein, 203 aa, Zea mays
  misc_feature: Ceres CLONE 1462489-F
  misc_feature (197)..(197): Xaa is any aa, unknown, or other
MATEIQGYYDDGTAVVSFDVHNIDTTLTNLGSVVEWWLGETYRLHHRGHIAGLDVEWRPARVPGPVPVAVLQICVDHRCLVFQILQADYIPDALSRFLADRRFTFVGVGISGDVAKLRAGYRLGVASAVDLRVLAADTLEVPELLRAGLQTLVWEVMGVQMVKPHHVRVSAWDTPTLSEDSSSTPGATLSPPSSRPXALRSDY

SEQ ID NO: 50204 - DNA, 794 bp, Zea mays
  misc_feature: Ceres CLONE 1462490-F
  misc_feature: Encodes the peptide sequence at SEQ ID NO. 50205
  misc_feature (489)..(489): n is a, c, t, g, unknown, or other
  misc_feature (709)..(709): n is a, c, t, g, unknown, or other
  misc_feature (710)..(710): n is a, c, t, g, unknown, or other
aaagctggagctccccgcggtggcggccgctctagaactagtggatcccccgggctgcaggaattcgcacgagaccattacctagaacatcctaatcgaaaaattgagcccgacagcaaaaagaaaggtgacgtttctctttcttggttccggcgccccaccgggagagtgagctgctgcctgcgcaactcgagcgtcgcttgtcgcgagcaccgcggcctcgatccgtcaagctaaaagcatgtctggacagcaggaccacgctagtaaaagctctagctcaagcatcagcagcagtactcaagagagcgaggaggaagcaccctgtccgaagcgtcaccattggtagcctccttgcccaagcaaatagcaccagtggacatagtcttgggaagcgcctgtcccatttggggtcaatccccgtatactccccgagttaatggaaaaatccccaatgttggtaatgcaacactggaccacgaacgattngctggaaaggttgggcacttatggtctagctgaatttcaaatagagggggatggggaattgtcagttccgagctttggctgatcagatatatcacaatcctgactatcataagcatgtgagaaaagctgtcatgaaacagctgaaggaattcagaaacaatatgaaagttacgtaccgatgggaatataaggtgtacttgagaaaatgaaagatctgggnnaagggggagatcatctgacctttacagcagctgcagatcggagctttgctaaactccctgggtggagacactaccaattcttgt

SEQ ID NO: 50205 - protein, 52 aa, Zea mays
  misc_feature: Ceres CLONE 1462490-F
MGNCQFRALADQIYHNPDYHKHVRKAVMKQLKEFRNNMKVTYRWEYKVYLRK

SEQ ID NO: 50206 - DNA, 767 bp, Zea mays
  misc_feature: Ceres CLONE 1462491-F
  misc_feature: Encodes the peptide sequence at SEQ ID NO. 50207
  misc_feature (583)..(583): n is a, c, t, g, unknown, or other
  misc_feature (594)..(594): n is a, c, t, g, unknown, or other
ggagctccccgcggtggcggccgctctagaactagtggatcccccgggctgcaggaattcgcagagaccattacctagaacatcctaatcgaaaaaatcaagcacgcatccacgaaatccgagagcagcagcagcagaccaagatcgagggagggaggaagacagacagaccgacagacagacagacagagagatggagcgaatgagctcgtcggtgcagtcctgggtggaggaacacaagctctcgtccatcggagccgtgtggccgacggcggtgggcgcgtcagtggcgtacagccggcggagggcgccggcgcgagccacgagcctgcgcctcatccacgccaggatgcacgcccaggcgctcacgctcgccgtgctcgggggagccgcgctcgcgcaccgctattacggcagcagcgagaggaggcagaggcaggaggacctgaactacggcttctactcccagctgccgccggccaccgacgccgagggcaacgagaacgagcgctggagctggtagtggcaaggcatactatcagtgagtgacccgtgagccagtgacttccgccttcagaggcantacatccatcngagggagtgaaggaagacggacactaaatagattaattagtactagtagcaataataataattgcatgcctgttttgccatcaatgatacatgacttggcgcctgatcctgttccgtccgggcccataaccccggaagcagctagcccatggtaggggggccctgttatgctt

SEQ ID NO: 50207 - protein, 109 aa, Zea mays
  misc_feature: Ceres CLONE 1462491-F
MERMSSSVQSWVEEHKLSSIGAVWPTAVGASVAYSRRRAPARATSLRLIHARMHAQALTLAVLGGAALAHRYYGSSERRQRQEDLNYGFYSQLPPATDAEGNENERWSW

SEQ ID NO: 50208 - DNA, 837 bp, Zea mays
  misc_feature: Ceres CLONE 1462492-F
  misc_feature: Encodes the peptide sequence at SEQ ID NO. 50209
  misc_feature (462)..(462): n is a, c, t, g, unknown, or other
  misc_feature (837)..(837): n is a, c, t, g, unknown, or other
tccccgcggtggcggccgctctataactagtggatcccccgggctgcaggaattcgcacgagaccattacctagaacatcctaatcgaaaaacccgcgcagaaggcccccgccgctcaagctaccggtgccctaaaccccgatatcttcttcgcctacctttcctcctcagcacccaatctccgaccttcagggttccgccgccatgccgcagggagaccacatcgagcttcaccagaagcgccatgggaagcgcctggaccacgatgaacgcaagcgcaagcgcgaggagcgaaaggtgcacaagtgctcgaaggacgtccgcaatttgattggtgctaaggggaagaggttcgctaagaaaccccacggagagaaggcacagatgatgaagagcctggggccccccccaccaatacaaataacccattagaagggtcgatgatagatgttccaaaacccnagcctcttccctcggaaatctactcgtaatggggatcacataaatggtggccagaggtcctgaatcagaagcattcaattcggaaaaaggaaaggaaaaaagctccgcaaaatgggtaatttctctcctggcagaaactgacataccttctcatctcaaaaaaaaataacggtacaattgctcccaactaaattgtgaaagtctatacaactccacgcagtgatcaacaaatcggcgttctcgaaaagccttcttttttcgtgcatccccgcatcttcacattataagtcatcggtatattttacatcgcgtccctagcgaagaggacagggcgctgatttactatcatctcgcctaatgtctaatcttccaccn

SEQ ID NO: 50209 - protein, 75 aa, Zea mays
  misc_feature: Ceres CLONE 1462492-F
MPQGDHIELHQKRHGKRLDHDERKRKREERKVHKCSKDVRNLIGAKGKRFAKKPHGEKAQMMKSLGPPPPIQITH

SEQ ID NO: 50210 - DNA, 743 bp, Zea mays
  misc_feature: Ceres CLONE 1462493-F
  misc_feature: Encodes the peptide sequence at SEQ ID NO. 50211
  misc_feature (476)..(476): n is a, c, t, g, unknown, or other
  misc_feature (495)..(495): n is a, c, t, g, unknown, or other
aaagctggagctccccgcggtggcggccgctctagaactagtggatcccccgggctgcaggaattcgcacgagaccattacctagaacatcctaatcgaaaactcttttcccccaccccatcaacacaatttacccttcgtcttcccgcttccagcgcacccccatcttgagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcacaaggcatgggtacaaaccctcaccctgcagagctggccgcttcagcggtggcggcttctgaacctacacgcgggcgcgcgtgggtgcgatcctagtgcacgatgctgacgccaccgattcgtcctccagcgaagatgaaggcacgccacttcttcctcgnagaagtccaggggtggtancagcaacctgaacgtgaaggaccctgttaatgaaacggctggggcaagctcggccgttcggtttcggggacctcaatcaaaagccctggggcgcctgggcctccgaaaaccccaaccccgaaaaccccccaaaaatgtggttggaacttcaaaacccttaaagaagtggcaaagccttaaatgctgggaaaatcccttttccgggggtaagggcaataaccaatttcctgggaacccgtaattcgccc

SEQ ID NO: 50211 - protein, 43 aa, Zea mays
  misc_feature: Ceres CLONE 1462493-F
MKRLGQARPFGFGDLNQKPWGAWASENPNPENPPKMWLELQNP

SEQ ID NO: 50212 - DNA, 779 bp, Zea mays
  misc_feature: Ceres CLONE 1462495-F
  misc_feature: Encodes the peptide sequence at SEQ ID NO. 50213
  misc_feature (454)..(454): n is a, c, t, g, unknown, or other
  misc_feature (462)..(462): n is a, c, t, g, unknown, or other
aagctggagctccccgcggtggcggccgctctagaactagtggatcccccgggctgcaggaattcgcacgagaccattacctagaacatcctaatcgaaaaaaaacttagcaatccgtacattccgctcatattcctcaccggtgaccttcctcacctgcgtcagacagagaaagccgagattagcggcggcggcgatggcactcccggcgtcaagctccggcctcttccgcttcgtctccccccgcagccgtccccagtccactgacatcgtggccgctgcctcctggggagtcttcgccggcaccgccggcctttacctcgtccagccatttgactggattaagaagactttcttcagaaacctgaaccagaggcatgagtctccaggcagaaaaatggctgcaattctgcactttggtaccacacttttggtccgggatgattcctgatgnatactcancaaataaatgaaacccccccgtcttctcctgtttggatttattcaaaggaggcttcctcttggctggaaaatccccagggggagggggacttttgatttgtttttcaccccccaaaaaacggggttggtccacccgggtttaggggcctgggggggttttctaaaaaaaaaaaaaaaatttttttttcccctcacaccccgggggggggcccggccacccttccccccaaaagaggggattaaaccccgccccccggggcgcttttttaaacgcggggggggaaaaccgctggggcccctcaatatcctcgggggcc

SEQ ID NO: 50213 - protein, 84 aa, Zea mays
  misc_feature: Ceres CLONE 1462495-F
MALPASSSGLFRFVSPRSRPQSTDIVAAASWGVFAGTAGLYLVQPFDWIKKTFFRNLNQRHESPGRKMAAILHFGTTLLVRDDS

SEQ ID NO: 50214 - DNA, 752 bp, Zea mays
  misc_feature: Ceres CLONE 1462500-F
  misc_feature: Encodes the peptide sequence at SEQ ID NO. 50215
  misc_feature (411)..(411): n is a, c, t, g, unknown, or other
  misc_feature (439)..(439): n is a, c, t, g, unknown, or other
  misc_feature (448)..(448): n is a, c, t, g, unknown, or other
  misc_feature (450)..(450): n is a, c, t, g, unknown, or other
  misc_feature (451)..(451): n is a, c, t, g, unknown, or other
aagctggagctccccgcggtggcggccgctctagaactagtggatcccccgggctgcaggaattcgcacgagaccattacctagaacatcctaatcgaaaaaaccccgcgcgccggtgaccatggagttcatcgacccctgggactcccagtcccgcgctcgcgtcgtccattccggcgccaactccacttcgttctcctcctccactgccaaagcacccctctccctccgccacgccgcatcttgcgccgccgcggccgtcgcacttctcgccgccgcgttctacctcctcccgacctaccagatcctctcctccctcctcatatggatcgcttcgtccctgctcctcgcccccttcgcgcccttgtcggccactggcggcgacatctccgtcggccgaggccgcgtcgntccggctccagaacggccccagaaccangccggaacnanngccgcccccggcgggggcgtcgccagaacccagtccggagtccacaaaaaccctcaaatcgggaactccccccggccatcggcccgatcaatggatccgttggaaaaggaaacaatggggtgggaaccctggtgaaaggcgcaaagggaagagaaaccccggaaagggatgaccaaaattgggacctctccggggacaaaggaaaaacccccgggggaaccccacccgggggaaaaaaccccccgggtttgggcgccccccccccaaaaaaatttccccggggaaaaaggggcgccccccg

SEQ ID NO: 50215 - protein, 154 aa, Zea mays
  misc_feature: Ceres CLONE 1462500-F
  misc_feature (97)..(97): Xaa is any aa, unknown, or other
  misc_feature (106)..(106): Xaa is any aa, unknown, or other
  misc_feature (110)..(110): Xaa is any aa, unknown, or other
MEFIDPWDSQSRARVVHSGANSTSFSSSTAKAPLSLRHAASCAAAAVALLAAAFYLLPTYQILSSLLIWIASSLLLAPFAPLSATGGDISVGRGRVXPAPERPQNXAGTXAAPGGGVARTQSGVHKNPQIGNSPRPSARSMDPLEKETMGWEPW

SEQ ID NO: 50216 - DNA, 750 bp, Zea mays
  misc_feature: Ceres CLONE 1462505-F
  misc_feature: Encodes the peptide sequence at SEQ ID NO. 50217
  misc_feature (373)..(373): n is a, c, t, g, unknown, or other
  misc_feature (415)..(415): n is a, c, t, g, unknown, or other
aaagctggagctccccgcggtggcggccgctctagaactagtggatcccccgggctgcaggaattcgcacgagaccattacctagaacatcctaatcgaaaaatcccccggtgaggtagagcagaccacacctcccctccctctcgtgtcggagcctccgcctcggcttgaccccaccaacccgcagctcgctcccaccaaacccactcccgaacaatggcgtcggcatccaacgaggacgtgatcgggaagctcaacgtccgcgtggtgcggggcaacaacctggtcatcgccgacccgctcacgcacaccagcaacacctacttcgtcctccagtacggcgctcaaaaaggtgaagactagtgtccagagnagaactacaatccagtgtggaacgatgtactgcagctctcantaacacatcctacgaggcggtgcaccttgaagttattgatgaagaaaagtcacagcaaacaacgcctgggtgttgctgaaatcacattactggactcacaaggctgcaaaactggacctgaacccccctctgagggaacagaattaaaaacctacctgccgaaaaaactaccttgggggaaaacctgttcagggaaaagaggggggggcccgaatttttaaaaacttaagaaagcccaagggccctattgggccacacggagggtttttttccgggagaaatttaaaccccccaaaaaaggggaagaccccccccgcccccctatttttttggaa

SEQ ID NO: 50217 - protein, 48 aa, Zea mays
  misc_feature: Ceres CLONE 1462505-F
MASASNEDVIGKLNVRVVRGNNLVIADPLTHTSNTYFVLQYGAQKGED

SEQ ID NO: 50218 - DNA, 773 bp, Zea mays
  misc_feature: Ceres CLONE 1462508-F
  misc_feature: Encodes the peptide sequence at SEQ ID NO. 50219
aaagctggagctccccgcggtggcggccgctctagaactagtggatcccccgggctgcaggaattcgcacgagaccattacctagaacatcctaatcgaaaaatctctttcgtatgttctcctgttttttccttctatagcgcaacgccgcctcctctctcagccttatccccaaatcgcttcttctctgttgattccatggtgcatcaaccgagctcctctccctggccgatccatggtgctcgtctctagctcatgtcttgccgccggccgagcccctccccagcgcccttggagccggcgtcctctgccctcatctcattccccgacgccgccctctcccctcggtgctctgctggtcggcgtcttctccctgcccgacgtttctggcgccatggccgccgcgccttgggtcgcctgctccactgcgccgatccgcccatctccctgctgccgctctcccatggcgcgtccctgcatcttgcttcagctcgctctgccatctcccttggcgccctagccccaacgccgagctccctacccggtcgcgcccccggtggttgaactcgccgagcttccttttctatcgctcgacctcgcccattcggcgccctcatctcaagccagtccagcctctctactcgccactctcctctatccccttgctgttataacatggcgagctacctccatgtgccagtagagttcgtcattccctgagcagcacctccctccatggatgccacgttgccgacttgtgcagttcatattta

SEQ ID NO: 50219 - protein, 94 aa, Zea mays
  misc_feature: Ceres CLONE 1462508-F
MVLVSSSCLAAGRAPPQRPWSRRPLPSSHSPTPPSPLGALLVGVFSLPDVSGAMAAAPWVACSTAPIRPSPCCRSPMARPCILLQLALPSPLAP

SEQ ID NO: 50220 - DNA, 767 bp, Zea mays
  misc_feature: Ceres CLONE 1462518-F
  misc_feature: Encodes the peptide sequence at SEQ ID NO. 50221
  misc_feature (435)..(435): n is a, c, t, g, unknown, or other
  misc_feature (537)..(537): n is a, c, t, g, unknown, or other
  misc_feature (649)..(649): n is a, c, t, g, unknown, or other
  misc_feature (651)..(651): n is a, c, t, g, unknown, or other
  misc_feature (652)..(652): n is a, c, t, g, unknown, or other
  misc_feature (676)..(676): n is a, c, t, g, unknown, or other
  misc_feature (700)..(700): n is a, c, t, g, unknown, or other
  misc_feature (701)..(701): n is a, c, t, g, unknown, or other
  misc_feature (716)..(716): n is a, c, t, g, unknown, or other
  misc_feature (717)..(717): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
tggagctccccgcggtggcggccgctctagaactagtggatcccccgggctgcaggaattcgtctcacccctaatcgaaaaccacaacgagagcagagcaggcaagacagctcgcaccagcggtccatccatccccatggcgcccgccttcggccgctccatctccttcccgctgagcccggcacgctcctcctcctccacgaagcaggcgcgccacgtgcgctccatcagcctcccgacctgccgcgcgcacccgctgctcgcccacctccacgccacagcccgcgccgcccgcgcctgggccgccgccaccgccgacccctgcaccaccaccaccacctccccgtcctcgggcctcgcccacctcgccgcgctccacgccgcgctcgccgagctcctcgtcctccctgagccccgcgccgcgctcgctaccgnccggcgccaccgccttctcggaccgcctcctggacggcctcctggggctggccgacgcgcacggcgcgtttcgggaagaccctggtcgacctcaggcgccangccgccaaagcgccagccgagctccaccaccgcaaactgacgcgcctaataatgggagtacgcgttacgcgaccaaaacaaatgagggcatggcccagaacacttcctcagngnntgccaccgccccctccaaactgangacgacagaatccatggggcaacnnctaacaacctaaaanntgacgcaggctcacacccaatgccnnnggacaccacaacaaaacactaat

SEQ ID NO: 50221 - protein, 146 aa, Zea mays
  misc_feature: Ceres CLONE 1462518-F
  misc_feature (100)..(100): Xaa is any aa, unknown, or other
  misc_feature (134)..(134): Xaa is any aa, unknown, or other
MAPAFGRSISFPLSPARSSSSTKQARHVRSISLPTCRAHPLLAHLHATARAARAWAAATADPCTTTTTSPSSGLAHLAALHAALAELLVLPEPRAALATXRRHRLLGPPPGRPPGAGRRARRVSGRPWSTSGAXPPKRQPSSTTAN

SEQ ID NO: 50222 - DNA, 749 bp, Zea mays
  misc_feature: Ceres CLONE 1462523-F
  misc_feature: Encodes the peptide sequence at SEQ ID NO. 50223
  misc_feature (337)..(337): n is a, c, t, g, unknown, or other
  misc_feature (367)..(367): n is a, c, t, g, unknown, or other
  misc_feature (453)..(453): n is a, c, t, g, unknown, or other
acccgcggtggcggccgctctagaactagtggatcccccgggctgcaggaattcgtctcacccctaatcgaaaacaacttatgatgataatgctattacaaatgcggttgagatatttaatacctctagtggcgccgttcacttcatggcatcaaataacgactctggtgtgagatactatgacatggagagattccagctattcaagcattttcagtttgaatggccagtgaatcatgcttcgttgagtcctgacagaaaggtggttgttattgtgggtgatgatcctgatggtctacttattgatgcaaactctgggaagacagttcattccatnaaaggacatcgggactactcatttgcatcngcttggagccctgaatggcgaacatttgctaccggcaacccaggacaagacatgcccgaatcctgggacgtggaagaaccttttcnaaatccggtcccatggtgttggaggggtaacccttgaagccatccggtccattccgctttcacctcggaatgcccagttccatgtcccatggctgaaccttgctaactttgtgcacactcctccaagtggaaaagtggcctacaacaaaggcgggaacctggaactctttgtgccaagatatccgggaaattcgtttaaccccaaaacctgaaacccttttttcctttggggggtgggaaaaaaaatttttgccacccctcttaaaatttggccccccgtgaaaacaccctctttt

SEQ ID NO: 50223 - protein, 114 aa, Zea mays
  misc_feature: Ceres CLONE 1462523-F
  misc_feature (64)..(64): Xaa is any aa, unknown, or other
  misc_feature (103)..(103): Xaa is any aa, unknown, or other
MASNNDSGVRYYDMERFQLFKHFQFEWPVNHASLSPDRKVVVIVGDDPDGLLIDANSGKTVHSXKGHRDYSFASAWSPEWRTFATGNPGQDMPESWDVEEPFXNPVPWCWRGNP

SEQ ID NO: 50224 - DNA, 772 bp, Zea mays
  misc_feature: Ceres CLONE 1462524-F
  misc_feature: Encodes the peptide sequence at SEQ ID NO. 50225
aaactggagctccccgcggtggcggccgctctagaactagtggatcccccgggctgcaggaattcgtctcacccctaatcgaaaacaagtgggagaggcacaggtttgggcttcagggtgggtttgtcacaaacccattacccgagccgaacatttcatctgcagggaaaacaatggttactcatgaaggcaggaataaggataaaactttacaaaagtgaagggcgggttaggcatgatgaacacattctgttccaagcgtgaactgctcgagtttgcttattatcatggaggcggctgtaattctcttttccaccgcgacctcttttttttcctaacgaacgaacattgtcatttttggaaactactgaaaccatggcgtgcgcgtgaactatgaatgtatgaatcactccgaagctaagctgtttgagtactatgctaagctgaggagctgcattcacatcatgtgctggagcgcgagggaggcttctttatcgaacagcctcacttgtcaccgacacaatcaggcacccccccaagccgtggactacgctgggtttggctttggcatgagaacgaccgctgtgtttgtctaagtcatatcgtaactggagaacaagtagcttataatcacgatgtatcaccatcctacagaactatggatgcgtcttgtacataggcccgatgatgcgcttctaaaaaacaaaaaaaaaacgagacgctcgaggtacccaattcccactatagtgagtcgtattacgcgcgctcacgc

SEQ ID NO: 50225 - protein, 72 aa, Zea mays
  misc_feature: Ceres CLONE 1462524-F
TGAPRGGGRSRTSGSPGLQEFVSPLIENKWERHRFGLQGGFVTNPLPEPNISSAGKTMVTHEGRNKDKTLQK

SEQ ID NO: 50226 - DNA, 750 bp, Zea mays
  misc_feature: Ceres CLONE 1462526-F
  misc_feature: Encodes the peptide sequence at SEQ ID NO. 50227
  misc_feature (369)..(369): n is a, c, t, g, unknown, or other
  misc_feature (370)..(370): n is a, c, t, g, unknown, or other
ggagctccccgcggtggcggccgctctagaactagtggatcccccgggctgcaggaattcgtctcacccctaatcgaaaactcaaccaccgccccgagatctccccttctctctcctcgcgccgttttcctctctacctctttgatccggcaatggccgcgcccgcccctgccaccaccggcgacctcctacgcgtcgaccccctcgagctacgcttccccttcgagttgaagaagcagatctcgtgctccatgcagctgtcgaatcacaccgacgactacatcgcccttcaggtgaaaactacaagtccaaagaagtattcggtgcgacccaacactggggttgtcttgccacggtctacctgtgatnngtgttgtacgatgcaagcaacagcggaagcccccgctgacatgcagtgcaaggaaagtttctagtccaaagcgtcgttgcccctgctggaaaactgtggaggatgtccctgggaattgtttacaaaggagctgggttaaaaaggaaaaagtaaattgggagggccctggttgcccctccaagcccccctcccatttcaaaaaaaacgaaaaaagtttccccccaagggttttcgaaaaaaaaaacggaggggccctttgggggattccccaaaacctaaaagggggtttggcccctaaaaaattacaaggggggggtttttttgtccagtgggaagaaaaaaaaatcccgcttctccaaatttttttttttggggggtgt

SEQ ID NO: 50227 - protein, 93 aa, Zea mays
  misc_feature: Ceres CLONE 1462526-F
  misc_feature (12)..(94): Pfam Name: Motile_Sperm Pfam Description: MSP (Major sperm protein) domain
  misc_feature (73)..(73): Xaa is any aa, unknown, or other
MAAPAPATTGDLLRVDPLELRFPFELKKQISCSMQLSNHTDDYIALQVKTTSPKKYSVRPNTGVVLPRSTCDXCCTMQATAEAPADMQCKESF

SEQ ID NO: 50228 - DNA, 728 bp, Zea mays
  misc_feature: Ceres CLONE 1462533-F
  misc_feature: Encodes the peptide sequence at SEQ ID NO. 50229
ctggagctccccgcggtggcggccgctctagaactagtggatcccccgggctgcaggaattcgtctcacccctaatcgaaaaaacttcacagaccagtgagtgacacacacccatgccgccgccgccgccgctcgcgcgccgcctactcctccagccgctaccgagcggcgcgcgcgccctccacacgaccccgggggtgctggcctgccgcctggcgtcccgcgccgtggtccgcttcgcggggcccgaggcggcgcgcttcctccactcgctgctcaccaacgacctcctctccgccttctccgcggccggcgcgtcgtcgccgcagcggtacgcgcccacgccgaacgcgcccgcgcggggccccgcggcgcccgcctacgccgagctgctcacgccgcagggcaggttcctctacgacctcttcatctaccggcccccgccgcggtcccagatgctcgaccgcacaggatccgcgcgcggagaccggtgaggcccccgaggggcacccgcacctgcaggaggtgctcgcagatgttgacgcccccgaggtggacgacctcgtcgcctgcttcatagatagcgcttgagatcgagcgttgatatagacaatgtaaggaagcaatttgcatgtcggacaagatttggacttgatgtattgcagactgaaccttctactcaggagcttgatgctcattccattgagtggggacgagtgctgaccggc

SEQ ID NO: 50229 - protein, 126 aa, Zea mays
  misc_feature: Ceres CLONE 1462533-F
MPPPPPLARRLLLQPLPSGARALHTTPGVLACRLASRAVVRFAGPEAARFLHSLLTNDLLSAFSAAGASSPQRYAPTPNAPARGPAAPAYAELLTPQGRFLYDLFIYRPPPRSQMLDRTGSARGDR

SEQ ID NO: 50230 - DNA, 779 bp, Zea mays
  misc_feature: Ceres CLONE 1462535-F
  misc_feature: Encodes the peptide sequence at SEQ ID NO. 50231
tggagctccccgcggtggcggccgctctagaactagtggatcccccgggctgcaggaattcgtctcacccctaatcgaaaaaattttctcctcggggactcctctcggttgccggccatggcggacaatttggcccccgagaagcgccacaccttcttgcacaacgggcagaaggtgttcgagtgggaccagacgctacaggaggtgaacatgtacatcgagctccctacgtgcgtgcccaccaagctcttccgctgatccatccaggccagcctcgtagaggtcgtgatcagcggtcaaccgccatatctcatgcatgtactgatgcaccaccgtgagacccactcgtcgttctggacactcaggatgctgaaatgcatatacactgcggacgggaagaaggggcaaccctgtccatccccatacaagggccaagggattgtcgatccctatgctgccaatccaaaccaaagccggcttatgctccaaggggtcagggaaaaaaccccggggtccaaattttcccagggtcaattcaaggggacctggcccccgacccaagaaccttagaggggggaaaacccctttgggggacccccccccccggcccctgttgggggggattttcccgggggggggctcaaagggaaaaaacccgggggtgtttcccttttggggggccacccaataagggggggggcccccttggggggcccctcgcccccaaaataccacaaaagagggggtgcccccctttttgtgttttttaaaggaaaaaa

SEQ ID NO: 50231 - protein, 46 aa, Zea mays
  misc_feature: Ceres CLONE 1462535-F
MADNLAPEKRHTFLHNGQKVFEWDQTLQEVNMYIELPTCVPTKLFR

SEQ ID NO: 50232 - DNA, 765 bp, Zea mays
  misc_feature: Ceres CLONE 1462537-F
  misc_feature: Encodes the peptide sequence at SEQ ID NO. 50233
aagctggagctccccgcggtggcggccgctctagaactagtggatcccccgggctgcaggaattcgtctcacccctaatcgaaaaactatcctaccaggcaccactcgcatcgtgtgctcagtcagatccccgtcccgcatttcctaaggccagttggcattgaagacgatgactgcttctgcagctgctggtgtgcagatggtggctgcacgcccttgcatttcggcctcgccaggaattcttaccgcacgggtagcagtttctaggactgattgcatgctcagtaccactgctacattccccaaaatcacctgctcctggcctctaaggtttaagcgcaatgatgttgttgtaagagcaatatcggaagagtgtggcccgcaggggcttcccattgatctcagaggtaaaagggcattcattgctggagttgctgatgataatggctatggatgggcaattgcgaaggcacttgctgcggctggtgctgaaattcttgtgggtacatgggtgccggcacttaacatatttgagacaagtctgaggcgtggaaagtttgatgaatcacggaagctgccagatggatctcttatggatattgttagagtctatccacttgatgctgtctacgattcccctgatgatgttcctgaagatgtcatatcgaacaagagatatgcatgggcatcacactggacagtaaaggatgttgttgaatcagcgaggaatgatttttgcagcattgacatactagtgcattctct

SEQ ID NO: 50233 - protein, 198 aa, Zea mays
  misc_feature: Ceres CLONE 1462537-F
  misc_feature: SWISSPROT Homolog: EC 1.3.1.9 Enoyl-[acyl-carrier-protein] reductase (NADH)
MTASAAAGVQMVAARPCISASPGILTARVAVSRTDCMLSTTATFPKITCSWPLRFKRNDVVVRAISEECGPQGLPIDLRGKRAFIAGVADDNGYGWAIAKALAAAGAEILVGTWVPALNIFETSLRRGKFDESRKLPDGSLMDIVRVYPLDAVYDSPDDVPEDVISNKRYAWASHWTVKDVVESARNDFCSIDILVHS

SEQ ID NO: 50234 - DNA, 723 bp, Zea mays
  misc_feature: Ceres CLONE 1462538-F
  misc_feature (391)..(391): n is a, c, t, g, unknown, or other
  misc_feature (702)..(702): n is a, c, t, g, unknown, or other
  misc_feature (722)..(722): n is a, c, t, g, unknown, or other
  misc_feature (723)..(723): n is a, c, t, g, unknown, or other
atagctggagctccccgcggtggcggccgctctagaactagtggatcccccgggctgcaggaattcgtctcacccctaatcgaaaactctgatttttggcgagtcccaaatccctcgatactactggtaaaacacgactgcctgtccctatgagcctcatcacggaggccgagggatccatcacatatccctctcgtgctgttcgtaaaggaggaaggccgtacgaagatggagatcttctacaagaccctctccctcaacaacctacgggccctcgaggacaagatcgtccgcatgtgcctcgtccgcgctgacatacagtgttcgtatgggtacccccggatctacagggcttttttttgtttgaagctccctggaggggggcgaaggntacctaattatgagccccccaaagtgtactttcattttagatctacgggtggagctgcagatcccccccctcgaaaagcctacagctaaggaaatgggtcctcctgtagaaccgctgttctccttgtacaataggggaacccccccggattgtaggggcattcaaccggaacaccggggtctcttctgctgaggaaacctgtccccgagcaacctcccggatcgcccttttaagggcgttaatgatccacccgccggtgccccatcccgccaaattactctccccccgcaccccccaacacccccttcacnagccaccctccctccccccnn

SEQ ID NO: 50235 - DNA, 747 bp, Zea mays
  misc_feature: Ceres CLONE 1462540-F
  misc_feature: Encodes the peptide sequence at SEQ ID NO. 50236
  misc_feature (711)..(711): n is a, c, t, g, unknown, or other
  misc_feature (747)..(747): n is a, c, t, g, unknown, or other
ctccccgcggtggcggccgctctagaactagtggatcccccgggctgcaggaattcgtctcacccctaatcgaaaaccagccacgtcttcatcacacacggtcgcggcgcgaagcaatggcgaccacggcgccgctgctctcgccccagcgcgcttgccctacccatctccggcgccgcctctcgcccctacatctcgtattccccctcgacgcgtcagcgaggcggctgcaccttcgccgggcgccgccaccttgttcggccaagttcggcaagttcgacgcctccgacgccccggcggaggccgaggaggcggggggcgccacagatggtgggctggcgcatcccgtggaggaggacgacagttgcttgccatcggatttggagggcgcgattccgcactcagggaaggcgagcgcagatttcgtaaactccggaggcatgcgagctatctggtgtcaatattgcaggcagaactgctgatccctcagttggaattcctcaacgaggaaggagcacaggctgaactctgggcgttgtcaaagattttcctggacacacttgtacaagagacatgagagagagttactgccattttccctgacgctggagcagctgcccttctcagcatgcatgggaagatgcacaattcaagtgtgccagataaaccctcttgtcatgtggaaccacgggcttgtagtggagatgtggnagtacgctttaatgtacgcactctgcggagaaattn

SEQ ID NO: 50236 - protein, 121 aa, Zea mays
  misc_feature: Ceres CLONE 1462540-F
MATTAPLLSPQRACPTHLRRRLSPLHLVFPLDASARRLHLRRAPPPCSAKFGKFDASDAPAEAEEAGGATDGGLAHPVEEDDSCLPSDLEGAIPHSGKASADFVNSGGMRAIWCQYCRQNC

SEQ ID NO: 50237 - DNA, 746 bp, Zea mays
  misc_feature: Ceres CLONE 1462543-F
  misc_feature: Encodes the peptide sequence at SEQ ID NO. 50238
tggagctccccgcggtggcggccgctctagaactagtggatcccccgggctgcaggaattcgtctcacccctaatcgaaaagtttctaactccggtggctccaccactagcaacccgtgcagcgagcccaccccgaccactgccatgtcgaggcgcggcgactgggtctacaagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctgccctgccatggcacagctcctctccaataccctgtactacaagcgcttcttcccatattacgccttcaatgtgctcgggaaagggtgtgttttcacctatgatgcagtaggttcctatgagagaactggttatagtgctcagggaacgggatctactttgattatgccagtcctggacaatcaactaaaatcaccaagtcctcttattgctccctggcaagggatgctgtcccaccatttggcggagtcagaggccatcgatctaggtaaaggagtggtttgcatctgcaactggaaagaaacatctacactggagaacaagttcgaaactttgat

SEQ ID NO: 50238 - protein, 200 aa, Zea mays
  misc_feature: Ceres CLONE 1462543-F
  misc_feature (10)..(185): Pfam Name: Proteasome Pfam Description: Proteasome A-type and B-type
  misc_feature: SWISSPROT Homolog: EC 3.4.25.1 Proteasome endopeptidase complex
MSRRGDWVYKNNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGKGCVFTYDAVGSYERTGYSAQGTGSTLIMPVLDNQLKSPSPLIAPWQGMLSHHLAESEAIDLGKGVVCICNWKETSTLENKFETL

SEQ ID NO: 50239 - DNA, 734 bp, Zea mays
  misc_feature: Ceres CLONE 1462548-F
  misc_feature: Encodes the peptide sequence at SEQ ID NO. 50240
aagctggagctccccgcggtggcggccgctctagaactagtggatcccccgggctgcaggaattcgtctcacccctaatcgaaaaaagctcttgaaaactgctcgtcccctccacttcaaaatctactactcaaggatggaaagctgtcatctctgtacacaacccaaggtgtggcggttgctgagctacagttctgccatcctgaggtggtcccaacgtcaaagaacttctggaagccactatgtgcatctctgcagaatctgctgaggtgcagcgtcgacatccgaatcaacctatctcctatctccggcaacggggcgggatccaaggactcgtccgtcagccttgtcatggagtcaagagaagaagaccgcgaggcacaggacccagccacctcaaactgcagaaccgtggtgtcatccgggagagactgcccttccccacccttggggcaggccaaggagagatcgtcccacatcctggggtgcctccatggcggcgcgggtggcgacgccgtggacaccgagccgaggatcctgagctaccagaagatctccgttgtccctgcagcatccaccccaggaaacactcccctgaaagccgctgccgccgctgccggagacgagtcaaaggttgatgatggcggggttcgtcctggctgctgctcgcacattttaccctgtggtgcttgcgctccccgtcagaagccccggacgcgggagaaacgccgtgc

SEQ ID NO: 50240 - protein, 127 aa, Zea mays
  misc_feature: Ceres CLONE 1462548-F
MESREEDREAQDPATSNCRTVVSSGRDCPSPPLGQAKERSSHILGCLHGGAGGDAVDTEPRILSYQKISVVPAASTPGNTPLKAAAAAAGDESKVDDGGVRPGCCSHILPCGACAPRQKPRTREKRR

SEQ ID NO: 50241 - DNA, 749 bp, Zea mays
  misc_feature: Ceres CLONE 1462553-F
  misc_feature: Encodes the peptide sequence at SEQ ID NO. 50242
  misc_feature (620)..(620): n is a, c, t, g, unknown, or other
aaagctggagctccccgcggtggcggccgctctagaactagtggatcccccgggctgcaggaattcgtctcacccctaatcgaaaaaatctcaatcccacaccaccaccaccacctcctccggtccccaacccctgtcgcaccgcagccgccggccatggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcaggaggggcaacaacatccttgtgatgtgcgattgctacaccccagccggcgagccaatccccaccaacaagaggtacaacgccgccaagatcttcagcagccctgaggtcgccgccgaggagccgtggtatggtattgagcaggagtacaccctcctccagaaggacacaactggccccttgggtgggccttcggtgctttccccggcctcagggtncttaatactggggatccgcgccaaaaatcttccgccgcgacatcgtgaagcccactaaaaggctggtttgatgcgggcactcacctcgtggatccacgggaaggtgatgcagggcagggggagtcccat

SEQ ID NO: 50242 - protein, 173 aa, Zea mays
  misc_feature: Ceres CLONE 1462553-F
  misc_feature (17)..(97): Pfam Name: Gln-synt_N Pfam Description: Glutamine synthetase, beta-Grasp domain
  misc_feature: SWISSPROT Homolog: EC 6.3.1.2 Glutamate--ammonia ligase
  misc_feature (155)..(155): Xaa is any aa, unknown, or other
MACLTDLVNLNLSDNTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEYTLLQKDTTGPLGGPSVLSPASGXLILGIRAKNLPPRHREAH

SEQ ID NO: 50243 - DNA, 761 bp, Zea mays
  misc_feature: Ceres CLONE 1462554-F
  misc_feature: Encodes the peptide sequence at SEQ ID NO. 50244
tggagctccccgcggtggcggccgctctagaactagtggatcccccgggctgcaggaattcgtctcacccctaatcgaaaaatcggactcatctccttcgattcagcagaggacagcgctctgcctctccactacttgacagccacggatccttccatccctcgcctagcgaacagacctggctggccatcctcaacgcacccctcccattttccattcggatgtatgcgtgggtgaccagcacatcgaggagttccacaagcacacatgaggtatctgaaactgaatccaaagtacgaagtcagtaatgaggagtgtgtctctctcaggcttgaactgtcgcagagttcagtgaaactcgacactatctttgaggcatctttcaagttcatgatatatgatcagttaatcggaaagcacaaggtgcatctaggtaaccacagcttccagactgcaagtacgagctctgccatcgcattcatgttacctctgaaagcactcagacaatcctctagatttattgtcaataacagctgcgtatttggcattggcttcatcaaagttgccactatcaaagttaacacgacgctagaaacactgtttgtcaggaagatgaacatcttcaacgaggccaaagtttacacttggaaaatcgaggatttctctgctctgaagaacccgtcccactcaccggagtttgagatcgctggatacacatggattatctctttgaatcatcctacgatggtaacagcctgtcc

SEQ ID NO: 50244 - protein, 164 aa, Zea mays
  misc_feature: Ceres CLONE 1462554-F
MRYLKLNPKYEVSNEECVSLRLELSQSSVKLDTIFEASFKFMIYDQLIGKHKVHLGNHSFQTASTSSAIAFMLPLKALRQSSRFIVNNSCVFGIGFIKVATIKVNTTLETLFVRKMNIFNEAKVYTWKIEDFSALKNPSHSPEFEIAGYTWIISLNHPTMVTAC

SEQ ID NO: 50245 - DNA, 724 bp, Zea mays
  misc_feature: Ceres CLONE 1462558-F
  misc_feature: Encodes the peptide sequence at SEQ ID NO. 50246
  misc_feature (379)..(379): n is a, c, t, g, unknown, or other
ctccccgcggtggcggccgctctagaactagtggatcccccgggctgcaggaattcgtctcacccctaatcgaaaactacgtacacaggattggaagaactggaagagctgggaagagcggacttgccactgccttcttcaatgataataactcatcactggcaagatctcttgctgacctaatgcaagaatctaaccaagaggtacctgcatggctattgcgctatgcagctcgcccttcttatggtggtggtggtggtgggaggaaccggcgatcagggggagggagccgctttggtggccgtgacttccgcaatgattcttcgtcatttggcaaggggggatcccgtggtggtggtgactacgatggtggaagcancattggtggttatgccccccccctcctcatatggttggtggcggacacgggtggagctgggcgctccgagtgcctgggaattgatgttacagttgctcccaagtagagggggtctgccaagtttaggtcactttttactctagttccatttaggtatacattttttggaaggagctgttatacagcaaccagtaccaaggggaatgtggccatccccttccttcttcctgttgcaacgggctgcagtcctaaatctgcagaagtcattacgagaagggccttgaggacttccagcccaccaaatcctaattaggtggaaatccttggaaggggaaaccaaccagt

SEQ ID NO: 50246 - protein, 160 aa, Zea mays
  misc_feature: Ceres CLONE 1462558-F
  misc_feature (126)..(126): Xaa is any aa, unknown, or other
PRGGGRSRTSGSPGLQEFVSPLIENYVHRIGRTGRAGKSGLATAFFNDNNSSLARSLADLMQESNQEVPAWLLRYAARPSYGGGGGGRNRRSGGGSRFGGRDFRNDSSSFGKGGSRGGGDYDGGSXIGGYAPPLLIWLVADTGGAGRSECLGIDVTVAPK

SEQ ID NO: 50247 - DNA, 756 bp, Zea mays
  misc_feature: Ceres CLONE 1462561-F
  misc_feature: Encodes the peptide sequence at SEQ ID NO. 50248
ggagctccccgcggtggcggccgctctagaactagtggatcccccgggctgcaggaattcgtctcacccctaatcgaaaaaaaactaaaaataattcagcgacagatatcttcgactcctcgttcgtggttccccatcgtcatcgccatggatttctcttaggctcacccgtccgctcagctcgcttccttccccactctctctgatcccgtcgcacttccctcctcgctgcagcccctctattattgcgattaccgtttcctcactgccctttcctttttcggtcggcagcaatcaccggggcaagcgaaccctcgatttgcgtccccgctctctgctagcgcccctaaaagaggagcgaagcgatgtctatgccggagacgggtcaggccgcggagagggacgagcagcagcagtcccgagggatagcactgatgcaggccatctgcgccgtggtgtaccgcaaggccgataacacgccctgccccatcaagcagggtctctacttgggatctgttggagcagcattcaataaggacgctctcaagagcttgaacatcacccatatcttgatcgttgcaaagtcactggatcccgtattttcagctgaatttaattacaagaagatcgaagtacttgatatcccagacactgatctgttaaagcattcggatgaatgcttcggttcctaagagaagctataagctcgggaggcaatgtttggtccatttgctttgcagggcgggcaaagaatgt

SEQ ID NO: 50248 - protein, 108 aa, Zea mays
  misc_feature: Ceres CLONE 1462561-F
MSMPETGQAAERDEQQQSRGIALMQAICAVVYRKADNTPCPIKQGLYLGSVGAAFNKDALKSLNITHILIVAKSLDPVFSAEFNYKKIEVLDIPDTDLLKHSDECFGS

SEQ ID NO: 50249 - DNA, 748 bp, Zea mays
  misc_feature: Ceres CLONE 1462562-F
  misc_feature: Translation starting site: 149
  misc_feature (473)..(473): n is a, c, t, g, unknown, or other
  misc_feature (606)..(606): n is a, c, t, g, unknown, or other
  misc_feature (626)..(626): n is a, c, t, g, unknown, or other
tccccgcggtggcggccgctctagaactagtggatcccccgggctgcaggaattcgtctcacccctaatcgaaaagcttcgaagtgttcgtgcgaaggcgaccctccctccttcgctccttccgcgccgcctcccggccgtcgccgccatggtgaattactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctgcatttgctgaataatgctgacagtaacgctgatgtgaaaggcttgnatgtggaacacctctatgtttcacacatccaggttgaatcaagcccataagcagaggcgccgcacctaccgtgctcacgggcgcatcaatccctacatgtcctcaccttgccacattgagctgatcttgtcanaaaatgaagagcctgtaaanaaagagctgacaacattgtcccatcaggaaacagtgaagtatatcagcatgctgatcgaggccatttgtcaaagtatatagccctaactccttgatgtaccttttcagccagcctgcctccc

SEQ ID NO: 50250 - DNA, 748 bp, Zea mays
  misc_feature: Ceres CLONE 1462566-F
  misc_feature: Encodes the peptide sequence at SEQ ID NO. 50251
  misc_feature (262)..(262): n is a, c, t, g, unknown, or other
  misc_feature (276)..(276): n is a, c, t, g, unknown, or other
  misc_feature (278)..(278): n is a, c, t, g, unknown, or other
  misc_feature (730)..(730): n is a, c, t, g, unknown, or other
ctggagctccccgcggtggcggccgctctagaactagtggatcccccgggctgcaggaattcgtctcacccctaatcgaaaataagcatgttcttcactcgtcatcagcactgcacaaaaggatggccgactacctggacaagtttgagcagtcattttcaggtccatcacatggttgggaagcaggcatcagtctgcccaaggttctacgtgatgtggttgaatctatcgctggtgcaattacatcgacgccagcatgacnaaggggtcgtttgnanaaccatgaaaacgatactggaacctcctgtgacacccgaccccctttcaaattgacctgggaaaaactccaggaattctgtgaagcaaaggttaacctttggagaacccagaaaccctggaaaccgtgtttccctccggggtccacaaaattcggacccaaaggactcttttaaaggccccccgaaaggcgtttcttaaattttgcccccaaaattggcgcccccttcccccgccccccggatttaaagcgcgcgaaacaaaaagggttcccccgagcctttaacctcccaacccccgggggaaaaactttttgtaaaaaaactccaaaaaacaaaagggggggaggggcctttggccccctacccccatttttatagggcttccgggtcacgggcccaccttaaaggcggaactaccgcacaggttttggttttggccatgcccctcgaanagtgaaagtgtagccttt

SEQ ID NO: 50251 - protein, 85 aa, Zea mays
  misc_feature: Ceres CLONE 1462566-F
GAPRGGGRSRTSGSPGLQEFVSPLIENKHVLHSSSALHKRMADYLDKFEQSFSGPSHGWEAGISLPKVLRDVVESIAGAITSTPA

SEQ ID NO: 50252 - DNA, 759 bp, Zea mays
  misc_feature: Ceres CLONE 1462569-F
  misc_feature: Encodes the peptide sequence at SEQ ID NO. 50253
  misc_feature (189)..(189): n is a, c, t, g, unknown, or other
  misc_feature (191)..(191): n is a, c, t, g, unknown, or other
  misc_feature (192)..(192): n is a, c, t, g, unknown, or other
  misc_feature (212)..(212): n is a, c, t, g, unknown, or other
  misc_feature (298)..(298): n is a, c, t, g, unknown, or other
  misc_feature (309)..(309): n is a, c, t, g, unknown, or other
  misc_feature (692)..(692): n is a, c, t, g, unknown, or other
ctggagctccccgcggtggcggccgctctagaactagtggatcccccgggctgcaggaattcgtctcacccctaatcgaaaagttctgaattgtgatcgagacgagacccttccaccttcgcaacgcctccccactccccagcaaccactgctccgccgcctccggcgaccgccggagcccgtggtggngnnaaagggggaaaggggaccgntggagagggtagatctcgccagatccaaggaggtggggacgagatggtgagctcctcgtcgtcggtggttaacgtgtacccgctcngcaactacacngtcgggcaccagggagcccaagatggaggagggacacttcggtcgccgaccgcctggcccgaatgaaggtccactacttgaaagaaggaaggcctccaaggggtggaagcatccctatgggtggcagagacccaccccccttccaaacggggccccgcaaatggaaaaatctttcgggaaaattccggggggaaagggttaaaccccgaaaaaaaataatacccaaggttttaaaaaaaaaatttggggcaaaaatttggggggaacccccctcccctccccaccaaaggggggggggaggaaaaaggtgttttttttggggggagaaacccaatttttggaagggggggggtttttttttggcgcccccccttttacccccncgcgggggggggggaaaaatttttttctcccccccacccaaaaaaaaaagagtttgtgggggcggga

SEQ ID NO: 50253 - protein, 39 aa, Zea mays
  misc_feature: Ceres CLONE 1462569-F
  misc_feature (15)..(15): Xaa is any aa, unknown, or other
MVSSSSSVVNVYPLXNYTVGHQGAQDGGGTLRSPTAWPE

SEQ ID NO: 50254 - DNA, 774 bp, Zea mays
  misc_feature: Ceres CLONE 1462570-F
  misc_feature (751)..(751): n is a, c, t, g, unknown, or other
ctggagctccccgcggtggcggccgctctagaactagtggatcccccgggctgcaggaattcgtctcacccctaatcgaaaacttggccgccgccccccctgcccatctcctcctctctccattgttgcagccaccaaaaccctagcccccccccaatcccctcctcctaaggtgctactccgtgccgctcggatcatcgtctcttggtgcgaatctccaatcgttttggtggagggaagaagggaggaaggaaagggggagaacccaaggtggtggacttccggatcgttcttagggattttgcccgaacttcggtgaaggcatctaatttctgctttggggaatagagggatgtagcagcacggccactacacctttaataaaggaaccaccatttattaatgttgttaatcagagttggacaagtctagtgaattgctttattcttggttgagcggttattttggggtggactgagttcttatcccatttgttttacttcagttgggtcataattacgttttaccactcttgcattacagtttctactatgtgaattatatgtctttatatcttggatgtgcgtcatgttttcccctccttgttatgctagttttcaaaggaggtgctgccggaatttttcttgctttatgttctttcttcaaaaaaaaaaaaaacgagacgctcgaggtacccaatttcgccctatagtgagtcgtattacgcgcgctcactggccgtcgttttacnacgtcgtgactgggaaaaccctg

SEQ ID NO: 50255 - DNA, 771 bp, Zea mays
  misc_feature: Ceres CLONE 1462571-F
ggagctccccgcggtggcggccgctctagaactagtggatcccccgggctgcaggaattcgtctcacccctaatcgaaaaaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaagctaaactgtttgagtactatgctaagctgaggagctgcattcacatcatgtggtgaagcgcgagggaggctttcttatcggacagcctcacttgtcaccgacgcaatcaggcaccccccccaggccgtgactacgctggggttggcctttggcatgaaaacgaccgctgggtttgtcataaatcaaatcgtaccaagagaaacaagtactttttatcccaatggatccccctccaacaaactttggaaggccccttgtacaaagccggaaaaaagccttttaaaaaaaaaaaaaaaaaaaaaacccccagggaacccatttccccaaaaaggggcccataacccccgccccccgggcccc

SEQ ID NO: 50256 - DNA, 763 bp, Zea mays
  misc_feature: Ceres CLONE 1462576-F
  misc_feature: Encodes the peptide sequence at SEQ ID NO. 50257
  misc_feature (95)..(95): n is a, c, t, g, unknown, or other
ctggagctccccgcggtggcggccgctctagaactagtggatcccccgggctgcaggaattcgtctcacccctaatcgaaaagaaaaaaaaaacntctgcggagattgaccgaccaccaccacctgcctgcgttcccgcgccgccaccgccatggctgccgctgccccccatgcatactcctccctcgtgcctgtttcggctgcgcggcctctctccggaagcacagtttctttcggtgcttcgtgccacaagtggaggaaggttccggcatggcgactccactgtgttgctgaagacgaagcagaggaagtcaaagattttggagtcaatatggcactatccatgctaaaattttacaaacgagaaatatcacctttactaccttcaagctgccgatatgtaccaacttgcagtgagtactctatgcaggcgtacaaacgatatggtgttgtaaagggttccatcttgactgcttggcgcctttgccgttgtaatcctcttggtggatatgggtatgatcctccaaaatggtttggcgaggaagatgtacctctgcaatagtaatgcctagtaattgaaagtacaggcattgtaattcttcagatccagacttgcagcagtttttatgttctggtcactgtcagaacaatgcacaactgtatgtggtagtttcaagggaaagcctccccatcgactatactgccaaggaaactgattggatttctgagatttctatgctgaagtacataaatggcaggggga

SEQ ID NO: 50257 - protein, 136 aa, Zea mays
  misc_feature: Ceres CLONE 1462576-F
  misc_feature (58)..(125): Pfam Name: DUF37 Pfam Description: Domain of unknown function DUF37
MAAAAPHAYSSLVPVSAARPLSGSTVSFGASCHKWRKVPAWRLHCVAEDEAEEVKDFGVNMALSMLKFYKREISPLLPSSCRYVPTCSEYSMQAYKRYGVVKGSILTAWRLCRCNPLGGYGYDPPKWFGEEDVPLQ

SEQ ID NO: 50258 - DNA, 764 bp, Zea mays
  misc_feature: Ceres CLONE 1462581-F
  misc_feature: Encodes the peptide sequence at SEQ ID NO. 50259
ctccccgcggtggcggccgctctagaactagtggatcccccgggctgcaggaattcgtctcacccctaatcgaaaatgtattagaaaaagatttgaacatgagtgagcatcatcattttgcatttgtgcacggtgcagggcatggacgatggtgttggtacaagctcgccaattcactgatagagaatggacataaggccacctgcatcgacctcaagggcgctgggatcaacctaactgatccaaacactgtctcctctcttgatgactacaaccagcctctctatgacttcctctcccaacttcccctcgaccaaaaggtcattctggtgacccacaccgttggaggagggagcatgacagctgccatgtgccactatccttccaaagtctccatggctgtttacgtcacagcacccatggtcaaacctggtaccataattcccccaattctcaaggaagtactaaagatatgttcagggatgatagacacggaagctgagaagatatgggacttcacttttggaaatggacccgagaatctccccacacgtatgatgatgaaacctgagtatgtccgggacaagtattacaacgagagccccatggacgattacacactggctaccacacttctgcgtccagcccctgtcatggcattagcacgcatagtggatatccctgcagcaccagaggctgacaaaatctcaacggtctacattaagacaggcaacgacaatatgatccagtcaagtcgtcaagac

SEQ ID NO: 50259 - protein, 222 aa, Zea mays
  misc_feature: Ceres CLONE 1462581-F
  misc_feature: SWISSPROT Homolog: EC 3.1.1.78 Polyneuridine-aldehyde esterase
MSEHHHFAFVHGAGHGRWCWYKLANSLIENGHKATCIDLKGAGINLTDPNTVSSLDDYNQPLYDFLSQLPLDQKVILVTHTVGGGSMTAAMCHYPSKVSMAVYVTAPMVKPGTIIPPILKEVLKICSGMIDTEAEKIWDFTFGNGPENLPTRMMMKPEYVRDKYYNESPMDDYTLATTLLRPAPVMALARIVDIPAAPEADKISTVYIKTGNDNMIQSSRQD

SEQ ID NO: 50260 - DNA, 679 bp, Zea mays
  misc_feature: Ceres CLONE 1462584-F
  misc_feature: Encodes the peptide sequence at SEQ ID NO. 50261
aaagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaagctaaactgttttgagactatgctagctgaggagctgcatcacatcatgtggtgagcgcgagggaggcttcttatcggacagctcactgtcaccgacgcatcaggcaccccccagccctggactacgctgggttggcctttgcataagacgacggctgtggttgtcaatagtcatacctaactagagaaaacaggtagcttttttatcccccaattggatccccccttcctaccgaaactttgggatgcgctcttgaaccta

SEQ ID NO: 50261 - protein, 73 aa, Zea mays; identical to SEQ ID NO: 46214
  misc_feature: Ceres CLONE 1462584-F

SEQ ID NO: 50262 - DNA, 787 bp, Zea mays
  misc_feature: Ceres CLONE 1462586-F
  misc_feature: Encodes the peptide sequence at SEQ ID NO. 50263
  misc_feature (420)..(420): n is a, c, t, g, unknown, or other
ggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaagaacgtacattgtcatttttggaagcttctgaaagcatggcgtgcgcgtgaactatgaatgtatgagtcactccgaagcttaactgnttgaatactatgctaagctgaagacctggcttcccatcatgtggggaacccccagggagccttctttatggaaagccttacttttcccgaagcaaatagggaccccccaaaacgggaaaaacccggggtttgggtttggaagaaaaaacccccctggtttttcaaacccattacccaacagagaaaaaagtgtttttatacccagggggcccccccccccaaaaatttgggggcgccttttgaaaagccgggaaaaaacccttccaaaaaaaaaaaaaaaaaaaaagccggggggaccccctcccccaaaagagggaaatacccccccccccggcgccctttttttacccccggggggaaaaaaacc

SEQ ID NO: 50263 - protein, 71 aa, Zea mays; identical to SEQ ID NO: 46198
  misc_feature: Ceres CLONE 1462586-F

SEQ ID NO: 50264 - DNA, 769 bp, Zea mays
  misc_feature: Ceres CLONE 1462587-F
  misc_feature: Encodes the peptide sequence at SEQ ID NO. 50265
  misc_feature (741)..(741): n is a, c, t, g, unknown, or other
  misc_feature (742)..(742): n is a, c, t, g, unknown, or other
caaagctggagctccccgcggtggcggccgctctagaactagtggatcccccgggctgcaggaattcgtctcacccctaatcgaaaagatttagggtttccttaccttacaagctttttcttccgccgccgcctcagccctcgccccgcgctgctgtactctctcacctccttcgccgttgtctaccagatcatcccatggcgtcggagaagaagcagtcgaacccgatgcgggagatgaaggtccagaagctcgtgctcaacatctccgtcggcgagagcggtgatcgcctcacccgcgccgccaaggtactggagcagctgagtggtcagtcaccggtattctccaaggcaaggtacactgtgaggtcgtttgggatccggcgcaatgagaagatcgcatgctatgtgacggtgcggggtgagaaggcaatgcagctgctggagagtggcttgaaggtgaaggagtacgagctgctgaggaggaacttcagtgacactggctgctttggatttggcatccaagagcacattgatcttggcatcaagtaagatgatctcatgtcttattgtaaataatttgaatgtggcctgtttgtttctgtgaacggatgttttatgatgggcactgttgcttgcctgtaagcaggggaaaagatatgtaactttgtattcatgtagcctgtacccactatgggtcactacgtactgggatagcttaaaggctagtgctttacacagnntttggaattgagactgctgattggctg

SEQ ID NO: 50265 - protein, 117 aa, Zea mays
  misc_feature: Ceres CLONE 1462587-F
  misc_feature (9)..(62): Pfam Name: Ribosomal_L5 Pfam Description: Ribosomal protein L5
  misc_feature (66)..(118): Pfam Name: Ribosomal_L5_C Pfam Description: ribosomal L5P family C-terminus
MASEKKQSNPMREMKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIK

SEQ ID NO: 50266 - DNA, 711 bp, Zea mays
  misc_feature: Ceres CLONE 1462590-F
  misc_feature: Encodes the peptide sequence at SEQ ID NO. 50267
  misc_feature (672)..(672): n is a, c, t, g, unknown, or other
ggagctccccgcggtggcggccgctctagaactagtggatcccccgggctgcaggaattcgtctcacccctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccacatcatcaagcataccctggagatcattcacctgctcaccgatgccaaccccatccaggtcgtcgtcgacgcgatcatcaacagtggaccccgtgaggatgccaccccgtatggtcccgctgggtgtgtgaggaggcaggccgtggatatctcacccctgaggagggtgaaacaggcatctacctcctcacactggtgccaaggagagtgctttccggaactcaaaccatttgcaagtggccntgcaagtgactgatccacgctgcaagggctcctccaagg

SEQ ID NO: 50267 - protein, 170 aa, Zea mays
  misc_feature: Ceres CLONE 1462590-F
  misc_feature (44)..(168): Pfam Name: Ribosomal_S7 Pfam Description: Ribosomal protein S7p/S5e
  misc_feature (167)..(167): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVHIIKHTLEIIHLLTDANPIQVVVDAIINSGPREDATPYGPAGCVRRQAVDISPLRRVKQASTSSHWCQGECFPELKPFASGXASD

SEQ ID NO: 50268 - DNA, 750 bp, Zea mays
  misc_feature: Ceres CLONE 1462593-F
  misc_feature: Encodes the peptide sequence at SEQ ID NO. 50269
tgtggcggccgttctagattcagtggatgccccgggctgcaggaattctcctcacccctaatcgaaaaagcctttttgttctccccgcgagcgctctctttctctatcgactggcgacgactccgccaccgccgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccagggccacaacctcatcctcaaggttgttgactccaagatggtcgtccagagaggccgcgagggagggcccctgggaagacagatgacgattgcggagtgcttggttggtgatgaaaccggcatcattgtcttcactgcaagaaacgatcaagtggatgtaattaggcctggaacaactgttgaactgaggaacgcaaagatccacatgttcaagggttcgatgcggcttgcagtggacaagtggggaattgtgaaagctgctgagagctcagctgagtggacagtcgaggaggacaacaacctgtccttaattgagtttgagctggtgaccgtgacggagtgaaaaccgccattgcttacgagtattgttggaatgctgtggagttgaacctaatcatcatcgccaatcaataaagactcgcggttgatgatctcggcatcagagttgcgtattgctgtaccgttgct

SEQ ID NO: 50269 - protein, 137 aa, Zea mays
  misc_feature: Ceres CLONE 1462593-F
MAADSGARRQPSFTKVDQLRPGTQGHNLILKVVDSKMVVQRGREGGPLGRQMTIAECLVGDETGIIVFTARNDQVDVIRPGTTVELRNAKIHMFKGSMRLAVDKWGIVKAAESSAEWTVEEDNNLSLIEFELVTVTE

SEQ ID NO: 50270 - DNA, 714 bp, Zea mays
  misc_feature: Ceres CLONE 1462600-F
  misc_feature (527)..(527): n is a, c, t, g, unknown, or other
ggagctccccgcggtggcggccgctctagaactagtggatcccccgggctgcaggaattcgtctcacccctaatcgaaaacaagagctatacgcctacgttcgggcttcagggtgggtttgtcacacacccattagcttagcctaacattacgtctagggggaaagacaatggttactcatgataagtggaagagacgattatattttacaaaactgatgggcgggttaagtatgatgaacacattctgttccaagcacgaactgctctattttgcttattatcatggaggcggctgtacctctcttatcaccgagacatcatttttgtcctacgtacgaaattgtcatctatggaacatctgaagcatgcttcgcgctgtactatggattacgactcactccaaactgacttgtttgagactttcctagctgaagatctcatttccctcatgtggcgagccggagcatgctctttacaggaaccctcaatgtccccaagcaaaaggggaccccccaagcgagaatnagcttggattgggttccctaaataaccaccccggttattcccacccaaattgcacccggaaaagaaagccctttaaaaacccggggccccccccccaccaaaaaattggagggcctttggcctgggccctgaaaaaagctcttctaaaaaaaaaaaaaaaaaacttccccccccgggtcccaatttt

SEQ ID NO: 50271 - DNA, 751 bp, Zea mays
  misc_feature: Ceres CLONE 1462601-F
  misc_feature: Translation starting site: 206
  misc_feature (618)..(618): n is a, c, t, g, unknown, or other
  misc_feature (634)..(634): n is a, c, t, g, unknown, or other
  misc_feature (671)..(671): n is a, c, t, g, unknown, or other
ggagctccccgcggtggcggccgctctagaactagtggatcccccgggctgcaggaattcgtctcacccctaatcgaaaactggctctccgtccgtttactcacacggtcacaccgcctcaactcgcgctgcccgtcgcccctcggttccgccggcgcgcgaggggattcgagctgggtcttgggtagcctctcaccgtctcacgatgccgccagcacccaagtccggcgacgccctcttcgccagcgtggatcgcgtcaatgcggagctgttcacgctcacgtacggcgccatcgtgcggcagttgctcacggatctggaggaggtcgaggaggtcaacaagcagctcgatcagatgggttacaacattggaacacgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgagggtacaagttgcagccttgtcctggaagacaccctcttgttgatttcgtcgagctccctgacacttgccaaggccttcagtattgcaatttgttaagtggagtnattaggggggcattgnaaatggtgtctatgaaggcggaggtgacatgggtgcncaaattgcttcgcggggacatgccttgaagaggggggtgagcttatccagcaggggccggaagaaataccctacaagata

SEQ ID NO: 50272 - DNA, 762 bp, Zea mays
  misc_feature: Ceres CLONE 1462603-F
  misc_feature: Encodes the peptide sequence at SEQ ID NO. 50273
  misc_feature (662)..(662): n is a, c, t, g, unknown, or other
  misc_feature (694)..(694): n is a, c, t, g, unknown, or other
  misc_feature (720)..(720): n is a, c, t, g, unknown, or other
aagctggagctccccgcggtggcggccgctctagaactagtggatcccccgggctgcaggaattcgtctcacccctaatcgaaaaactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggccgcactccccgccgacgccttcgccaccgcgctggtcatcttcctcggcgactacaacgaccgcggcccgcacacccgcagggtcctcgacttcctcctcgcgctcccgacgcgctaccccgcgcagcgccacgtcttcctctgcggcaaccacgacctcgccttcgcggcgttcgtcggggcgctgccgccgccgcccgacggctccccgttctcggccacctgggacgagtacatccacaacgaggagcacgaggggtggttccgcgggccgggattcgagggcatgcacgtgcaggggaggcggtggggcggggtcatcaaggagaggtggaaccccaagaagggcctcccgtacaggggctccatctacgacgcgcagcccaccttcgnaatctatggcgtcgcccatggttcctctgatnctgcaaaggctgtgccagaagagcancagaagtttctgcatgattgggtttggaacatgaagaggaaa

SEQ ID NO: 50273 - protein, 197 aa, Zea mays
  misc_feature: Ceres CLONE 1462603-F
  misc_feature: SWISSPROT Homolog: EC 3.1.3.16 Phosphoprotein phosphatase
  misc_feature (164)..(164): Xaa is any aa, unknown, or other
  misc_feature (175)..(175): Xaa is any aa, unknown, or other
  misc_feature (183)..(183): Xaa is any aa, unknown, or other
MSAPSAPPRTVICVGDVHGYITKLESLWSNLQAALPADAFATALVIFLGDYNDRGPHTRRVLDFLLALPTRYPAQRHVFLCGNHDLAFAAFVGALPPPPDGSPFSATWDEYIHNEEHEGWFRGPGFEGMHVQGRRWGGVIKERWNPKKGLPYRGSIYDAQPTFXIYGVAHGSSDXAKAVPEEXQKFLHDWVWNMKRK

SEQ ID NO: 50274 - DNA, 707 bp, Zea mays
  misc_feature: Ceres CLONE 1462606-F
  misc_feature (405)..(405): n is a, c, t, g, unknown, or other
  misc_feature (430)..(430): n is a, c, t, g, unknown, or other
  misc_feature (593)..(593): n is a, c, t, g, unknown, or other
caattgggtaccgggccccccctcgagccctgcagtggtaaagggtggcccagctgctgggcgcgtccgtggcgtgcctgctcctcaggttcgtgacccacggcaaggccatcccgacccacggcgtctccggcggcaccaccgagctggagggcgtcgtgttcgagatcgtcatcaccttcgcgctcgtctacaccgtgtacgccaccgccgccgaccccaagaagggctccctcggcaccatcgcgcccatcgccatcggcttcatcgtcggcgccaacatcctcgccgcggggcccttcagcggcggctccatgaaccccgcccgctccttcggccccgccgtcgccgcggccgacttcgccggcaactgggtctagtgggtcgggtcggttcatcgggggnggactattttggcttcgttaacggnaagctcttcatgggggggttctaacagcaggggcggcgagcgagggtaggcgggagagcggggggaggggggggggggggggagcgggggtgggggaggggggggtggggaggaggggaggggtaggggcccggcggcggggggccggggggtggttcggctngccgcgctatcctggcgagagcccaggagagttggcccccgccacttagttaaaacgctcctttcttgggacgttccatcacccccccgcctaccgtgcttcgcgcccccacca

SEQ ID NO: 50275 - DNA, 605 bp, Zea mays
  misc_feature: Ceres CLONE 1462609-F
  misc_feature: Encodes the peptide sequence at SEQ ID NO. 50276
cgattgggtccgggccccccctcgagccctgcagtggtaaaggatggctgcagcggcggcgtggaccggcgccgcatcccccaactcgctgctgctctcgcgctcgcctccccacgccgccgtgctcgcgccttcgtcggggagctccatgcggaggcggctcctgctcggcgtcggcaccccggccgtggcggcgctggcggccgcggcgccgccagcggtgctgcaggacggggcagtcactgtgctcatcaccgccggcgcctactctcttgtgcgcgtcttcgacgagctcaccgagcggcggctcatcgaaaagagcttgagcaggaaggttgtgcacgtgctgtccggcgtcctgttcatgtcatcttggcccctgttcagcaattccacagaagcacggtatttcgccgcggttgtcccgttcctgaactccatgaggcttctgatatatggactccgtctctacactgatgaagctctgggtaaatcagtgacacgtggaggaaaaccagaggaattgctgagaggtccactctattatggcctggtgctgctgttcagcgttttaccttctggcgtgagtcccccatcgggatcgg

SEQ ID NO: 50276 - protein, 187 aa, Zea mays
  misc_feature: Ceres CLONE 1462609-F
MAAAAAWTGAASPNSLLLSRSPPHAAVLAPSSGSSMRRRLLLGVGTPAVAALAAAAPPAVLQDGAVTVLITAGAYSLVRVFDELTERRLIEKSLSRKVVHVLSGVLFMSSWPLFSNSTEARYFAAVVPFLNSMRLLIYGLRLYTDEALGKSVTRGGKPEELLRGPLYYGLVLLFSVLPSGVSPPSGS

SEQ ID NO: 50277 - DNA, 649 bp, Zea mays
  misc_feature: Ceres CLONE 1462618-F
  misc_feature: SWISSPROT Homolog: EC 4.1.1.19 Arginine decarboxylase
  misc_feature (1)..(1): n is a, c, t, g, unknown, or other
  misc_feature (597)..(597): n is a, c, t, g, unknown, or other
ncgattgggtaccgggccccccctcgagccactgcagtggtaaaggcgagggggtgcagcaccccatcatctgggaggggagcttccacgtgctggtgtcccacctctcggtcctggagttcgaggccttctcggctaacgcgcccgtacgcttgtacgcggtcggggtctacctcttcgacgagctcacggacgactgcaccgccgactaccacatcgtcgtggccgctgccgtgcgcagcgacaagcaactgggcgccctgtacgccgaccaccagacgaggacctgctcggagctgttcgacggagagtgtccttggcctgtagcacgtcgccgcgatggacgccttctgcgagctctgtcggcgcttcatgggcgcgcccgagtgggcgcgcacctacaacatgaacctggccgtgtgcacctccctgccggacatgagcttgatcggtgagacactccgcatcatctcgatcgaacggctgcaggactggaccgtcgtctatggtttgttctcggcactgacctactccaccccgaggaagatgagccttatcatcggcgggaggacgatctgtcgctacacgagctgcgcnccagctgaccctggtgctactatctggtatgttcatcggaggaggctaacag

SEQ ID NO: 50278 - DNA, 649 bp, Zea mays
  misc_feature: Ceres CLONE 1462623-F
cgattgggtacgggcccccctcgagccactgcagtggtaaaggaaaggcgatcttgatccgttcctcttcctgttcctgctgctagctgttggctgctgggtccgtgtactgtacgcgttgatgaacgtgaccgtagaagggagcggctccgttccggtcgcggtcaacaggattcggagatgtccggactgacaagcaccacagcgcctacctgagcgtacagcaccgcgtgcaggaggaagaggaaactgggccacaggtggcgccggcgccactacaacgactgcttgcagtgtgtcgactggagttccgaggccgcgggaccgtgacgtcacgacacgacgtcgtcctcataacagacgtcctctctcagatgtgaccggaggatgtgcacctgacagattgatccaggccacttgctgcttcttgcgtgcctcgagcgtcgcctgtgcgtatcttcacacgatcacgatttataagtagcagagcttcacgatcgtggtgattctgctgtcccaatgcgcgacttcactctgcacagctaccggtgatgacggtgtgaaggaagatctgctcggttcgatcagcgtcaagtgctacactgttgccagtccgaccatgtccctcgacgatgagagcatctgccaa

SEQ ID NO: 50279 - DNA, 638 bp, Zea mays
  misc_feature: Ceres CLONE 1462628-F
  misc_feature: Encodes the peptide sequence at SEQ ID NO. 50280
  misc_feature (25)..(25): n is a, c, t, g, unknown, or other
  misc_feature (31)..(31): n is a, c, t, g, unknown, or other
  misc_feature (32)..(32): n is a, c, t, g, unknown, or other
cgattgggtaccgggctgcccctcnattcanntgcttccataaaggagagaagaatcgaaacggtccccactcagcatatatcctctgcgcgtgtatctcgtcgaacagagccgaaagctggagcttccaatggcgggaggcaacgacctgaaggtgctcggcgtgtggacgagcccgttcgtgatccgggtccgcatcgtgctcaacctgaagggcctggcgtacgagtacgtggaggaggacctcggcaacaagagcgcgctcctcctgggatccaacccggtgcacaagagcgtgccggtgctcctccacgccggccgcgccataaacgagtcccaggtcatcctgcagtacatcgacgaggtgtgggcggggacggggccggccgtgcttccggacgacccctacaagagcgcggtggcgcggttctggggcgcgtacatcgacgacaaggtggagtcggcgtggctggggatgctgttcaggtgcgcgaacaaggaggatagggcggcggcggtggtgcgcgcccgcgaggcgctcgacgcgctggagggcgcgttccgggactgctccagggggaggccgttcttcggcggggacaacttcgggttcgtggacgccgttctcggcgggaact

SEQ ID NO: 50280 - protein, 169 aa, Zea mays
  misc_feature: Ceres CLONE 1462628-F
  misc_feature (5)..(78): Pfam Name: GST_N Pfam Description: Glutathione S-transferase, N-terminal domain
  misc_feature: SWISSPROT Homolog: EC 4.4.1.5 Lactoylglutathione lyase
MAGGNDLKVLGVWTSPFVIRVRIVLNLKGLAYEYVEEDLGNKSALLLGSNPVHKSVPVLLHAGRAINESQVILQYIDEVWAGTGPAVLPDDPYKSAVARFWGAYIDDKVESAWLGMLFRCANKEDRAAAVVRAREALDALEGAFRDCSRGRPFFGGDNFGFVDAVLGGN

SEQ ID NO: 50281 - DNA, 667 bp, Zea mays
  misc_feature: Ceres CLONE 1462634-F
  misc_feature: SWISSPROT Homolog: EC 1.11.1.7 Peroxidase
  misc_feature (417)..(417): n is a, c, t, g, unknown, or other
  misc_feature (652)..(652): n is a, c, t, g, unknown, or other
caattgggtaccgggccccccctcgagccctgcattgctaaaagatacgcctctcttgctcgccattctcttctaaccatccaatccaaagcgcatctagcgagctgagaactcctggttgctgctacttcttctaggcgccctgcaactgctctgctggccctggcatcacccgtcctggccctggagtcctatgggctcaggtacccgccgctggagccggccctgtcattcaacttctacactaagagctgcccctgagcgaactccatcatgtcagtagttcctggcgtcagtggcccgttacaacgtgggactcgccgcgtggctgatccggctccgcttccacgactgcttcgtgagaggctgctacccctccgtcctgctggacgcttcctcactcagtcaatcgagcancactcgccgtccaatctcacgatccgccccacctcgttcaaaggcgtcaacaacatccgcgcccgcctcgaccaatactgcagccgcgacatctgctgcaccgacatcgtcacgctcgcgacacgtgaatccgtcgccctgctgggctgtccccatatacatcttcccacttgacaagcatcgaaaggctcgcgcctgaattcaaagcctgccgatcctagagcgctctcaccgnatgacatgcagtgtg

SEQ ID NO: 50282 - DNA, 672 bp, Zea mays
  misc_feature: Ceres CLONE 1462640-F
  misc_feature: Encodes the peptide sequence at SEQ ID NO. 50283
  misc_feature (571)..(571): n is a, c, t, g, unknown, or other
  misc_feature (572)..(572): n is a, c, t, g, unknown, or other
  misc_feature (579)..(579): n is a, c, t, g, unknown, or other
  misc_feature (589)..(589): n is a, c, t, g, unknown, or other
  misc_feature (606)..(606): n is a, c, t, g, unknown, or other
  misc_feature (672)..(672): n is a, c, t, g, unknown, or other
cgattgggtaccgggccccccctcgagccctgcagtggtaaaggtcgataaacttctattttcgtcacaaggctattccgttccgagagccaaaaactccactgctttcatcaactccggcgacttggagaatacgaagttccagaatccgatcgggagtttggtgctcgcgccttgacggattgatttcggtgcgccgatggggcaggcgttccgcaagctgttcgatgccttcttcggcaccagcgagatgagggttgtgatgcttggtctggatgccgccggtaaaaccaccatattgtacaagctgcatatcggggaggttttgtcgactgttcccacgattggtttcaacgtcgagaaagttcaatacaagaatgtgatgtttactgtgtgggatgttggtggccaagaaaagttgaggcccttgtggaggcactacttcaacaatactgatggcctgatctacgtagttgattcgttggatcgggagagaattggaaaagccaagctgaatttcagggcataatcaaagatcctttgatgcttaacagtgtaatactggtacttnngccatangcagatatgnaaggggcaatgacaccnatggaggtgtgtgagggtcttgccctctacgattttgagaaccgcatctggcacatccaaggctcn

SEQ ID NO: 50283 - protein, 109 aa, Zea mays
  misc_feature: Ceres CLONE 1462640-F
  misc_feature (5)..(109): Pfam Name: Arf Pfam Description: ADP-ribosylation factor family
MGQAFRKLFDAFFGTSEMRVVMLGLDAAGKTTILYKLHIGEVLSTVPTIGFNVEKVQYKNVMFTVWDVGGQEKLRPLWRHYFNNTDGLIYVVDSLDRERIGKAKLNFRA

SEQ ID NO: 50284 - DNA, 672 bp, Zea mays
  misc_feature: Ceres CLONE 1462642-F
cgattgggtaccgggccccccctcgagccactgcagtggtaaaggaaggcgtgccttctttgattggtcacctgctctcgcggcttgtcagtttggtttctacgagctcttcacgacctaatactaggacattgctaggcctgagtatgatgaaaagaacaaaactctcatctacctcgcaggatctgcatctggtgaggtaattgctgatgtggctctctgacattgtgaagctgttaaggaacgtgtgcacacacgacctggatttgcactgggattgagtgatgagctccctaaatttgtccaatatgaggttgttctagggctctgctgggcaattgatcctcactgggctcgccagataccttatcccatcatgaagtttggttccgtcgacaccatccttaaacttacccccaccacgctgtgcctgttcggaaccctgagggcactaagacaacacagttgggaattagtttatgtggtgcttaccttcacggtgacaactgtgttattgtttcccacccggctgacaatcttgtgtgtttcgtgacccatgcctagggagctaccttgagaaatgcttgttaaaaaaatcgtgcccggtggacccctacactaaaaagacttcatccttccaacggccatgaatcggtacccttggtggaggag

SEQ ID NO: 50285 - DNA, 668 bp, Zea mays
  misc_feature: Ceres CLONE 1462644-F
  misc_feature: Encodes the peptide sequence at SEQ ID NO. 50286
cgattgggtacgggccccccctcgagccctgcagtggtaaagggagtgcgagacaacggatcccgtccgcccccggaccaagaatcccaacctcacagcgatggcatcatcccgcagcgaggaacgtgatcataatcaaccagtggtgcttgtgacgggttgctcggagggcggcatcggccacgcgatggcacgcgccttcgctgaggccgggtgcgccgtcgtggccacggcgcggtcacgcggttccatgcgcggtctcgacggcgacccgcggttcctgctgctggatctcgacgtgcgctccaacgatagcgcgcgcgccaccatggcgaatgcactgcggaagcacggccgcatcgacatgctcgtcaacaacgctggggttcacctcgtcgcaccaatcgccgaggtgcccatggagtccttccaccaggttttcgacaccaatgtctatggtgcaatgaggttaattcaatctgttattcctcacatgatgcagagaatgacacgaacaattgtgaatgtcggaagtattaccgctctggcacatgaacaatgggctggtgtgtattcagcatgcaaagctgctcttcatgcattgaatgactcgttaagggtggaactaagaaacttcggctacacgtgatgaccgtcgtcacacgagg

SEQ ID NO: 50286 - protein, 182 aa, Zea mays
  misc_feature: Ceres CLONE 1462644-F
  misc_feature (14)..(177): Pfam Name: adh_short Pfam Description: short chain dehydrogenase
  misc_feature: SWISSPROT Homolog: EC 1.1.1.36 Acetoacetyl-CoA reductase
MASSRSEERDHNQPVVLVTGCSEGGIGHAMARAFAEAGCAVVATARSRGSMRGLDGDPRFLLLDLDVRSNDSARATMANALRKHGRIDMLVNNAGVHLVAPIAEVPMESFHQVFDTNVYGAMRLIQSVIPHMMQRMTRTIVNVGSITALAHEQWAGVYSACKAALHALNDSLRVELRNFGYT

SEQ ID NO: 50287 - DNA, 656 bp, Zea mays
  misc_feature: Ceres CLONE 1462647-F
  misc_feature: Encodes the peptide sequence at SEQ ID NO. 50288
cgattgggtacgggccccccctcgagccctgcagtggtaaagggtggggggaggcggagggtgatgcggcggaggaagggagacgaggggaggacgggggcgaggtgagcctgcgggagtggctggaccggccgggccgagcggtggaggcggcagagtgcgtgcacgtgttcaggcaggtggcggaggcggtggccgtcgcgcacgcgcagggggtggccgtgggcagcgcgcggccgtcgtgcttcgtcgtgtcgccgcccttcgcgcgcgtcgccttcatcgagtccgcctccggctccgacgcctcgggctcgtgctcgggctctgacgcctccgaggacgccgacggcgacccggacccggacccggacgcctcgcctccgctgcggcgacgcgacagcgccgtccccggcgaggagcgcgcggggaggtcgttcccgctcaagagcgtgctggccatggagctcagctggtacaccagccctgaggatgcggacgacagcgccgctaccttcgcctctgacgtctacagactgggtgtgctctttgtcgagctgttctatacattcgaaacgatggagggacagatgcggggcatggcgaatctgcggcaccgggtgttgccaccgcagttgctgtttcaatggcccaag

SEQ ID NO: 50288 - protein, 218 aa, Zea mays
  misc_feature: Ceres CLONE 1462647-F
IGYGPPLEPCSGKGWGEAEGDAAEEGRRGEDGGEVSLREWLDRPGRAVEAAECVHVFRQVAEAVAVAHAQGVAVGSARPSCFVVSPPFARVAFIESASGSDASGSCSGSDASEDADGDPDPDPDASPPLRRRDSAVPGEERAGRSFPLKSVLAMELSWYTSPEDADDSAATFASDVYRLGVLFVELFYTFETMEGQMRGMANLRHRVLPPQLLFQWPK

SEQ ID NO: 50289 - DNA, 651 bp, Zea mays
  misc_feature: Ceres CLONE 1462653-F
  misc_feature: Encodes the peptide sequence at SEQ ID NO. 50290
  misc_feature (458)..(458): n is a, c, t, g, unknown, or other
  misc_feature (459)..(459): n is a, c, t, g, unknown, or other
  misc_feature (543)..(543): n is a, c, t, g, unknown, or other
  misc_feature (605)..(605): n is a, c, t, g, unknown, or other
cgattgggtccgggccccccctcgagccctgcagtggtaaaggagtctctcgccgctcgcctctcagccgccgcgtgcctcccagtctcccgccctcgcctctctcttcctctcctctctccctgcgcgccgccgccgtgcctcgccttgcccagagactaaggcgccaggatagtataaatttagttcacgtgattgtggacttctcgccttttggattcaacattttctgcttctcagctctggaatacagaagtgccattgtgggctcaagaggataatgtacgggaggcgtgcatcgcagctgctgaaggagatcgactcctctgaggctggccagctcgtgccattcaacagtgacgtgtttgatcaagtgattagagagtgcaatgagcacaactcacaatttcaatccccgatcaggaaaatggtgggagcaaaacttagatatcgagacnnactagaatgaagatcactatggtgcagctatcccacatctttcccctgctcggacaaaagatgccttatggcttacatgtacanccgagcagaagttatccagagttttagatggaaaattggccctgtgcttcctcatgacatancagaaaagctccatttctcagaaaaggagtactttcagaaccactc

SEQ ID NO: 50290 - protein, 62 aa, Zea mays
  misc_feature: Ceres CLONE 1462653-F
  misc_feature (60)..(60): Xaa is any aa, unknown, or other
MYGRRASQLLKEIDSSEAGQLVPFNSDVFDQVIRECNEHNSQFQSPIRKMVGAKLRYRDXLE

SEQ ID NO: 50291 - DNA, 648 bp, Zea mays
  misc_feature: Ceres CLONE 1462660-F
  misc_feature: Encodes the peptide sequence at SEQ ID NO. 50292
cgggccccccctcgagcactgcagtggtaaagggcagtgacgaactcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcaccaccaagtacaggtgccgcgacttcctccccgaaaactgcggctgcaagatccactagactcatccacagcggcacagccgatggatccttccatgctcctccgtccgtccgccttgctataagcagtcaggcagccaccaataagctagctcttgctgttgttttgcatgtttgattgggtgtcccttcccagtcgagatggaataaaataaatgtcaggcgcacgtaaaaaaaaaaaaaaaaaaccagagctctgggaattcctgcagcccgggggatccactagttctagagcggccgccaccgcggtggagctccagcttttgttt

SEQ ID NO: 50292 - protein, 89 aa, Zea mays
  misc_feature: Ceres CLONE 1462660-F
MKSSTLLAILVLQALLVSAAVAKGPAGPTTKKQCWCGECTSWSGVWTCDDLLTKCAATCKNCVPVSTDKGTTKYRCRDFLPENCGCKIH

SEQ ID NO: 50293 - DNA, 657 bp, Zea mays
  misc_feature: Ceres CLONE 1462663-F
  misc_feature: Encodes the peptide sequence at SEQ ID NO. 50294
tcccccgggctgcaggaattcgcacgagaccattacctagaacatcctaatcgaaaaattgaattgcttctcgcggtaccggtcaccggtggaaccaactccccaccacccgcccccgcgcccgcgggctccaggccgagccgaagctaggcgcgatgtcgctgtcaccggcggacggcgcagcgtactggctgcggtggcaggtcctcgtctgcggcgcgctcatcgcgctgcccacggtggccgcggcggcgctgctgccgcggctgcggagctcagcgccgcccctgcgcgcggccgacctctgggttccttgctgggcgcgcctccacccgggctggctccttgcctaccgcgccgtcgcgctcgccgccgctgtagcgcttctcgcgcgcctcgtcgtcgcgcgcggcatcaccgtcttctacttctacacccagtggacgtttctattactcaccatatattttgcgctatatcagcccatggatgtttggtttactccaggaaaagtttgaggaaatccgacgaatcccgtggacttcttaatgctcatgtcaaaaatccggatgtttccaattctggttctggagagaggaaaacagatgagacaaatatgatgatgacctattatgaacaaatagtgaatgagagaaa

SEQ ID NO: 50294 - protein, 120 aa, Zea mays
  misc_feature: Ceres CLONE 1462663-F
MSLSPADGAAYWLRWQVLVCGALIALPTVAAAALLPRLRSSAPPLRAADLWVPCWARLHPGWLLAYRAVALAAAVALLARLVVARGITVFYFYTQWTFLLLTIYFALYQPMDVWFTPGKV

SEQ ID NO: 50295 - DNA, 674 bp, Zea mays
  misc_feature: Ceres CLONE 1462666-F
  misc_feature: Encodes the peptide sequence at SEQ ID NO. 50296
  misc_feature (374)..(374): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (520)..(520): n is a, c, t, g, unknown, or other
  misc_feature (541)..(541): n is a, c, t, g, unknown, or other
  misc_feature (579)..(579): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (624)..(624): n is a, c, t, g, unknown, or other
ctgcgggaattcgcacgagaccatacctagaacatcctaatcgaaaagtgtcggagcctccgcctcggcttgtccccaccaacccgcagctcgctcccaccaaacccacacccgaacaatggcgtcggcgtccaaggaggaggtgatcgggaagctcaacgtccgcgtggtgcggggcaacaacctggtcatcgccgacccgctcacccacaccagcgacccctacgtcgtcctccagtacggcgctcagaaggtgaagactagtgtccagaagaagaactccaatccagggtggaacgaaggactgttgttctcagtaactcatcctaggggggggggggcgccctgaagtttttgatgaggacaagttcccnccataccacacccatggctggttgctgatatcaacattaccgacatctacgaatgctgctggaggtggcgctgtggcctcgcctcttgaggggtaccgggataaagatgtatcccccctgacgagagcaaacatccnnnnatctgncctatccttcttctgctgaantggttggaggggcgttccctgccttggttttttaagcnccacctagccctaggctgccctgnnnnngcgctcccccccccccngattcccattgtttgtactcaaacacaccaaacccctcttccaatttcaa

SEQ ID NO: 50296 - protein, 76 aa, Zea mays
  misc_feature: Ceres CLONE 1462666-F
  misc_feature (13)..(76): Pfam Name: C2 Pfam Description: C2 domain
MASASKEEVIGKLNVRVVRGNNLVIADPLTHTSDPYVVLQYGAQKVKTSVQKKNSNPGWNEGLLFSVTHPRGGGAP

SEQ ID NO: 50297 - DNA, 673 bp, Zea mays
  misc_feature: Ceres CLONE 1462669-F
  misc_feature: Encodes the peptide sequence at SEQ ID NO. 50298
  misc_feature (421)..(421): n is a, c, t, g, unknown, or other
cgattgggtaccgggccccccctcgagccactgcagtggtaaaggagtgggaccgcgccacgggcggctacgacaggtgcgtgtccaacgaccaggcgcgcgacatcgccgccagcctcggcgtcacgtccgtgttctgggactgggacctgccacggaccagggaagggttctaccgcttcagggggtccgtggcggcggccgtggtccggggccgcgccttcgcgcctcacgccgacatgctgaggatggagacgtccagccccaacgtgggcgagtgcaccgccttcgccgagggcgtcaaggcggcgtgccccgaggcgatgctcgcctacaacctctcgccgtccttcaactgggacgcgtccgggatgacggacgccgagatggccgccttcatcccgagcgtcgcgcgcctccnccacatctggaagatcatcacactcgccgggttccacgccgacgcgctcgtcaccgacacgttcacacgggacttcgcgcgccgcgtcatgctggcctacgtgcataggatccagagggaggagagcatcaacggcgtgcagacgctggagcatcacaagtggtcaggcgccaatttctacgacagggtgctcaaagctgtgcagggtggcatctcctcgactgcagccatgagcaaaagagttactgcaca

SEQ ID NO: 50298 - protein, 223 aa, Zea mays
  misc_feature: Ceres CLONE 1462669-F
  misc_feature (2)..(222): Pfam Name: ICL Pfam Description: Isocitrate lyase family
  misc_feature: SWISSPROT Homolog: EC 4.1.3.1 Isocitrate lyase
  misc_feature (140)..(140): Xaa is any aa, unknown, or other
IGYRAPPRATAVVKEWDRATGGYDRCVSNDQARDIAASLGVTSVFWDWDLPRTREGFYRFRGSVAAAVVRGRAFAPHADMLRMETSSPNVGECTAFAEGVKAACPEAMLAYNLSPSFNWDASGMTDAEMAAFIPSVARLXHIWKIITLAGFHADALVTDTFTRDFARRVMLAYVHRIQREESINGVQTLEHHKWSGANFYDRVLKAVQGGISSTAAMSKRVTA

SEQ ID NO: 50299 - DNA, 673 bp, Zea mays
  misc_feature: Ceres CLONE 1462671-F
  misc_feature: Encodes the peptide sequence at SEQ ID NO. 50300
  misc_feature (335)..(335): n is a, c, t, g, unknown, or other
  misc_feature (357)..(357): n is a, c, t, g, unknown, or other
  misc_feature (358)..(358): n is a, c, t, g, unknown, or other
  misc_feature (382)..(382): n is a, c, t, g, unknown, or other
  misc_feature (398)..(398): n is a, c, t, g, unknown, or other
  misc_feature (574)..(574): n is a, c, t, g, unknown, or other
ctccccgcggtggcggccgctctagaactagtggatcccccgggctgcaggaattcgcacgagaccattacctagaacatcctaatcgaaaaaaaacgcagatccctgcctgcacacggcatccggagttccggactcccctcctcttctcgggcagccgggcgccgcttcgcctcctcctcgcaggcaagaagagcagccagccgcttcgcgatcggggacgcggagaggggaaaggcgagtcgtcgtccgtccacggcagcttccctccctctcctctccgcccccgcttacctagcccggcccctcctacgccccccctccccgccgcgcangatgagcacctctccgggcgcnngtcgcgccgcgtcgcctcccgcgnctattgcctccgccgnccgagcctcgcgggcgacggaaacgttggtggtcgacgagaggtcgccctccacgttaacccgttcctcgtagaggggctcgacaacccctcgcaccgcctcatggtccaccggtggaactggaaatacaaaactttatggcaaaccctcaccggcgggagttcgaattccagaanttcccactttcttacaaaccggggctgccatcggggtgcccacctttttggcttaaaaactttgtggccgaaatttttaaaaaaaacccgtttgccggg

SEQ ID NO: 50300 - protein, 44 aa, Zea mays
  misc_feature: Ceres CLONE 1462671-F
  misc_feature (8)..(8): Xaa is any aa, unknown, or other
  misc_feature (16)..(16): Xaa is any aa, unknown, or other
  misc_feature (21)..(21): Xaa is any aa, unknown, or other
MSTSPGAXRAASPPAXIASAXRASRATETLVVDERSPSTLTRSS

SEQ ID NO: 50301 - DNA, 694 bp, Zea mays
  misc_feature: Ceres CLONE 1462674-F
  misc_feature: Encodes the peptide sequence at SEQ ID NO. 50302
  misc_feature (630)..(630): n is a, c, t, g, unknown, or other
ctccccgcggtggcggccgctctagaactagtggatcccccgggctgcaggaattcgcacgagaccattacctagaacatcctaatcgaaaaaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccaccgcctcgaccagttccgcaagtgggcggagctggagagcggggcgacgaccatcgcgttcacgccgctgcaccagcgggagacggacgagctgtcgggggcggtgcagctgccggactcgtcggccgccggccggggctccgtggaggtctgcttcgcctacgcggacgtcgacgccgcgtacaagcgcgccgtggacaacggggcggtggccgtgagcgcgccggaggacaagccctggggccagaagtccggcttcgtgcgggacatggacggcaacatcgtgcgcatcgcgagctacgtgcgagagtagtcgcattccgctgcatcaccatcgatcaatcgatcagcctttcccatgcatgtctcgtatactancacgtctacacgtgtaccaaaaaaaataaatcgttgtgcaggtcatgtagttgtgggaggtaag

SEQ ID NO: 50302 - protein, 139 aa, Zea mays
  misc_feature: Ceres CLONE 1462674-F
  misc_feature (9)..(133): Pfam Name: Glyoxalase Pfam Description: Glyoxalase/Bleomycin resistance protein/Dioxygenase superfamily
MASGGPKPKLAYIILYVRDVEKAASFYDAAFGYTVHRLDQFRKWAELESGATTIAFTPLHQRETDELSGAVQLPDSSAAGRGSVEVCFAYADVDAAYKRAVDNGAVAVSAPEDKPWGQKSGFVRDMDGNIVRIASYVRE

SEQ ID NO: 50303 - DNA, 685 bp, Zea mays
  misc_feature: Ceres CLONE 1462676-F
  misc_feature: Encodes the peptide sequence at SEQ ID NO. 50304
tggagctccccgcggtggcggccgctctagaactagtggatcccccgggctgcaggaattcgcacgagaccattacctagaacatcctaatcgaaaaagcaaaccttcgggaagggaagcagcagcatgaactgcgcgtctgccatcccgcagctactccaaacagcaacgtcctagccgacgagagcctccctccgccacctacccacccaccaactcccgcccgtcgcctccgcttgtcttttcgtcgagcagttggttggcacctaaccccccagggccgcgggccagtaaggcgggagagtgaggcagaggcactgagccaaagccgggagatgaagaagctgtgccaaggcggcaagaaggggcggcgggtgcacccggcgccggcggacgcggccgtggccgtggcgctgccggccgccgcgctggccctggcgtccgcgctgacggccgaggagcaggaggtgctggcctacctcctgtcctgcggcggcgcggcggtcgtgggcggccgcccgcgccgccgccgcgggccccacccgccggagatgggctgcgcctgcttcggctgctacaagagcttctgggcgcgctgggacgcgtcgcccaacagccacctcatccaccgcatcatcgacgccgtcgaggacggcggccccccgcgccgcacgcaccggcgccg

SEQ ID NO: 50304 - protein, 116 aa, Zea mays
  misc_feature: Ceres CLONE 1462676-F
MKKLCQGGKKGRRVHPAPADAAVAVALPAAALALASALTAEEQEVLAYLLSCGGAAVVGGRPRRRRGPHPPEMGCACFGCYKSFWARWDASPNSHLIHRIIDAVEDGGPPRRTHRR

SEQ ID NO: 50305 - DNA, 699 bp, Zea mays
  misc_feature: Ceres CLONE 1462678-F
  misc_feature: Translation starting site: 77
  misc_feature: Pfam Name: Pept_tRNA_hydro Pfam Description: Peptidyl-tRNA hydrolase
  misc_feature: SWISSPROT Homolog: EC 3.1.1.29 Aminoacyl-tRNA hydrolase
  misc_feature (166)..(166): n is a, c, t, g, unknown, or other
  misc_feature (175)..(175): n is a, c, t, g, unknown, or other
cgattgggtccgggccccccctcgagccctgcagtggtaaaggaagcgcgtgctttttacctaccgaacggcggcgatgcgtcttttctccggcgtcctcgattcttcgtccgcgcttgcctccgccgtccggggctccgtgtccgaccgcctcggattctcgcgnatagttttnggttgagggaggccttcgaacatgcccgctctcgctcgttctgccgcttcatcgtgttctgctactaagggaggcgagaagccgaggctctatcgtcagtctggggaaccccgggcggatgtactaaggcactcgcggtaacgttggggtttgagatgattgatgctattgcggcaccctgagggcatatccttcttcagtaaccatttgagcgcagttgtctggaaaatgcctctttggtgacccccctgtgttgctttgccagccctggacttttatgactgcaagtggtgagtctgtcggacagctggtttcgtgctttccgagcccactcgatcgattagttgggatcaccgatggatcttgatcgacccttggccaaattggctgcggctaaaacaggggggggacatgctgggccaccaaggggtatgagggaatatttgttgaaccttttgaatgcagaaccggggatttttggccggccttaagggatccggcttttgggaccgcccccccttgaa

SEQ ID NO: 50306 - DNA, 668 bp, Zea mays
  misc_feature: Ceres CLONE 1462696-F
  misc_feature: Encodes the peptide sequence at SEQ ID NO. 50307
  misc_feature (381)..(381): n is a, c, t, g, unknown, or other
  misc_feature (668)..(668): n is a, c, t, g, unknown, or other
cgattgggtccgggccccccctcgagccctgcagtggtaaaggagatccattcccaacttcagctgcgcctcgactcgtagcccgaaccctagccaccaagccggaggcgagagagcagccatggcgcggtgcctcgcgctcgtcgccctcctcgtactcggcctcgccgccgccgccgcctccgcggccgacgcgcccttcgtcgtcgcgcacaagaagatttcgctctcccgccccaagccgggcgtcgagcgcgtcgccgtctccctcgacctctacaaccagggatccgcgactgcctatgatgtgtccattaatgacgactcttggccaacagaagtgtttgagcttgtcactggagagaaatcgaagacattggnaaggcttgaccctggtgccactgcttcacacacatatgtcctggagaccaaaacacagggcaggttccagggttcaccagctatcattacataccgtgttcccacaaagacagctcttcaggaggcatactcaactcccatcttcccactggatattctcgctgagagacctccagagaagaagtttgaatgggctaagaggcttgtgatgaaatacgggtcacttgtgcctgttgccccttttgtgggacggtttatcccccttgtcgcgggccccgtcaaaagcn

SEQ ID NO: 50307 - protein, 182 aa, Zea mays
  misc_feature: Ceres CLONE 1462696-F
  misc_feature (10)..(181): Pfam Name: TRAP_beta Pfam Description: Translocon-associated protein beta (TRAPB)
  misc_feature (87)..(87): Xaa is any aa, unknown, or other
MARCLALVALLVLGLAAAAASAADAPFVVAHKKISLSRPKPGVERVAVSLDLYNQGSATAYDVSINDDSWPTEVFELVTGEKSKTLXRLDPGATASHTYVLETKTQGRFQGSPAIITYRVPTKTALQEAYSTPIFPLDILAERPPEKKFEWAKRLVMKYGSLVPVAPFVGRFIPLVAGPVKS

SEQ ID NO: 50308 - DNA, 725 bp, Zea mays
  misc_feature: Ceres CLONE 1462699-F
  misc_feature: Encodes the peptide sequence at SEQ ID NO. 50309
  misc_feature (409)..(409): n is a, c, t, g, unknown, or other
  misc_feature (418)..(418): n is a, c, t, g, unknown, or other
  misc_feature (515)..(515): n is a, c, t, g, unknown, or other
  misc_feature (517)..(517): n is a, c, t, g, unknown, or other
  misc_feature (524)..(524): n is a, c, t, g, unknown, or other
acccgcggtggcggccgctctagaactagtggatcccccgggctgcaggaattcgcacgagaccattacctagaacatcctaatcgaaaaaagacgatctgcgaaacaaacactagtccgtttgcgagagaaaccgagaaagagaagctacagagtcactgaccgaccgctatggcatcgaggcagaacacgcgtgaggcgcccgctgaggccgacgcgcggcgcgccgtggaggagctggctcgggcgcgggacgagcacctcgagaaggcggaggtgaacgcccgctcggccgcggacgagatcgcgcgctcccgcgccgaccgcggtgccgccggtggcggcggcatcctggagagcgtgcaggagggcgccaggtccttggccagcgccgtgggccgcaccttcngtggcgccnaggacgcgaccgtggacagacctcgcagacggcgcacaccgcgggcgaacagctcggcgagtacagggactaccccgccgaacaagcccgggaggcnangaacgcnttctcggtcaaacggggaaaagggcggagccacccgaaacagctgggcaagttcaaaaaccgcccggggaaaagggagggaaccaagggaccggggggcccaaaaaaaaaggaacccgggaggggcccaaaaaaaccccggggaagaaaagaaccccccgcccccaaaggcccggggaccccgggaccccccccggggaga

SEQ ID NO: 50309 - protein, 184 aa, Zea mays
  misc_feature: Ceres CLONE 1462699-F
  misc_feature (80)..(80): Xaa is any aa, unknown, or other
  misc_feature (83)..(83): Xaa is any aa, unknown, or other
  misc_feature (115)..(115): Xaa is any aa, unknown, or other
  misc_feature (116)..(116): Xaa is any aa, unknown, or other
  misc_feature (118)..(118): Xaa is any aa, unknown, or other
MASRQNTREAPAEADARRAVEELARARDEHLEKAEVNARSAADEIARSRADRGAAGGGGILESVQEGARSLASAVGRTFXGAXDATVDRPRRRRTPRANSSASTGTTPPNKPGRXXTXSRSNGEKGGATRNSWASSKTARGKGREPRDRGAQKKRNPGGAQKNPGEEKNPPPPKARGPRDPPRG

SEQ ID NO: 50310 - DNA, 659 bp, Zea mays
  misc_feature: Ceres CLONE 1462717-F
  misc_feature: Encodes the peptide sequence at SEQ ID NO. 50311
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (652)..(652): n is a, c, t, g, unknown, or other
gggccccccctcgagccctgcagtggtaaaggagacgcaccccttcctcgtttcgccgcctccgccgacaccgactgcctacctcagctgccgtcgccatgggcagaaggcctgctagatgctatcgccagatcaagaacaagccataccctaagtccaggtactgccgtggtgtccctgaccccaagatcaggatctacgatgtcgggatgaagaggaagggtgttgatgagttcccctactgtgtgcaccttgtctcttgggagaaggagaatgtctccagtgaggcgctcgaggctgcccgcattgcctgcaacaagtacatgaccaagtctgcaggaaaggatgccttccaccttagggtccgggttcacccgttccatgtcctccgtatcaacaagatgctttcgtgtgctggggctgataggctccagactggaatgaggggtgcctttggcaagcctcagggcacctgtgctagggtggacattggtcaggtcctcctttccgtgcgatgcaaggacaaacatgctgcacatgccagcgaagctctgcgtcgcgctaagtttcagtttcctgggnnngcaaagatcattgagagcagaaagtggggcttcaccaagttcagccgcgctgactaccctgagtacangagcgag

SEQ ID NO: 50311 - protein, 187 aa, Zea mays
  misc_feature: Ceres CLONE 1462717-F
  misc_feature (5)..(167): Pfam Name: Ribosomal_L16 Pfam Description: Ribosomal protein L16
  misc_feature (162)..(162): Xaa is any aa, unknown, or other
  misc_feature (185)..(185): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDKHAAHASEALRRAKFQFPGXAKIIESRKWGFTKFSRADYPEYXSE

SEQ ID NO: 50312 - DNA, 687 bp, Zea mays
  misc_feature: Ceres CLONE 1462719-F
  misc_feature: Encodes the peptide sequence at SEQ ID NO. 50313
tcccccgggctgcaggaattctcacgagaccattacctagaacatcctaatcgaaaacaccttccacttcagcttcattccacttccacttggatcgatcgatcgcatatggcggtactgtgcgggtggtcatcgtcctggttgtcctcccgcgccgtcgctgctgagctgctttgcgctgctggtggctcacgacagcgatggacgccgccacaagagcaacaatggcggtggcagtggcagttccagcctcagcaagatccacaagcaaggtggagggggacgagcccatgccgtgcctacgacaccgtctccgtatccgtctccgtttccaagcccttaaagcaacagccccacctactacgggtgggttaacccccgtgcgacagggggcggtgccccgaacggggatgggttcgacgacaatagccgcgcgtgcggcttcaaaggagtgaacatgacacctttctcggtgatgacttcgcgccgaaacgaaccaattttccagaacagcaaattatgcatcgtcctgctaccagatccggggtacggttcaccctggcccgctccgggagtgggtgacagggggaatctcccccggatatgaccccaaccaacccgcgtggcccccctacttacttttaacctgaatgggccctccccttttggtgctctttgcccactgtc

SEQ ID NO: 50313 - protein, 49 aa, Zea mays
  misc_feature: Ceres CLONE 1462719-F
MTPFSVMTSRRNEPIFQNSKLCIVLLPDPGYGSPWPAPGVGDRGNLPRI

SEQ ID NO: 50314 - DNA, 647 bp, Zea mays
  misc_feature: Ceres CLONE 1462727-F
  misc_feature: Encodes the peptide sequence at SEQ ID NO. 50315
cctcgagccactgctgtggtaaaggcaggcggacacggacgcgggcgtgatcctggtgaacgtgcaggccatggacaacccgaaggcgttcgagaaggcggtggggaaggtgatgggcaaggcgacggcgcaggcgtcggcggcgggcagcgcggggctcgggcgggacaaggagcagtacacgccgttcgtgtccatctacgggctggcgcagtgcacgcgggacctcacgccgctgacctgcgcgcagtgcctgtccacggcgctgtccaggttcggcgactactgcggcgcgcagcagggctgccagatcaactacagcagctgcagggtgcgctacgagatctaccccttctacttcccgctcgccggcaagggcggcggcctcgccaccaccgacatgacgaagaacaccaagatcgtcgtgcgtccttaattagcctgaagtgacttgtgtgccttaacgtagggtaaagtagccttgcgttagctagcaataaagatgtgcaactgtatgtgttaagagcttatgcagtgtaagtacatctctgcgtcgaagcaatagtattgatatgttaaactacgatcagtcaccaccaacttttatgttccaaaaaaaaaaaaaaaaaaccagagctctgggaatt

SEQ ID NO: 50315 - protein, 121 aa, Zea mays
  misc_feature: Ceres CLONE 1462727-F
  misc_feature (43)..(97): Pfam Name: DUF26 Pfam Description: Domain of unknown function DUF26
MDNPKAFEKAVGKVMGKATAQASAAGSAGLGRDKEQYTPFVSIYGLAQCTRDLTPLTCAQCLSTALSRFGDYCGAQQGCQINYSSCRVRYEIYPFYFPLAGKGGGLATTDMTKNTKIVVRP

SEQ ID NO: 50316 - DNA, 633 bp, Zea mays
  misc_feature: Ceres CLONE 1462733-F
  misc_feature: Translation starting site: 117
  misc_feature (356)..(356): n is a, c, t, g, unknown, or other
  misc_feature (442)..(442): n is a, c, t, g, unknown, or other
  misc_feature (627)..(627): n is a, c, t, g, unknown, or other
tcgagccctgcagtggtaaaggggaggtcaaatagcgaaaggacgcacgaaccccaggaggcaccgtctccaaagtccaaaccctaaccctagcgcccccaactcgtcgccgggagatggccatggacgcggagcggcggcaagcggagctgatcgcgcagttctcctctcaggcggtggctctttcgtccgcgcagcagctcgccgctctggtgctcgaggccacctcccacccggccctcttcgccttctccgagctcctcgccctcccggccctctccatgctcgctggcactcagtactcgtcttcactggacttgctccggctcttcgcctatggcacccttgaggactantagaatattcgggatccctttcagcattgttgcctgatcaggtccgaaagctaaagcaactcagtgtgctaactctggcagagtcnactaagatactaccatatgatccgctcatgcaagaggtggatgtttcccacggtagaagactccaagatttttcaatccatggatgcatgtattcaggtatcgtccgaggcaaactggatcagctgaaaagatgctttgaagtacaatttgcagctgggagagatctaacacctgatcagctaancacatg

SEQ ID NO: 50317 - DNA, 667 bp, Zea mays
  misc_feature: Ceres CLONE 1462738-F
  misc_feature: Translation starting site: 47
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
caattgggtaccgggccccccctcgagccctgcagtggtaaaggagatggcgatctcgcggggcctcaacggcatcggtctcgcgctggtcctcccggcgatcagctcgctcgtcgccgactacaccgatgaccacacccgtggcgcggccttcgggtggctgcagatgacctgcaacctcggctccatcctggggggctctttcggcgtgctgctcgcgccagtcaccttcctcggcgtcgctgggtggcggctcgccttccactccgtggccgtgatcagcgtcgcgctgggcgtgctcatgtggctcttcgccgcggacccgagcccggcctgcaagtgcaagaccgcggcctcggcggggggaggaagccaaagagctgctccagcacgccaggcgcgtcctcggggtgaccacgttccagatcatcgtgccgcaggggatcgccggctccatcccgtggtcccgcgctcacttctccggcatgtggctggagctcgtcgggttcacgaattggcaaacagcgtcatcacggggctgtacctggttcgcaccgctctcggggcgctctttgccggggnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50318 - DNA, 657 bp, Zea mays
  misc_feature: Ceres CLONE 1462752-F
  misc_feature: Encodes the peptide sequence at SEQ ID NO. 50319
  misc_feature (615)..(615): n is a, c, t, g, unknown, or other
  misc_feature (626)..(626): n is a, c, t, g, unknown, or other
cgattgggtaccgggccccccctcgagccactgcagtggtaaagggttcgcttcctttcgtcaactccacttctcttctccgcgacagctcctcttcgccgccgccgacgcttcacccggcagccagccatggatgaggagtacgacgtgatcgtactaggcacggggctcgaggagtgcatcctcagcggtctcctctctgtagacggcctcaaggttttgcatatggacagaaatgactactatggaggagattccacctcactcaaccttaatcagctctggaagaggtttagaggggaagacaagcccccagcacatctaggtgcaagcagagactacaatgtggacatggtgccaaagtttatgatggcaaatgggacattggttcgaaccctcattcacaccgacgtgacaaagtacttgtcattcacagctgttgatgggagctatgttttctgcacacggaagatttacaacgtccctgccactgatatggaggctctgaagtcccctttgatgtgcctattcgagaagcgcagatcaaggaacttcttcatttatgtccaagattacaatgaagctgatccaagcacacatcaaggattggacttnactacggtgancactagagaacttatagcagagtatggttta

SEQ ID NO: 50319 - protein, 176 aa, Zea mays
  misc_feature: Ceres CLONE 1462752-F
  misc_feature (1)..(176): Pfam Name: GDI Pfam Description: GDP dissociation inhibitor
  misc_feature (162)..(162): Xaa is any aa, unknown, or other
  misc_feature (166)..(166): Xaa is any aa, unknown, or other
MDEEYDVIVLGTGLEECILSGLLSVDGLKVLHMDRNDYYGGDSTSLNLNQLWKRFRGEDKPPAHLGASRDYNVDMVPKFMMANGTLVRTLIHTDVTKYLSFTAVDGSYVFCTRKIYNVPATDMEALKSPLMCLFEKRRSRNFFIYVQDYNEADPSTHQGLDXTTVXTRELIAEYGL

SEQ ID NO: 50320 - DNA, 849 bp, Zea mays
  misc_feature: Ceres CLONE 1462760-F
  misc_feature (36)..(36): n is a, c, t, g, unknown, or other
  misc_feature (37)..(37): n is a, c, t, g, unknown, or other
ccgtgttccccgcgccctctgcttctccgtaaatgnntttttgccgggccaaaactgggagtccccgcgggggcggccgctctataacagtggatcccccgggctgcaggatttcccacgagaccattacctagaacatcctaatcgaaaaacagcgactgtgagcttctttcgttcagttcatccgtgttcttgttcgataggtcgagagacagaggatgtcgtgctgcggatgcaactgtgggtgccgctcctgctgcaattgcggccccggttgcttagggtgcacctagacgtttccggacatggttgatccggtgaattacccccgcccatgctctcatcatgggcgtcgtctgcttcccaggggctcctcttttggcgtgctcctatggcggtcgtcgttatctcagaacggttggcgtaatatgctgcggtgaagttgggattatttaccccttgtgccctgcgttgaacccccctctatgctgcttaccccccctgtcggccgttttcggtgcgcaatttttcgtcttatgtcttatcgctttcacctcatcgtatctatttgcccccctttcatgggctgttttttccgcggcacagttctatttccccactttcttcttccccccttttctctgtctttgcggggggttttacccaattgaggattatgccttactgcccgttcttttccccctaggttccctttggcccatccttttgaaccgttccccttgttttgaattctccccctttttgttcatgccgcgctttagcctccccccacctcagctctatggacttgatgcctgtggtgttttgcttccgctcctccttttctta

SEQ ID NO: 50321 - DNA, 677 bp, Zea mays
  misc_feature: Ceres CLONE 1462766-F
  misc_feature: Encodes the peptide sequence at SEQ ID NO. 50322
ccccgcggtggcggccgctctataactagtggatcccccgggctgcaggaattcgcacgagaccattacctagaacatcctaatcgaaaaatcggttagcttgtttcggcgtttcgttggatcagcagagcgttaaaccctatccgttggatgtagcactacaggcgtcgagcactggtaatcctgcaaccttcgtcatggcgcatgcggcggcggccgccgccgtgccgttacgtcgtccgctcctcttcctcaaggaggctcgactcctgtccacactcgcgacccccttacctgggctccgccacccgcgcgccctccgacccacaggccccttgccctccgatgccgaggacaccgacgatccagacgccggcgacggcgccgccgtgtccttcaagaagagccgcaacgaactgaagcgggaggcccgccgcgccgtgaagtggggaatggacctcgccaagttctccccacctcagatcaagcgcatcctcagtgccgcgtcgctggagcgcgaggtgttcgacgcgctaatgctcgtgaagaagtttgggcccggatgtgcgggaaggaaggaggagacagttcaattacatcggaagtcttttgcgcgatgcacaacccgaaatgagggggactctcatacaacactctccagaggaagaggagaagag

SEQ ID NO: 50322 - protein, 160 aa, Zea mays
  misc_feature: Ceres CLONE 1462766-F
MAHAAAAAAVPLRRPLLFLKEARLLSTLATPLPGLRHPRALRPTGPLPSDAEDTDDPDAGDGAAVSFKKSRNELKREARRAVKWGMDLAKFSPPQIKRILSAASLEREVFDALMLVKKFGPGCAGRKEETVQLHRKSFARCTTRNEGDSHTTLSRGRGEE

SEQ ID NO: 50323 - DNA, 700 bp, Zea mays
  misc_feature: Ceres CLONE 1462768-F
  misc_feature: Encodes the peptide sequence at SEQ ID NO. 50324
aaagctggagctccccgcggtggcggccgctctagaactagtggatcccccgggctgcaggaattcgcacgagaccattacctagaacatcctaatcgaaaattacctagaacatcctaatcaaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatcctacactttggttggaacttcaccctccaccaaaaaccccgtcggg

SEQ ID NO: 50324 - protein, 155 aa, Zea mays
  misc_feature: Ceres CLONE 1462768-F
  misc_feature (34)..(135): Pfam Name: ADH_N Pfam Description: Alcohol dehydrogenase GroES-like domain
  misc_feature: SWISSPROT Homolog: EC 1.1.1.1 Alcohol dehydrogenase
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPILHFGWNFTLHQKPRR

SEQ ID NO: 50325 - DNA, 570 bp, Zea mays
  misc_feature: Ceres CLONE 1462769-F
  misc_feature: Encodes the peptide sequence at SEQ ID NO. 50326
  misc_feature (315)..(315): n is a, c, t, g, unknown, or other
aagctggagctccccgcggtggcggccgctctagaactagtggatcccccgggctgcaggaattcgcacgagaccattacctagaacatcctaatcgaaaaactgcaaccccggaacagagcgaggcgacgccgaggcacctcatctccggcgaagggaaatggcgaccgttccaggggatctgatctggcagattgtgaggaagaacaactccttcctggtgaagcagtttggcaacggcaatgccaaggtggcagtttcaccaaagagcccaacaacctctacatgtacactcctacaagtactctggcttancaacaagaaaactgtacgatccacccgctgctgaaaagactcggctgtgttctttcctccaccagaccagaacaaaaccccccccgaagctccccaatctggaatgcccaaggattccccaaaaagggcaagggtgggaaaacccggttgggcaaaaatttttaaggccggattgtccaaatcgcccctgggaaggtgaacctcttggtcccccaccccccgtttttgcaaatttggggggaaaaaaaaaaaaaa

SEQ ID NO: 50326 - protein, 62 aa, Zea mays
  misc_feature: Ceres CLONE 1462769-F
  misc_feature (52)..(52): Xaa is any aa, unknown, or other
MATVPGDLIWQIVRKNNSFLVKQFGNGNAKVAVSPKSPTTSTCTLLQVLWLXNKKTVRSTRC

SEQ ID NO: 50327 - DNA, 674 bp, Zea mays
  misc_feature: Ceres CLONE 1462770-F
  misc_feature: Encodes the peptide sequence at SEQ ID NO. 50328
  misc_feature (531)..(531): n is a, c, t, g, unknown, or other
  misc_feature (539)..(539): n is a, c, t, g, unknown, or other
  misc_feature (564)..(564): n is a, c, t, g, unknown, or other
ctggagctccccgcggtggcggccgctctagaactagtggatcccccgggctgcaggaattcgcacgagaccattacctagaacatcctaatcgaaaactccgatcctatcacatcgcgcactaccttccagcgaatccatcacggaagaaattgttccccacccaccctagactcgccgccgtcgcaactcccacccgatccccaaattctccggcggtgatggccagcctgtggcgcgccgtgatggatagcgtcagcggctcctccccctcggcgctggacgcggccccaggtagcggcgtcgagttctggcacggcgcagagcgcgctgggtggctaaataagcagggcgagtacatcaagacgtggaggcggcggtggttcgtgctgaagcaggggaggcttttctggttcaaggaccctgcggtgacacgggcctcggtgccccgcggcgtcatccccgtcgccacctggctcacagtcaaggggcgccgaagacgtgctcaaccgccagttcgccttcgagctnctcacgcntggcgagaccatgtatttcattgcngactccgagaaggacaggaggaatgaattaactccatcggtggtccatcgtccagaatcccgtccggtaccgaagagaggtcgttgaatagaaagccgcccccagccccg

SEQ ID NO: 50328 - protein, 122 aa, Zea mays
  misc_feature: Ceres CLONE 1462770-F
  misc_feature (34)..(121): Pfam Name: PH Pfam Description: PH domain
  misc_feature: SWISSPROT Homolog: EC 2.7.11.1 Non-specific serine/threonine protein kinase
  misc_feature (104)..(104): Xaa is any aa, unknown, or other
  misc_feature (115)..(115): Xaa is any aa, unknown, or other
MASLWRAVMDSVSGSSPSALDAAPGSGVEFWHGAERAGWLNKQGEYIKTWRRRWFVLKQGRLFWFKDPAVTRASVPRGVIPVATWLTVKGRRRRAQPPVRLRAXHAWRDHVFHCXLREGQEE

SEQ ID NO: 50329 - DNA, 714 bp, Zea mays
  misc_feature: Ceres CLONE 1462776-F
aaactggagctccccgcggtggcggccgctctagaactagtggatcccccgggctgcaggaattcgcacgagaccattacctagaacatcctaatcgaaaaatttctatcgccgaatgcgctgctcattcgtcctttttgataccattctctaccgtcgcctcctccccatcgacttggctctctataatgatatggccccgcccccgccgtcgaaagacgcctagtccgaaggggaggtccacaacaatctacacgtggaaccccgccaaagcatgaacataaggagaatcatctccggatgctctactccgctctctacaatgaggagactctctgaggaggctctgatctacagatccccccctcctgcttatggtatcgcctctagattcatgcctgactgagctcgcagggatatcaaggacctgatggcgagtgacctcgtcccgatgctcacctaccacttgcgccaacctgtctggtgctgggtacaagctgactaaagtaggaattcgcttgtttgccctctcggcaggagctcgacatcttgtaaacagttgccatctcggccaaaaatttggcaaatgcctggttaaaagaaaaattgcccggtccaaaaaacgtatacaaagagtaccgcgttttttttgcctagaccaataaaaacattaagctgacccaaacctgttccacctgcgaagggggggcctgg

SEQ ID NO: 50330 - DNA, 709 bp, Zea mays
  misc_feature: Ceres CLONE 1462780-F
  misc_feature: Encodes the peptide sequence at SEQ ID NO. 50331
aaagctggagctccccgcggtggcggccgctctataactagtggatcccccgggctgcaggaattcgcacgagaccattaccaaaacatcctaatcgaaaaagtcgcctcgtctctccctgccgcgtcgcctcgtctctccctgccgcgtcgcctccagttccgacgccagcgcgcctcccgcctccgccgcgcctgacgaacgcaatgtatgactgtgcaggtagaaaggaggagggtccggcgagatggggatgcgagataagaagcggaaccagaagcgagtgctcgcgcgccgtaccacggtaccgcgcccaggcgagggcaaggacttcctgccgctggaaggaggccccggtaagaagctccggaaggtgcaacagcctgaagagcccgaaaacacagccacagtcgtctacattggggatatcccccatggtttctaccaggacgagatgaaagggttctttaagcagtttggggatattaagaggcttacgatcgctcgtaaccgcaagacaggaaagtccaagcactatggattcattgagtttgagaaccctgctgtggcaaaggtcgtagcagatgagatgaataactatctcttgtgtgagcgcaccttgcacgttgcacttgttgatccggagagagtcatcctaaattatgtaaaggggtgcgaacgggatctatccctgttgatcgattcaaaa

SEQ ID NO: 50331 - protein, 154 aa, Zea mays
  misc_feature: Ceres CLONE 1462780-F
  misc_feature (56)..(127): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGMRDKKRNQKRVLARRTTVPRPGEGKDFLPLEGGPGKKLRKVQQPEEPENTATVVYIGDIPHGFYQDEMKGFFKQFGDIKRLTIARNRKTGKSKHYGFIEFENPAVAKVVADEMNNYLLCERTLHVALVDPERVILNYVKGCERDLSLLIDSK

SEQ ID NO: 50332 - DNA, 801 bp, Zea mays
  misc_feature: Ceres CLONE 1462781-F
  misc_feature: Encodes the peptide sequence at SEQ ID NO. 50333
  misc_feature (801)..(801): n is a, c, t, g, unknown, or other
tggagctcaccgcggtggcggccgctctagaactagtggatcccccgggctgcaggaattcgcacgagaccattacctagaacatcctaatcgaaaaactgcaactctgcgagtgccagaaaaaaaatactgccacccaccaccgcgccgccgcgccatggcttccccatccccttcctcgcccctccacccgcaccagcacccacctcctccgaatgttcaccaccaattccaatccctaccgccttcgatgccgccaccgccgccgtcaacggcgctgccaaaggcgctcgaccttgaggttaccgtcgtctgccggaaaccacttggaaaaatgcaactgggccccgtgggcaacctccgtgccttactttggggagaaacttggaaccctcccgccggggccattacccgccccaaaggaagggggggggggggcaaaaccaaccaggaaaaaagaggccctgtccctcccggttttcggccccacctttctccccggtaaaaaacccccccatccttcccgggtcccccagatttttccccactctcaaacctcccccaaatttcccccaaacgctctcccttgcgagtacccccccacgcttccttcttaggggagccccctcctccccccccgaaaaccttaaccccccgaggccgaattcccccgtaccgccctcctgtcccccttattttatacccaatatccgcaacctccttgttggcctcctggtgggggtagaagactctgttgtcgcctccgtcccccctccccaaaataattcgtctctcccactn

SEQ ID NO: 50333 - protein, 115 aa, Zea mays
  misc_feature: Ceres CLONE 1462781-F
MASPSPSSPLHPHQHPPPPNVHHQFQSLPPSMPPPPPSTALPKALDLEVTVVCRKPLGKMQLGPVGNLRALLWGETWNPPAGAITRPKGRGGGGKTNQEKRGPVPPGFRPHLSPR

SEQ ID NO: 50334 - DNA, 726 bp, Zea mays
  misc_feature: Ceres CLONE 1462782-F
  misc_feature: Encodes the peptide sequence at SEQ ID NO. 50335
gagcaggagctcaccgcggtggcggccgctctagtactagtggatcccccgggctgcaggaattcgcacgagaccattacctagaacatcctaatcgaaaaaagttcccatcccagtccgtcagtcaagcgagcgaaatcgaatggctcccctcttcgccgcggcgtcccacgcgtccctcctccccctctcctccctcgaccgccccgccgccggccacctagtccgtggcaccctcaggccccacacctcgagcctccgcctgcgccgccccccgggggcaaccgggcgcggccgcgggcgtggccgagggggcatcccagacgagtggggcgagcgctcgccgccggacaaccccgagccccccgcgcagcccgatcctcccatcgacgaagacgagtggggccgcgacgactctgccgaggggcactcacgccctatcgtcgtcgacgaggggggcaagcccggggtgcctgagcccgagccgccctccggccgcggacccgcccaagcccctccgcaaacgacgaactggggaaaaggaaccgggaagggcccgggcccggaccctggctcgggggggggaaaggggaacaaacaggaggtgaaaaagggaagaaccctcaaccgtgcccgggggaaaacgggggataaggttcccaaaccccggtttccgggggggccccggggggccaaaaagggagggcctccaaaaaataccccccc

SEQ ID NO: 50335 - protein, 194 aa, Zea mays
  misc_feature: Ceres CLONE 1462782-F
MAPLFAAASHASLLPLSSLDRPAAGHLVRGTLRPHTSSLRLRRPPGATGRGRGRGRGGIPDEWGERSPPDNPEPPAQPDPPIDEDEWGRDDSAEGHSRPIVVDEGGKPGVPEPEPPSGRGPAQAPPQTTNWGKGTGKGPGPDPGSGGGKGNKQEVKKGRTLNRARGKTGDKVPKPRFPGGPRGAKKGGPPKNTP

SEQ ID NO: 50336 - DNA, 697 bp, Zea mays
  misc_feature: Ceres CLONE 1462783-F
  misc_feature: Encodes the peptide sequence at SEQ ID NO. 50337
  misc_feature (697)..(697): n is a, c, t, g, unknown, or other
aactggagctcaccgcggtggcggccgctctagtactagtggatcccccgggctgcaggaattcgcacgagaccatacctagaacatcctaatcgaaaagaattgatctaaaaattgctccatatgataccatacagctaaaggttgggccatcatggcttgacaagaaatgttcagaatttggaccacctgtgtatccagcatcagctcattcagttaggatcccagtcttcgacctactacctcaaatacagctggaggcagttctttggggaattgggactgcgcttggtgagctccctccttattttatatcacgagcagctcgcttatcaggaagcgagtcaaaagctgttcaggagcttgatgcagctacttccaaagaagatgggccagtagcatcatcccttaatcgaaccaagcgttggcttctctctcactcccaacatctcaacttcttctctatcttgattcttgcttcagttccaaatccactctttgaccttgctggtattatgtgtgggcaatttggtgtgcctttctgggagttcttgtttgctactttgattgggaaagccatcattaatactcatattcagacactatttatcgtgtccctgtgaaacaatccgctcttggatcatattgaaaaggaattaatctggattttgggtcacctccctgggtttccggcccn

SEQ ID NO: 50337 - protein, 29 aa, Zea mays
  misc_feature: Ceres CLONE 1462783-F
LELTAVAAALVLVDPPGCRNSHETIPRTS

SEQ ID NO: 50338 - DNA, 695 bp, Zea mays
  misc_feature: Ceres CLONE 1462787-F
  misc_feature: Encodes the peptide sequence at SEQ ID NO. 50339
ggagctccccgcggtggcggccgctctagaactagtggatcccccgggctgcaggaattcgcacgagaccattacctagaacatcctaatcgaaaaatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacctcctccagggcatcgagaaaggggggcacccgcaacggctccacctcctaggtggtcaaagttccttaccggcgaacagcctccctatatctctctgatcgggtctggtccggcccccctcccttcgtgtatcgggaaa

SEQ ID NO: 50339 - protein, 176 aa, Zea mays
  misc_feature: Ceres CLONE 1462787-F
  misc_feature (5)..(165): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTVGGAPAGRIVMELYANEVPKTAENFRALCTGEKGVGKSGKPLHYKGSTFHRVIPEFMCQGGDFTRGNGTGGESIYGEKFPDEKFVRKHTAPGVLSMANAGPNTNGSQFFICTVATPWLDGKHVVFGQVVEGMDLLQGIEKGGHPQRLHLLGGQSSLPANSLPISL

SEQ ID NO: 50340 - DNA, 651 bp, Zea mays
  misc_feature: Ceres CLONE 1462790-F
  misc_feature: Encodes the peptide sequence at SEQ ID NO. 50341
ggatcccccgggctgcaggaattcgcacgagaccattacctagaacatcctaatcgaaaagcctccgcctcccaaacacccgaatcaaactaacagccaccgatggcgtcgccgtcgcggttgctcccgcccacgcctccttcggccgcccagccccgcggcccgcgggatcgcctcgccttgccgcgcctccggtgcctcgccgccgccgcagcctccgcctcgcccactgatggcgctgtgctgctggagcgtggcggttccacggcggtggccgcgcggtagttcatcacgcttgacgagctccgcgctgccgtgcgcctccgagtccgcagcttccactattacgcacacaactccgtcggaaccgagttttgttaggataacagaaaggctcttgcagattagggagtttgaagcattacaagatacgatttctggcaagatgattaattaccgaagagtttcttgcataaacgggactgttccactgtccccctcattaatgttaacttgagaaactttggcctaagtgcctctctgtgaagaagggaaaagaagattaaaaactggtagttaagaccttaatcagaggctttgccctgcacactcctgtgaacgggccaaagcctggggggaccaccctccctt

SEQ ID NO: 50341 - protein, 94 aa, Zea mays
  misc_feature: Ceres CLONE 1462790-F
MALCCWSVAVPRRWPRGSSSRLTSSALPCASESAASTITHTTPSEPSFVRITERLLQIREFEALQDTISGKMINYRRVSCINGTVPLSPSLMLT

SEQ ID NO: 50342 - DNA, 704 bp, Zea mays
  misc_feature: Ceres CLONE 1462797-F
  misc_feature: Encodes the peptide sequence at SEQ ID NO. 50343
tccccgcggtggcggccgctctagaactagtggatcccccgggctgcaggaattcgcacgagaccattacctagaacatcctaatcgaaaaacacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaatgactcggacatgccatgcgtacctgtccgtcgccgaataatggatgtgtgtgtgcttcgttccaataaattgctagtaaaaataatggcatcgtcggtatgcatgaataaaatgtatcagaatgttcatcctttcacgattggatatatgaaaattggatatatgaaaatgtgctcaaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcg

SEQ ID NO: 50343 - protein, 71 aa, Zea mays; identical to SEQ ID NO: 46326
  misc_feature: Ceres CLONE 1462797-F
  misc_feature (12)..(71): Pfam Name: potato_inhibit Pfam Description: Potato inhibitor I family

SEQ ID NO: 50344 - DNA, 722 bp, Zea mays
  misc_feature: Ceres CLONE 1462798-F
  misc_feature: Encodes the peptide sequence at SEQ ID NO. 50345
aaagctggagctccccgctgtggcggccgctctagtctagtggatcccccgggctgcaggaattcgcacgagaccattacctagaacatcctaatcgaaaaaccctataaattgtctcgccagaccattccaatccggcaactcctgctctgcctgagcctgagcgtaggcggctaccaaagagaagggtaggcggcgccggcggcgggagcaatagaagagcggtaaatccaagagagatcagagcctccgagggaaacagaagcgcacagagcatggagagcccgatctcgaggactaacctgaattgcatcagcctggcggacccgaacgtccagaaatcagtggcgctcctcaagcaggcatgcctggattcaggcttcttctatgttgtggatcatgggataagccaagagttcatggatgaagtttttgcccagagcaagaagttctttgaccttcctcatagtgagaaaatgaagcttctccgagacgagaagaatagagggtacacacccatgctagatgaaattcttgatcctgaaaatcaagtgaatggtgactacaaggaaggatattatattggagttgaggtacctgcagatgatccacaagcaaacaggccgttttatggtccaaatcagtggccgtcttacgaagtattacctacccggatagaagagatgggagggggccacatccccgcgggggggtttataaga

SEQ ID NO: 50345 - protein, 149 aa, Zea mays
  misc_feature: Ceres CLONE 1462798-F
  misc_feature: SWISSPROT Homolog: EC 1.14.11.19 Leucocyanidin oxygenase
MESPISRTNLNCISLADPNVQKSVALLKQACLDSGFFYVVDHGISQEFMDEVFAQSKKFFDLPHSEKMKLLRDEKNRGYTPMLDEILDPENQVNGDYKEGYYIGVEVPADDPQANRPFYGPNQWPSYEVLPTRIEEMGGGHIPAGGFIR

SEQ ID NO: 50346 - DNA, 679 bp, Zea mays
  misc_feature: Ceres CLONE 1462804-F
  misc_feature: Encodes the peptide sequence at SEQ ID NO. 50347
  misc_feature (405)..(405): n is a, c, t, g, unknown, or other
cgattgggtaccgggcccccctcgagccctgtagtggtaaaggagcgaacaagcagcctaaaaaaaccgtatcgtctcgcctgttcagtttccttctcctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcnttagccccgtctacgaccgcttcggcggcctgccgctcgacgtcctcgccttcgtcgaccgcaaggtggacgacacggtgcacgaggtggacaagcacctcccgggcgcgctgaaggcggcgtcggcgcatgtctacccggtggttcggggcgtgcccgaagtgggcgcgcgagcctggcggccgaggcgcaacggttcggggcttgaggggggcaaccccgtgccggcgcctccgcggtgaccggaaccgggtgggctccgggaacgtggtac

SEQ ID NO: 50347 - protein, 156 aa, Zea mays
  misc_feature: Ceres CLONE 1462804-F
  misc_feature (19)..(153): Pfam Name: REF Pfam Description: Rubber elongation factor protein (REF)
  misc_feature (77)..(77): Xaa is any aa, unknown, or other
MAEEQSNPQHQQAEEREVMVEQQQPRRAPKLRYLDFVQVAAAQAAVCLAGLYGLAKDHAGPLRPSVDAVESAVKGVXSPVYDRFGGLPLDVLAFVDRKVDDTVHEVDKHLPGALKAASAHVYPVVRGVPEVGARAWRPRRNGSGLEGGNPVPAPPR

SEQ ID NO: 50348 - DNA, 668 bp, Zea mays
  misc_feature: Ceres CLONE 1462806-F
  misc_feature: Encodes the peptide sequence at SEQ ID NO. 50349
cgattgggtaccgggccccccctcgagccctgcagtggtaaaggacgccaagtgagcgtcagcgagcgaccgcaccggcacggcgcccatccatccatcgccatcctctagcccagtccaaaggaaccctagccatgagcgccggctccaagaagctcttccaggccgccaggtccctagtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcgggatggggagccatcgccgccgcagacccagctgcagtttacatgctccaggaccagaaggctcatgctgcagagatggagcgcaccttcattgacatcaagcctgatggtgtccaaagaggcctgatttctgagattatcagccgatttgagagcaaaggctataagcttgttgccatccagctgattgttccatccaaagaatttgctgagaagtactaccatgatctcaaggaaaggcctttcttcagtgaggtgcgtgattttctcaactctgggcctgtgcttgccatggttcggaaaggagagggtgtcatccagtatgagacaaaactattgttcgcacag

SEQ ID NO: 50349 - protein, 178 aa, Zea mays
  misc_feature: Ceres CLONE 1462806-F
  misc_feature (89)..(177): Pfam Name: NDK Pfam Description: Nucleoside diphosphate kinase
  misc_feature: SWISSPROT Homolog: EC 2.7.4.6 Nucleoside-diphosphate kinase
MSAGSKKLFQAARSLVLSASNRSVLAAEGRTAALATLTNFGRKTLPTAYLSYHKQGSHHAASGWGAIAAADPAAVYMLQDQKAHAAEMERTFIDIKPDGVQRGLISEIISRFESKGYKLVAIQLIVPSKEFAEKYYHDLKERPFFSEVRDFLNSGPVLAMVRKGEGVIQYETKLLFAQ

SEQ ID NO: 50350 - DNA, 672 bp, Zea mays
  misc_feature: Ceres CLONE 1462809-F
  misc_feature: Encodes the peptide sequence at SEQ ID NO. 50351
cgattgggtaccgggcccccctcgagccctgtcgtgggaaaggcggccccgacgcggcgcgcgcctacgacgtcgcggcgcagcggttccgcggccgcgacgcggtcaccaacttccgcccgctcgcggacgccgacccggacgcggccgccgagctccggttcctggcgtcccgctccaaggccgaggtcgtcgacatgctccgcaagcacacatacttcgacgagctcgcgcagaacaagcgcgccttcgccgccgcgtccgcggccaccgcctcgtcgctggccaacaacccttcttcctacgcgtcgctctcccccgcgaccgcgacggccgccgccgccgccgcgcgggagcacctcttcgacaagacggtcacccccagcgacgtgggcaagctgaaccggctggtgatccccatgcagcacgccgagaagcacttcccgctgcagctcccgtccgccggcggcgagagcaagggcgtgctcctcaacctggaggacgccgcgggcaaggtgtggcggttccgctactcgtactggaacagcagccagagctacgtgctcaccaagggctggagccgcttcgtcaaggaagaaggcctccaagccggcgacgtcgccggtttctcccgctccgctgccggcgccgaccccaggctattcctccgag

SEQ ID NO: 50351 - protein, 223 aa, Zea mays
  misc_feature: Ceres CLONE 1462809-F
  misc_feature (120)..(216): Pfam Name: B3 Pfam Description: B3 DNA binding domain
  misc_feature: The sequence is a functional homolog of SEQ ID NO 1186 in the 10/374,780 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 48 in the 10/838,616 US patent application
  misc_feature: The sequence is a functional homolog of SEQ ID NO 50 in the 10/838,616 US patent application
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: The sequence is a functional homolog of SEQ ID NO 46 in the 10/838,616 US patent application
  misc_feature: The sequence is a functional homolog of SEQ ID NO 1182 in the 10/374,780 US patent application
  misc_feature: The sequence is a functional homolog of SEQ ID NO 18 in the 10/838,616 US patent application
  misc_feature: The sequence is a functional homolog of SEQ ID NO 754 in the 11/435,388 US patent application
  misc_feature: The sequence is a functional homolog of SEQ ID NO 1258 in the 11/479,226 US patent application
  misc_feature: The sequence is a functional homolog of SEQ ID NO 138 in the 10/225,068 US patent application
  misc_feature: The sequence is a functional homolog of SEQ ID NO 170 in the 10/374,780 US patent application
  misc_feature: The sequence is a functional homolog of SEQ ID NO 2 in the 10/838,616 US patent application
  misc_feature: The sequence is a functional homolog of SEQ ID NO 208 in the 11/375,241 US patent application
  misc_feature: The sequence is a functional homolog of SEQ ID NO 580 in the 10/412,699 US patent application
  misc_feature: The sequence is a functional homolog of SEQ ID NO 630 in the 11/435,388 US patent application
  misc_feature: The sequence is a functional homolog of SEQ ID NO 796 in the 10/225,066 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: The sequence is a functional homolog of SEQ ID NO 64 in the 10/838,616 US patent application
IGYRAPLEPCRGKGGPDAARAYDVAAQRFRGRDAVTNFRPLADADPDAAAELRFLASRSKAEVVDMLRKHTYFDELAQNKRAFAAASAATASSLANNPSSYASLSPATATAAAAAAREHLFDKTVTPSDVGKLNRLVIPMQHAEKHFPLQLPSAGGESKGVLLNLEDAAGKVWRFRYSYWNSSQSYVLTKGWSRFVKEEGLQAGDVAGFSRSAAGADPRLFLR

SEQ ID NO: 50352 - DNA, 656 bp, Zea mays
  misc_feature: Ceres CLONE 1462812-F
  misc_feature: Encodes the peptide sequence at SEQ ID NO. 50353
cgattgggtacgggccccccctcgagcactgcagtggtaaagggctagctgccgtcgtcgcagtagcagtagtaggagctagcgtttctccatccgtacgtcctgcagtagcgattgggcaggctgggcatcgtcatcgatcgatcgccatgaggctccgcggcgtgctgctcgtcctcgcgctcctcctcgccgccaccgccgtcgtgccggtgctgctccttagcgagaacgacgacggcggcgtcgcacctgcgccgccgttcaactcctcgcgtgtcaaggccgtctcgtggcatccaaggatcttcatgtacaaggggttcctctccgacgccgagtgcgaccacctcgtggctctggcgaagaagaagatccagcggtccatggtggcggacaacgagtccggcaagagcgtcatgagcgaggtgcgcaccagctccggcatgttcctcgacaagcgccaggacccggtggtgagtcggatcgaggagagggtcgcggcatggacgtttcttcctcaagagaacgccgagaacatgcaggtgctgcgctacgagcccgggcagaagtacgagccgcacttcgactacttccacgacagggtcaaccaggcccgcggcggccaccgctacgccaccgtgctcatgtacctg

SEQ ID NO: 50353 - protein, 169 aa, Zea mays
  misc_feature: Ceres CLONE 1462812-F
  misc_feature: SWISSPROT Homolog: EC 1.14.11.2 Procollagen-proline dioxygenase
MRLRGVLLVLALLLAATAVVPVLLLSENDDGGVAPAPPFNSSRVKAVSWHPRIFMYKGFLSDAECDHLVALAKKKIQRSMVADNESGKSVMSEVRTSSGMFLDKRQDPVVSRIEERVAAWTFLPQENAENMQVLRYEPGQKYEPHFDYFHDRVNQARGGHRYATVLMYL

SEQ ID NO: 50354 - DNA, 664 bp, Zea mays
  misc_feature: Ceres CLONE 1462817-F
  misc_feature: Translation starting site: 261
  misc_feature: Pfam Name: Meth_synt_2 Pfam Description: Cobalamin-independent synthase, Catalytic domain
  misc_feature: SWISSPROT Homolog: EC 2.1.1.14 5-methyltetrahydropteroyltriglutamate--homocysteine S-methyltransferase
  misc_feature (425)..(425): n is a, c, t, g, unknown, or other
cgattgggtaccgggccccccctcgagccctgcagtggtaaaggctctgagacatgctattcaatacctcttgccctacacaacgagtgttgaggatcttgacgctgctggtcttcaggtgatccacattgatgactctcttctgaaggagggactgccactgcccacgtcagagcatgcattcatcctgaactggattgaccactctttcataatcaccacctgctcactccacgacaccacgcagatccgcacaccatatgtgctactccaacttcaacgacatcatccactccatcatcgacatggacgcacatgtgatcaccatcgacaactcctggtcctacgagaagctactgtccgtgttccgcgagggtgtgaactaccgatctggattctgtcatggagactacgacatccactcnctcagcatcgcctccaccagagagatcttggaccgcgtcaacaagatggtcgtcgtgctcgacatctacatcgtctgggtgaaccatgactgcggtctcaggaccacaagatcacggaggtgaaccccgcccctgacaacaatgttctcggtcacaaaggttcatccgcagccagcttcggccccccccaaatggggtccaattggggtaaattccttgcgcttgttgaattccaaacc

SEQ ID NO: 50355 - DNA, 669 bp, Zea mays
  misc_feature: Ceres CLONE 1462822-F
  misc_feature: Encodes the peptide sequence at SEQ ID NO. 50356
cgattgggtacgggccccccctcgagcactgcagtggcaaactgaagaagctcctgatcctcatgacgtttattggactttcttttatacaacctttatggaaaaatggattgcgcaagtttgtattatttgtagcttcacttctcctgaaagttgtctttctcctagaaggaggatatgttcctggactacacctatactggaacaactagataaatggtctgtcttttctgaggaatatactggaaatagatgttgtgagtcaactggttacaggatatcttcccagtgttattctacaagttctttcatcttgtgagccctgaacagtgaatctattttcaactatgcaatgtatttgcatctgttagtgtgattgagaaaatcgtttgatacataaaatgcttaccattacaatatggacagccttctcttgccaatgttctcactgcatcagcctcacttcaatctcgacaatttccttagtcgcgaggagctaccttcaacaattgcagttctagtaccaacgcacgtatctctactatatagcatatgagctcccatcgagcacaatcatagaatctgaactcacacaacttactgcttgttactgactatgtcgccaaaatcgtcgaacgagttccaagcgggattactcaaaagcttcat

SEQ ID NO: 50356 - protein, 69 aa, Zea mays
  misc_feature: Ceres CLONE 1462822-F
IGYGPPLEHCSGKLKKLLILMTFIGLSFIQPLWKNGLRKFVLFVASLLLKVVFLLEGGYVPGLHLYWNN

SEQ ID NO: 50357 - DNA, 669 bp, Zea mays
  misc_feature: Ceres CLONE 1462824-F
  misc_feature: Pfam Name: TIM21 Pfam Description: TIM21
cgattgggtaccgggccccccctcgagccactgcagtggtaaaggagggcaccacacagccgataatccacccttacagatctctgtttcccctgttcgctgcctcctcattcctgaacccctccccccagtataccactactaccaatcacatccgcatggcctcccgtgtcacgaggctgctcctgcaccgccgcctcaccaactgagcgaaagcctccgagcgccgtgcgccgcaagctccctgtgccggcgccgctgtctccactgatgttgttaaggctgaagcatcatctttgaaaaatacatggtgatacattactacgtcaaaaacatcaagtcctttgactactatttatgagtgccacaaagtatttccttgttctgtaaggccatctgcatcttactctacacaagcttcataccatattgtaaaacctgaatgtaaagacttgtcggatgtagaacacccctttgatgatattacctacaatatacctgagaagccagtgacatttactgaaggtgcttcttatagtcttgtaatactcgccgggctcggaattgcacgactggctggatatgctgtgttcaaagagcttatattagagcctttggagtaccagatatgtggaagagctctcttaagaattcagattgatagtcagg

SEQ ID NO: 50358 - DNA, 657 bp, Zea mays
  misc_feature: Ceres CLONE 1462830-F
  misc_feature: Encodes the peptide sequence at SEQ ID NO. 50359
  misc_feature (60)..(60): n is a, c, t, g, unknown, or other
  misc_feature (165)..(165): n is a, c, t, g, unknown, or other
  misc_feature (546)..(546): n is a, c, t, g, unknown, or other
  misc_feature (657)..(657): n is a, c, t, g, unknown, or other
ccgattgggtaccgggccccccctcgaggcctagggttgggataggccgcccaacacccntttcttttgtactcttgcgtctctgccctcgcgttatcgccttcgtcacgctcgctcgcctggctggcttgtgtgccttgccttgctcggcgtacgctaacgcancgagagggaggagcaaggaaatagagagagacagagagagagagagagaaaaaatcaagtcatccccctttcctctgagctcgttccatggagaactcttctcacaagcgggcgcgggaggcgggcgacctcgtcgccggcggctgcggagaggagggctcgccgcaggccgacgccaagaggctgcggccgcaggacctgctcgacatgctggaggacgacacggacgcggccgcggccggcgacctagcgtcggtcatgcggagcctggaggaggagatagccagcttcgacgaggccgcggaggcgccggcgccggagctgggcttcctgctcgaagcctcggacgacgagctggggctgccgcccgcctcctcttcngaggaggaggaggccgggcgcgcgggggcgcatgagccgccgcccgccctcgacggccagatctggggcttcgaggacgaaatcgtggacggaggcggcttcggcggctan

SEQ ID NO: 50359 - protein, 134 aa, Zea mays
  misc_feature: Ceres CLONE 1462830-F
MENSSHKRAREAGDLVAGGCGEEGSPQADAKRLRPQDLLDMLEDDTDAAAAGDLASVMRSLEEEIASFDEAAEAPAPELGFLLEASDDELGLPPASSSEEEEAGRAGAHEPPPALDGQIWGFEDEIVDGGGFGG

SEQ ID NO: 50360 - DNA, 653 bp, Zea mays
  misc_feature: Ceres CLONE 1462832-F
  misc_feature: Encodes the peptide sequence at SEQ ID NO. 50361
  misc_feature (1)..(1): n is a, c, t, g, unknown, or other
  misc_feature (167)..(167): n is a, c, t, g, unknown, or other
ncgattgggtaccgggccccccctcgagccctgcatggtaaaggaaagtcgcgtagccacttctccgaatcgagccaaattggctcatgcgccaccagctcctccctctccaccccgatcgcaatgccactacgtgatcaaccccaaaggtcgccgtgaccgtgccngagagatctcgcgctccgggcccgttaccgcgcagctgtgctgtcgcaggcccacccgttcacccactccgccacgctctcgataaggccgccgcacgcggccgcacgcaccgacaagctggagccgccgcagcaggaggcggtgaaaccatcgccgaccaacggtcgcatccgctaccgtacgccctcggcagccgatctgctccccgctgacgatgtcgcggcggatgccgcggcagccacagtggtggccgcgaggatgcgccgctactcgggcgccggagcacggcagcagcagcaaacggaggcggtggccgaccgcgtgcaccggtaccgtcgggtgctgatggtgttgctctcgccggtactcctcatctcgttcgtgctccttctcatgccgcgcgcgccggcctccgcctcagggggtgtgctcctcgccgttggtggtcggaggtggggaccccgggccgtcgagggacgactgag

SEQ ID NO: 50361 - protein, 75 aa, Zea mays
  misc_feature: Ceres CLONE 1462832-F
MRRYSGAGARQQQQTEAVADRVHRYRRVLMVLLSPVLLISFVLLLMPRAPASASGGVLLAVGGRRWGPRAVEGRL

SEQ ID NO: 50362 - DNA, 654 bp, Zea mays
  misc_feature: Ceres CLONE 1462842-F
  misc_feature: Encodes the peptide sequence at SEQ ID NO. 50363
ggatcccccgggctgcaggaattcgcacgagaccattacctagaacatcctaatcgaaaaatgtggtcgcgctgagggggttctgctgctccagggcgcgcggggagtgcttcctcgtctacgacttcgtgcccaacggcagcctgtcgcagttcctcgacgttgacgtcgacgccgacgccgacaacgccggcggaggcagcggccgtgtcctccagtggtccacgaggatctccatcatcaagggcatcgccaaaggaattgagtatctgcacagcacaaggacgaacaagccggccctcgtccaccaaaacatctcagcggataaggtcctgctggactacgcgtacaggcccctcatctccgggtgcggcctgtacaagctcctcgtggacgacctcgtcttctcgacgctcaaagccagcgccgccatggggtacctggcgccggagtacaccaccgtgggccgcttctcggagaagagcgacgtgtacgcgttcggggtcatcgtgctccaagtgctccccggttagagcaaggtgacaacgacccatgcgcagctgccggacaaggacgtcgatgagctcgtccacggcaacctgcagggggataattactcggcggccgaggccgcccagctggcgataatcggct

SEQ ID NO: 50363 - protein, 33 aa, Zea mays
  misc_feature: Ceres CLONE 1462842-F
  misc_feature: SWISSPROT Homolog: EC 2.7.11.1 Non-specific serine/threonine protein kinase
MGYLAPEYTTVGRFSEKSDVYAFGVIVLQVLPG

SEQ ID NO: 50364 - DNA, 724 bp, Zea mays
  misc_feature: Ceres CLONE 1462847-F
  misc_feature: Encodes the peptide sequence at SEQ ID NO. 50365
  misc_feature (687)..(687): n is a, c, t, g, unknown, or other
  misc_feature (724)..(724): n is a, c, t, g, unknown, or other
tggagctccccgcggtggcggccgctctagaactagtggatcccccgggctgcaggaattcgcacgagaccattacctagaacatcctaatcgaaaagttattccatcaccagttcaccaccgtcttcctcaactcttcctctcctctctcttctgcaccatctggtgtgtgtgcgcgttactcgccgcgtcgatcgaagaaagaggcgcacgggagcgagctacgcgaagcaaggcaatggcgaagggcgggctgtccaagcttcggtgcatgatcaagaggtggcactcgtccagccgcatcgcccgcgcgccgccgtctcccggccccggtgaggacgaccgctgcgccgcgcgcggcgcgtcgttccacggcgcggacgaggtgcccgagggcctgcacccggtgtacgtcggcaagtcgcgccgccggtacctcgtcgccgaggagctggtgggccacccgctgttccagaccctcttcgaccgcatcggcggcggcggcaccggggcagcggcggcgggtaccgtcgtcggctgcgaggtcgtgctgttcgagcacctgctgtggatgctggagaacgcggacccgccgccggagtccctcgacgagctcgtcgagtactacgcgtgctgagacagagtcatagagcctcgccccacgccgccagctcggccgtgacgcancgcggcccgacggtggtggaagtggaatggaagctan

SEQ ID NO: 50365 - protein, 132 aa, Zea mays
  misc_feature: Ceres CLONE 1462847-F
  misc_feature (12)..(114): Pfam Name: Auxin_inducible Pfam Description: Auxin responsive protein
MAKGGLSKLRCMIKRWHSSSRIARAPPSPGPGEDDRCAARGASFHGADEVPEGLHPVYVGKSRRRYLVAEELVGHPLFQTLFDRIGGGGTGAAAAGTVVGCEVVLFEHLLWMLENADPPPESLDELVEYYAC

SEQ ID NO: 50366 - DNA, 772 bp, Zea mays
  misc_feature: Ceres CLONE 1462851-F
  misc_feature: Encodes the peptide sequence at SEQ ID NO. 50367
  misc_feature (736)..(736): n is a, c, t, g, unknown, or other
tggagctccccgcggtggcggccgctctagaactagtggatcccccgggctgcaggaattcgcacgagaccattacctagaacatcctaatcgaaaacttccgctcgccgacacggcgcaaatccccacaaccccaggccggcggacgggcggactcccacccacctcctcgcgacgacgtgctcggctcgcttccagccacctggctcgccgcccgcctcggaaaccccgccgcgagatcccgtcccccgggccgggaggatggaggtgaaaacggtaaaagttagcaacctttcattaaatgttttgaaaagagagctcacagagttctttagtttctctggggatatagaatatgttgaaatgtaaagtgaatctgaatggtcacagcttgcttatgtcacatccccccactcacagggagcagacactgctgttcttctctcgggggcaacaattgttgatcgtgctgtcattataactcctgctgagaactatcagctgcctcctgaagcacacaaacaattatcgggagcaaacgtctctactgaatcagcagtcaggaaggcagaagatgttgtcagcagcatggtgggcaagggatttgtgctcagcaaagatgctctcaacttggcaagatccttcgacgagcgtcacaatatcctatccaatgctactgccactgttgcatctctagaccgccagtatggcctgagtgaaaaggacaatctgggangggccattgttgtcagcaaggtcaaggaaggggata

SEQ ID NO: 50367 - protein, 61 aa, Zea mays
  misc_feature: Ceres CLONE 1462851-F
  misc_feature (50)..(50): Xaa is any aa, unknown, or other
MVGKGFVLSKDALNLARSFDERHNILSNATATVASLDRQYGLSEKDNLGXAIVVSKVKEGD

SEQ ID NO: 50368 - DNA, 703 bp, Zea mays
  misc_feature: Ceres CLONE 1462853-F
  misc_feature: Encodes the peptide sequence at SEQ ID NO. 50369
ggatcccccgggctgcaggaattcgcacgagaccattacctagaacatcctaatcgaaaacgttgcaatgctgttactcttatggttctaaatttggccgccactccaattgaactaagcttgatcgtccctttcttgcgtttgggtgaagccgtcactggcagcgggcacttccccttgacagccgacgcattgaagaatgttctcaccggtcatgcctcaaaggatgtgctaatgagcatcgtccatgcgatgctgggttggcttattgctgcaccaattgtactggtcgtgctgtacgccgtttcgttcccttgtttcaaggtcctggacaacaggtttggtggcattccttcgagccccaggaccccaatcaaagcggtgtagccagtgcctggccggatcctctgcagttacatccgtggacatagctgcagaatgtgtcgctgacatccggggccggccgtggcgtggcccctaacgtcagtgactcgacgtaattgcaaaggaaacggttttcagccaggtgagggatgcctgaaatgcccctgggaattgtgcgccccaaggttctttgagaagccctccggatttgaaaatggttttccggcttccttgtttttttcggcccctcccccggccctcgcgggaataaacttttgataactctttgaagggcttttgtttcccctctggatgatgg

SEQ ID NO: 50369 - protein, 128 aa, Zea mays
  misc_feature: Ceres CLONE 1462853-F
GSPGLQEFARDHYLEHPNRKRCNAVTLMVLNLAATPIELSLIVPFLRLGEAVTGSGHFPLTADALKNVLTGHASKDVLMSIVHAMLGWLIAAPIVLVVLYAVSFPCFKVLDNRFGGIPSSPRTPIKAV

SEQ ID NO: 50370 - DNA, 781 bp, Zea mays
  misc_feature: Ceres CLONE 1462854-F
  misc_feature: Encodes the peptide sequence at SEQ ID NO. 50371
  misc_feature (781)..(781): n is a, c, t, g, unknown, or other
ttttttttccccgaccgccacccccgaaaaacaaaaccccccctaaaaaaaaaaactggtactccccgcggtggcggccgctctataactagtggatcccccgggctgcaggaattcgcacgagaccattacctagaacatcctaatcgaaaatcgcccctcctaccgcacccggaagctaggtttagccgccgccttctcccttttcgccgcggcggccgcaagaaccgacttctccccggagaagccccaagcaagcgacccccgcttcctctccgcgccagatctttgtttatgagctcgaaggagaagcccactcttggaggcacgcggattaagacccgcaagcggaatattgcagctcctttggaccctgcatcattcgctgatgcaattgttcagatctatttggataatggtggagacctggaacttgtccccaaaagtatcaagtcttcagaccccaccttctcacgttacggtgacacctttttcgaggcggttttctgttgcagggcgcactcagccaggctctgtaaaacctggaaaaggagaccgccacccttattcggggttatattgtgcgtcacagcaagataggaattttgccttatagaagatgtatttcccgaaaaaatttgccccgcaaagcctttccaaaagaaagaacccgaaaaaaagttatagggagaagtcgtggggccaacccggggacgctgttgggggtagatgccgggtggggaagatgtggccgcataatgcaaagtgcctgtgggatttn

SEQ ID NO: 50371 - protein, 101 aa, Zea mays
  misc_feature: Ceres CLONE 1462854-F
MSSKEKPTLGGTRIKTRKRNIAAPLDPASFADAIVQIYLDNGGDLELVPKSIKSSDPTFSRYGDTFFEAVFCCRAHSARLCKTWKRRPPPLFGVILCVTAR

SEQ ID NO: 50372 - DNA, 675 bp, Zea mays
  misc_feature: Ceres CLONE 1462856-F
  misc_feature (577)..(577): n is a, c, t, g, unknown, or other
  misc_feature (586)..(586): n is a, c, t, g, unknown, or other
ggagctccccgcggtggcggccgctctagaactagtggatcccccgggctgcaggaattcgcacgagaccattacctagaacatcctaatcgaaattcctcgtagggcacctctggcgggttgttgcgctgcctgatatctccaccgcccacggcctcgccttgtcccaactacaaaagcgaacccaatccctcttgactcctctcatccgcctcgtctaaccaccaccacgagggagagttaaagtcgccagtacagaagagtgaaggggagagggttgctgggtccgattcggtgggctcatcgccgtcgggtccacgaattggtgcctaggagtctcgcgtgcttcggggacataatcgatggtctcgctgcggtgggttggtggctggagacctcagaattcgtcgtcatagtgcgagctcctccgcgtgtgcaccgtgcgccgtggccaggggtgtctgcgctgcaattgccagcatacaagatgacgatggtatgaagactatctcatttccaaaaagctttgtgcagaacaactaatgcaatgcaagtgtttggggctttttggttgatnaaactgccngaagctttttgggatttttgaaaaaagccagcccgggcctccgggtggaaccttaaaagtgggggggtcaaaacggaaaaaaccgggcg

SEQ ID NO: 50373 - DNA, 818 bp, Zea mays
  misc_feature: Ceres CLONE 1462864-F
  misc_feature: Encodes the peptide sequence at SEQ ID NO. 50374
  misc_feature (8)..(8): n is a, c, t, g, unknown, or other
  misc_feature (11)..(11): n is a, c, t, g, unknown, or other
  misc_feature (23)..(23): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (774)..(774): n is a, c, t, g, unknown, or other
tgtcggcncgnctatcccttccnctatatttgctgggggctttnnnttnnccaagctggagctccccgcggtggcggccgctctatactagtggatcccccgggctgcaggaattcgcacgagaccattacctagaacatcctaatcgaaaaaaaaggttctcttcgatccggcctctccgggccacccagtcccacacaaggatggatcgctatactctttgatcactgtactagtcacacgattggctacacgacacgagctcagagctctcaggtttcccaacgccggctgctggccaatggcgcagcaccacggcagccactccctggaggtcggcggcgtcgagttcgacgacgacggccgcgccgcgcgcaccggcaacctatggacctgcttcgcgcacatcatcaccgccgtgatcggctagcacatgctggcgctctcctggagcgtcacgcacctaccccagggtggggcggcacccgtcccccatgcctctggattcagccttcggccacctaaattctccggcctttcccccttgtgccccattgtcttccaggggccccctgggattcctaattgaatgggcttcccctgaaaaccgcccaaaagaaacttccccctttacctgggattccccttctaggaaaacccccctgggggggaaaaaagccccccctgtgttttttttggggcctttgttccgagtcccctctaaacatggtgccgggaacccgtaaaatcgccttataaaccatttctacaacnggtggaacctttgcctttcaggcgccgatcactgagggcgccaa

SEQ ID NO: 50374 - protein, 42 aa, Zea mays
  misc_feature: Ceres CLONE 1462864-F
MAQHHGSHSLEVGGVEFDDDGRAARTGNLWTCFAHIITAVIG

SEQ ID NO: 50375 - DNA, 691 bp, Zea mays
  misc_feature: Ceres CLONE 1462866-F
  misc_feature: Encodes the peptide sequence at SEQ ID NO. 50376
  misc_feature (556)..(556): n is a, c, t, g, unknown, or other
ggagctccccgcggtggcggccgctctagaactagtggatcccccgggctgcaggaattcgcacgagaccattacctagaacatcctaatcgaaaaacacacgcgcgcgaacacgaacagggacacgagacagcggcggccatggcgagaggcggcggcgatcggagtcgggaggatgaccccttctccgacggcggcaccaccggaaccgactcggacgagtcctctccgcgtggggtgggggcccgcggccccggctccacctccaacccgatcctgacacgcctcgcggtgtcgcggaacccgagcccgctggctgcggccaccgcggccccaggggtctgcctcctccgcttcgcctgggagtccgccgcgggctccctcgtcggcgccgccgttggctacggtaaaggtttggttacgatgaaggggattaaaggctcatttgctgatgctgcgtcatctgctaagatatttgctgttcttgctggtgttcaaagtttagtagcctgctctttgagaaaactacgtggaaaagatgatggaatcaatgcangagtcgcaagctgttgcactggccttgctctgagccttccaggtgccaccacaaacttctgattccaaacctggccggaccttggggactttcccttactccttggaaaacttaacaagccccacctggggctgc

SEQ ID NO: 50376 - protein, 158 aa, Zea mays
  misc_feature: Ceres CLONE 1462866-F
  misc_feature (61)..(158): Pfam Name: Tim17 Pfam Description: Tim17/Tim22/Tim23 family
  misc_feature (139)..(139): Xaa is any aa, unknown, or other
MARGGGDRSREDDPFSDGGTTGTDSDESSPRGVGARGPGSTSNPILTRLAVSRNPSPLAAATAAPGVCLLRFAWESAAGSLVGAAVGYGKGLVTMKGIKGSFADAASSAKIFAVLAGVQSLVACSLRKLRGKDDGINAXVASCCTGLALSLPGATTNF

SEQ ID NO: 50377 - DNA, 683 bp, Zea mays
  misc_feature: Ceres CLONE 1462869-F
  misc_feature: Encodes the peptide sequence at SEQ ID NO. 50378
  misc_feature (397)..(397): n is a, c, t, g, unknown, or other
  misc_feature (475)..(475): n is a, c, t, g, unknown, or other
atagctggagctccccgcggtggcggccgctctagaactagtggatcccccgggctgcaggaattcgcacgagaccattacctagaacatcctaatcccccctgccccaagctctccctcacctctcacagccacgtccacgccgaccactggagcgtcgcttcgtcgccgtccgcggaagctcgccggagccctcctcggtcgcgtcctccccgtgccgagcccctgcctcaacgaagcagcacccatgccgccattccccgtccgagcctcgccccgcgaagcccctgtcgatcgtgtcatctgttcgtcgcgagaagctgattgtgtggtagaagaaccgaattcgtttgaggacgacgcgcaagacacttttgagcaaggttgcctttggtgncatctatgctcaggtaaagaagaaggcgtcgaggcggatctccaggagttccaggactttgacaagttcgaggattangctagcgacctcccccagttagttgcctgtggtggggttgtttacgttggctacgtttccattcgggggactttgatttaaattagggaaagggctctagccgggaaattaataacttaccccttttttgaaatccaaagcttggtgtttgatggagccttttgggaaaaaaaaaaaaaaaacttttccgtacccccaacccgggggg

SEQ ID NO: 50378 - protein, 102 aa, Zea mays
  misc_feature: Ceres CLONE 1462869-F
  misc_feature (50)..(50): Xaa is any aa, unknown, or other
  misc_feature (76)..(76): Xaa is any aa, unknown, or other
MPPFPVRASPREAPVDRVICSSREADCVVEEPNSFEDDAQDTFEQGCLWXHLCSGKEEGVEADLQEFQDFDKFEDXASDLPQLVACGGVVYVGYVSIRGTLI

SEQ ID NO: 50379 - DNA, 750 bp, Zea mays
  misc_feature: Ceres CLONE 1462873-F
  misc_feature: Encodes the peptide sequence at SEQ ID NO. 50380
  misc_feature (340)..(340): n is a, c, t, g, unknown, or other
  misc_feature (401)..(401): n is a, c, t, g, unknown, or other
agtggatcccccgggctgcaggaattcgcacgagaccattacctagaacatcctaatcgaaaattcatatattggtggtttgaagtccattgaggagttccttcatattgagattcctcctaatgctccaccggcgatcgatgaacagatgctagaggatggtggcaagaaaccaagcgaagccatccaggaaagccgggacagggaggagcaaatgcccgacgtgaacgactcaggaggaagcaaggcagccagcgccagcacgcagaacgacaagttgtacaccgccgagggcgtactctaccctcgctagagcaaagcatataagaaacggagcaanccaagcaggcccagcgcgctgaacgaaatggactttggacccccccccacgcggattatcnaatggaggacggtggcagcgagcctgcacacccggatgatgaaaatggccgagatggatccgaggataatgaaccaatgaccggtgtcaatgatgcatgaattggcatgtcaagtgccattttgcccaaaatgatttgtcccaatgggggcttgggcaaattaacccccaaccagttttgtgcttacatatgtttcttctatcgaaaatatgaccatttgtgttttctcaaggataactatgaaaagagttctatcgaatcccgctcccacctccaagggggggggccccgggaaaccccaatttctccctcttattatcgagctcctcattaacgccggcgtcttccg

SEQ ID NO: 50380 - protein, 54 aa, Zea mays
  misc_feature: Ceres CLONE 1462873-F
MLEDGGKKPSEAIQESRDREEQMPDVNDSGGSKAASASTQNDKLYTAEGVLYPR

SEQ ID NO: 50381 - DNA, 675 bp, Zea mays
  misc_feature: Ceres CLONE 1462874-F
  misc_feature: Translation starting site: 181
  misc_feature: SWISSPROT Homolog: EC 3.6.3.14 H(+)-transporting two-sector ATPase
  misc_feature (347)..(347): n is a, c, t, g, unknown, or other
  misc_feature (387)..(387): n is a, c, t, g, unknown, or other
tggagctccccgcggtggcggccgctctagaactagtggatcccccgggctgcaggaattcgcacgagaccattacctggaacatcctaatcgaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccagggggngcccgccaccccgccgccagccaccgggaagacggcggcngcaagatcaccgacgagttcaccggcgccgcgccatcggccaggtgtgccaggtgatcggcggcgtcctcaacgtgcgctacgatgagggccctccgcccttcctcacggggcttgaggggttcaaaaacaaattccccctcggggtccaagggggcccaaccccctggcaaaaaaatgggggcccccctcccttttggacggcccggaaggggttctccccggggccaaggggttcctcaaaaaggggtccccccttaacccggggcttggtggggggggcctcccc

SEQ ID NO: 50382 - DNA, 748 bp, Zea mays
  misc_feature: Ceres CLONE 1462876-F
  misc_feature: Encodes the peptide sequence at SEQ ID NO. 50383
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (748)..(748): n is a, c, t, g, unknown, or other
ggtgtttgcctttcctgctcgtctcttttatcttnnnnnnngtttnnnnnnncaaaactggagctccccgcggtggcggccgctctataactagtggatcccccgggctgcaggaattcgcacgagaccattacctagaacatcctaatcgaaaaacttcctcttctgcccctccaacctctcctcttcctctggtctctggacaaccaagccagagaggagcagccagcgacaacctcctctcctctcctcccctcttattccgcgcccagcagcgaggcatggtggagaaggcgaggaccatggcgcgcaggctggagatcccccagtggaaggccgacggcctgccgtcgccgacgagcccgctggaccgcgcgtcggcgtcgccccgtgggtggcgccaccgcgacgccgtaggaggaggcgtggggctcgggatcctggcggcgctcgaggccgagggcccgccccagcccgcgccgagggggtccatcccgcggcgcgcggcgcggctggaggtgtcggagctcgggtgcaccgggcgctgcgccaccagcctgtgcggcggcgtcggcccggcccccgcccggcccggaggcggctcggcgttccgcgccccgtagttcctgtcgtgctgcaacatgtcccggcgggccctcgacgggagggatatcttcattttaccgcgggggaaaaagcccttctgcaaacagggaatgcccggtaccacccccatgggtgagcaaan

SEQ ID NO: 50383 - protein, 113 aa, Zea mays
  misc_feature: Ceres CLONE 1462876-F
MVEKARTMARRLEIPQWKADGLPSPTSPLDRASASPRGWRHRDAVGGGVGLGILAALEAEGPPQPAPRGSIPRRAARLEVSELGCTGRCATSLCGGVGPAPARPGGGSAFRAP

SEQ ID NO: 50384 - DNA, 676 bp, Zea mays
  misc_feature: Ceres CLONE 1462877-F
  misc_feature: Encodes the peptide sequence at SEQ ID NO. 50385
ggatcccccgggctgcaggaattcgcacgagaccattacctagaacatcctaatcgaaaagtgattagcaaaaccggccgtttggttggggacagaccacggctaccgaacagccgggttccacgaccaacccaaccgcgggggaaaggggaaaaccccacggcccggagcaacccttgggaaagtcgtcgacgccgttgagttcgaggcgaccggcggctcgccgccccgccacagcgccgctgcgatttcttctgatccctgtggctcagcgcggagggttaaatggcaaatagagcaagatggatgatgaagtacgaaaagggtcttgttgatatacttcatgagaacaatacttcacattatcgtacccaaaacggttggagaacggaggggtggaggaaaatcgttagggatttcaatgtaaggtaccccgaagcaaagtttagtaaaatgcaaatccaggaacatgagactcaattgaagaaagattataagttgataaaatctatcctccaacgtggttggtggtctctggggacagagtgcatccttggttaaaacaacaaaatgaattttgggaatgaatttaattcaaggaatttgccccagggccgcggaggccccccaaggaaaaaactttccctttggcccgacctccctataaactggtttt

SEQ ID NO: 50385 - protein, 91 aa, Zea mays
  misc_feature: Ceres CLONE 1462877-F
MANRARWMMKYEKGLVDILHENNTSHYRTQNGWRTEGWRKIVRDFNVRYPEAKFSKMQIQEHETQLKKDYKLIKSILQRGWWSLGTECILG

SEQ ID NO: 50386 - DNA, 693 bp, Zea mays
  misc_feature: Ceres CLONE 1462878-F
  misc_feature: Encodes the peptide sequence at SEQ ID NO. 50387
aagctggagctccccgcggtggcggccgctctagaactagtggatcccccgggctgcaggaattcgcacgagaccattacctagaacatcctaatcgaaaagtgcgtacactccacacctcgcctccgtgcttccgtctcgcacttccggacataaagtgcgaccatggccatggcggcgctgcgggaaacctcccgctgtttggcgtccagggggagatctgcggcctggcgacccgtgctcctcgcgcagtcccgcggcatcacttacaagctcttcgtcggaggtttatcacagtttgcgacggaagcaagcctagcagaagcattctcacgttacggacaagtaatagaagctaccgtcgtcagggataaggtgaccgacgtaccgaaaggattcggcttcgtgaagtttgcttccccggaggaagccaataacgcgagggaagagatgaacggcaaggcattgaacggtcgggtcatatacgtggacattgcaaaggccagacaggaccgtgctgcagatgccctcccaatagcgagaggccctcctaagcctatcaagcacgactgatagaggagggctttgtgtgccctcccaataagcgagagtccctcctaaaacaatttaccacggcttgttcaagaaagccctgggggggaattccccccccgccccacctggaaacaaatt

SEQ ID NO: 50387 - protein, 135 aa, Zea mays
  misc_feature: Ceres CLONE 1462878-F
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAMAALRETSRCLASRGRSAAWRPVLLAQSRGITYKLFVGGLSQFATEASLAEAFSRYGQVIEATVVRDKVTDVPKGFGFVKFASPEEANNAREEMNGKALNGRVIYVDIAKARQDRAADALPIARGPPKPIKHD

SEQ ID NO: 50388 - DNA, 755 bp, Zea mays
  misc_feature: Ceres CLONE 1462880-F
  misc_feature: Encodes the peptide sequence at SEQ ID NO. 50389
  misc_feature (363)..(363): n is a, c, t, g, unknown, or other
  misc_feature (456)..(456): n is a, c, t, g, unknown, or other
ccccgcggtggcggccgctctagaactagtggatcccccgggctgcaggaattcgctcgagaccattacctagaacatcctaatcgaaaaatcgagccgccgccgccgccgccgcagttgtcttcggtcttccgtgctcaccttcgagagatcaagttgctgctgcggtagtccccaaccatcatcatgcagaacgaggagggtaagacggtggacctctacgtccccaggaagtgctcggccacgaataggatcatcactgccaaggatcatgcctctgtccagatcaacattggccacttggatgcgaatggcctgtacgatggtcacttcaccacgtttgctctctctgggtttgtgggngcccagggtgatgctgacagttcgttggataggatgccccacgttgttaaggctgaaatcaagcagtaggtctttgcacgtacttccaccggnaatggactcttgagggatactgctctagctaatgctttagctgggggggggggagtgattctgatgtttggctgttcgtttgttggatgaccaggatttagattgtctgggcatgcttggggcgcagcaatctggggcacgatgaatatcattttgtcaccctattcttctcacaaaaaaaaaaaataaaaagcttatcgataccgttcaacctcgaggggggccccggtacccatttccgcctctatctgagttcttatttaccggcgctccctgggccgccgttttacccctccggg

SEQ ID NO: 50389 - protein, 81 aa, Zea mays
  misc_feature: Ceres CLONE 1462880-F
  misc_feature (1)..(81): Pfam Name: Ribosomal_S21e Pfam Description: Ribosomal protein S21e
MQNEEGKTVDLYVPRKCSATNRIITAKDHASVQINIGHLDANGLYDGHFTTFALSGFVGAQGDADSSLDRMPHVVKAEIKQ

SEQ ID NO: 50390 - DNA, 691 bp, Zea mays
  misc_feature: Ceres CLONE 1462881-F
  misc_feature: SWISSPROT Homolog: EC 2.3.1.16 Acetyl-CoA C-acyltransferase
  misc_feature (546)..(546): n is a, c, t, g, unknown, or other
  misc_feature (550)..(550): n is a, c, t, g, unknown, or other
  misc_feature (600)..(600): n is a, c, t, g, unknown, or other
  misc_feature (605)..(605): n is a, c, t, g, unknown, or other
  misc_feature (612)..(612): n is a, c, t, g, unknown, or other
  misc_feature (613)..(613): n is a, c, t, g, unknown, or other
  misc_feature (648)..(648): n is a, c, t, g, unknown, or other
agctaaccgcggtggcggccgctctagaactagtggatcccccgggctgcaggaattcgcacgagaccattacctagaacatcctaatcgaaaaacctttttctcaaccccgtctctctcgcgtctgtctgttccttggagccgtccgccgccagccgccccctccgcccacgccactggccgcccccgccgcccccgtccgccgcggacgccccagccccttccatcgtggccgcggccgccctcggccccgtccgccgtggccgcccctgcctcggcccgcctaccagaggtcctcctccttcggggacgatgtcgtcgtcgtcgcataagcgcattccaaaaagcgcatgattgtcttctgcccatgggaattacttctaaaaatgttgcccatcgatatggtgtaaccaggcaagagcaagatcaggccgccgcaattccagtcaagtgagtgatggtgctggagctgttcttctcatgaaaagatctgtggctatgaagaaagggctgtccattcttggtgttttcagggagctttgcccnctgnctggagggaatccagttataatgggatttgggcctgggtgttgccctatnctggngggtggnnaaaggcttgccccccctttgaatttgaaaattttngaatctgtgtaaacagaaaagaaccccttttccccgccacatt

SEQ ID NO: 50391 - DNA, 691 bp, Zea mays
  misc_feature: Ceres CLONE 1462885-F
  misc_feature: Encodes the peptide sequence at SEQ ID NO. 50392
ggagctccccgcggtggcggccgctctagaactagtggatcccccgggctgcaggaattcgcacgagaccattacctagaacatcctaatcgaaaaaaggaaaccctaggccgctacgcccttggccccttctctctcttcgtcgcgccgccgtagcacgactccgactcggccatggcgacacccccagctctcctattcccttcgccctcttcggcatcttctccgccgtcatccgcgcaggtagaggcggtggtcctcttcaacgtctgcgacagctacgtgcggcgaccggaccaggcagaccgtgtcatcggcaccctccttggatccctcctccccgatggcaccgtccacgtccgcaactcctacgtggtcccccacagcgagtcggccgaccaggtcgccatcgacatcgactaccaccataacatgtacgcctcgcaccagaaggtgaaccccaaggaagtcatcgtcggatggttctcgactggatttggtgtttctgggggaagtacgcttatccatgagttctattcaagggaagtacaaagccccatccatcttacagtcaacaccggttcactagggggggaagtttcatcaaaggcttaggtctcaatcaaacctggccccccgggaaaaggaaccccgctggccaatttcgggaaaacccctgggaccttaggaa

SEQ ID NO: 50392 - protein, 146 aa, Zea mays
  misc_feature: Ceres CLONE 1462885-F
  misc_feature (17)..(127): Pfam Name: Mov34 Pfam Description: Mov34/MPN/PAD-1 family
MATPPALLFPSPSSASSPPSSAQVEAVVLFNVCDSYVRRPDQADRVIGTLLGSLLPDGTVHVRNSYVVPHSESADQVAIDIDYHHNMYASHQKVNPKEVIVGWFSTGFGVSGGSTLIHEFYSREVQSPIHLTVNTGSLGGEVSSKA

SEQ ID NO: 50393 - DNA, 774 bp, Zea mays
  misc_feature: Ceres CLONE 1462889-F
  misc_feature: Encodes the peptide sequence at SEQ ID NO. 50394
ctggagctccccgcggtggcggccgctctttaactagtggatcccccgggctgcaggaattcgcacgagaccattacctagaacatcctaatcgaaaaagtaactagcagctagcacatcaaacaagtggcgacagacaaagatttgtgagggtgatccgcgctgagaagagatggctaagatcgccgcggcggcggcggcggcgctgtgcttcgcggccctggtggccgtggccgtctgccaaggcgaggtcgagcggcagaggctcagggacctgcagtgctggcaggaggtccaggagagcccgctcgacgcgtgccgccaggtcctcgaccggcagctaaccggcggcggcggcggtgcggcgttggcccgttccggtggggcaccgggctccggatgcggtgctccccccacctccaggacgtgagccgcgagtgccgctgcgccgccatccggagcatggtcaggggctacgaggaggccatgccgccgctggagaaaggctggtggccatgggggcggcagcagcagccgccgccgcagggaggaggaggaggacaggggggctactactacccctgcagccggccaggagagggatacggctacggtcagggtggccagcggcagatgtatccaccgtgtcgtcccgggccccccgggcggcgggcccaggatcggccgcgtgagggttaccaagggcccgggagtacgccgcggggtttgccgatgaatgtgccggctgtcggaacccccaggaatgcagcttct

SEQ ID NO: 50394 - protein, 125 aa, Zea mays
  misc_feature: Ceres CLONE 1462889-F
MRCSPHLQDVSRECRCAAIRSMVRGYEEAMPPLEKGWWPWGRQQQPPPQGGGGGQGGYYYPCSRPGEGYGYGQGGQRQMYPPCRPGPPGRRAQDRPREGYQGPGSTPRGLPMNVPAVGTPRNAAS

SEQ ID NO: 50395 - DNA, 695 bp, Zea mays
  misc_feature: Ceres CLONE 1462893-F
  misc_feature: Encodes the peptide sequence at SEQ ID NO. 50396
  misc_feature (600)..(600): n is a, c, t, g, unknown, or other
  misc_feature (608)..(608): n is a, c, t, g, unknown, or other
  misc_feature (616)..(616): n is a, c, t, g, unknown, or other
ggagctccccgcggtggcggccgctctagaactagtggatcccccgggctgcaggaattcgcacgagaccattacctagaacatcctaatcgaaaaatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgaacctttgagtgacatgctacatcggtcagcctgttcgtttggttcaatcccgnaccggctncaacaacntccaaaattggttttggcccccggggatacccccccaacacgccaaaaaccggattttaccccaaagcaaaagcccaaa

SEQ ID NO: 50396 - protein, 183 aa, Zea mays
  misc_feature: Ceres CLONE 1462893-F
  misc_feature (44)..(108): Pfam Name: Glutaredoxin Pfam Description: Glutaredoxin
  misc_feature: SWISSPROT Homolog: EC 1.11.1.15 Peroxiredoxin
  misc_feature (152)..(152): Xaa is any aa, unknown, or other
  misc_feature (157)..(157): Xaa is any aa, unknown, or other
MVALLGRRIGVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTVDSYESGKLARLLNIGVKDEPLSDMLHRSACSFGSIPXRLQQXPKLVLAPGDTPPTRQKPDFTPKQKPK

SEQ ID NO: 50397 - DNA, 849 bp, Zea mays
  misc_feature: Ceres CLONE 1462900-F
  misc_feature: Encodes the peptide sequence at SEQ ID NO. 50398
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
gttcgtttcccccccccccgtcttcttttatcggccgtctcacgctnnnntttcatagctggactccccgcggtggcggccgctctttaatagtggatcccccgggctgcaggaattcgcacgagaccattacctagaacatcctaatcgaaaaggggcgccgcctcgccgggtgcgtgctgctgtggcccttcttcggcggcgagcggaggacgcggtcggaggcggcctacctgggagacgcgttcctgacgctcccgctgtacgaccagatgtggcgcctggagctgccggcgggggcgacgcgggaccacccggtcgcgaacccggaggcgggcgagctcccgccgctgctcgtcgcggccggcgaccgcgatcatgctgatcgaccgaatcatggagtacttggcgcgggtgtgggtagttttttacttttaatagtcatcatccaccttcctcccacttgttttgtgttgcggggtacggctttccgcccatctttcgaaacccgcatggcccagtgctccccaatgaacttagtcccgcgtttgtgcgcgctggactcagcgcaacggactcgggcatgtttgtctggtattgggtgctcgcaacagccggattaacgccgataaaatataacggccatccccaccggagaattatttaccttaaacactttttttacgccactcccttttaagggtggcagccccttggagaattttttatttttttataattgtttacaaagcgacggggtgtttcgcccgcccctctcttagaacccttttccacggcgtccactttggccgtagtaccacctacaatattttttctcgccactgtgat

SEQ ID NO: 50398 - protein, 116 aa, Zea mays
  misc_feature: Ceres CLONE 1462900-F
MWRLELPAGATRDHPVANPEAGELPPLLVAAGDRDHADRPNHGVLGAGVGSFLLLIVIIHLPPTCFVLRGTAFRPSFETRMAQCSPMNLVPRLCALDSAQRTRACLSGIGCSQQPD

SEQ ID NO: 50399 - DNA, 677 bp, Zea mays
  misc_feature: Ceres CLONE 1462908-F
  misc_feature: Encodes the peptide sequence at SEQ ID NO. 50400
ggatcccccgggctgcaggaattcgcacgagaccattacctagaacatcctaatcgaaaagggacgagggaggggaaaagagagatggtggaggcatcgccggagtccggcgccgcggcgaccggaggtgcctctagtacggcggcggtgcggaaggggaagtcatgcaagggctgcctctactactcgtcagtgctcaagtcccgcggttacaacccaatctgcgttgggatcccccgctccatcccccaagttcctaactacgtggtggatgaacctaaggaggaggcgacggcgcaggggcatgacctcaggcggttcaggtacgggtgcgcgggttactccatgttcgtggacaacatggacggccagcgtggtgagagcgagggcaagacgttgttgccatattgcaggggcctcgagttattggtggacagcagattggtcgagagaaaacccatccgccaactgaacaagctccagcacatgttgcaaaggaggcttaccttccggttctttcctaatttaggacaacggagaccctccaaatttgcccaagccgggaattttttggaaacggttttaaaaaaaagccctttgagtatcggccccttctcggtggtcgcaaaaaatctttaacaaaaaccgctcaattatattctaaaaaaaacattttg

SEQ ID NO: 50400 - protein, 184 aa, Zea mays
  misc_feature: Ceres CLONE 1462908-F
MVEASPESGAAATGGASSTAAVRKGKSCKGCLYYSSVLKSRGYNPICVGIPRSIPQVPNYVVDEPKEEATAQGHDLRRFRYGCAGYSMFVDNMDGQRGESEGKTLLPYCRGLELLVDSRLVERKPIRQLNKLQHMLQRRLTFRFFPNLGQRRPSKFAQAGNFLETVLKKSPLSIGPFSVVAKNL

SEQ ID NO: 50401 - DNA, 655 bp, Zea mays
  misc_feature: Ceres CLONE 1462909-F
  misc_feature: Encodes the peptide sequence at SEQ ID NO. 50402
  misc_feature (267)..(267): n is a, c, t, g, unknown, or other
ggagctccccgcggtggcggccgctctagaactagtggatcccccgggctgcaggaattcgcacgagaccattacctagaacatcctaatcgaaaaaaaacccaacggccgaagctaagctcgagccgccgccgcgatgatcctccgtatccgcagccgcgacggcacggaccgcatcacggtcccagactcggcctcagtcaccgtcgccgacctgcagcgcctcatcgagtcgcacctcaccgtgcccgtcccgctccagcgccntctccctcgacccggccctcctgctccctaacccctccgccgttgtcccactcctcaccgactcggcggcgccgcttgcctcgctccgcctcgccaacggcgccttcgtctacctcgcatacccgcccgacgcgcgctcggcccgcccgccgccgcccaaggcactttccgccgctggctctttcggcaaaaagatgaccatggatgaccttatcgcgcgccagatccgcgtcacacgccaggagaacgcgctctgcgccgccgcctcttttgaccgcgatgcccgcaacgcgttccagctctacgtcggcgagttccctcggcttcggggtcaaagcgggggggtttttttttaagggccgcgtcaaacccaaaaaccaagggatgt

SEQ ID NO: 50402 - protein, 53 aa, Zea mays
  misc_feature: Ceres CLONE 1462909-F
MTMDDLIARQIRVTRQENALCAAASFDRDARNAFQLYVGEFPRLRGQSGGVFF

SEQ ID NO: 50403 - DNA, 800 bp, Zea mays
  misc_feature: Ceres CLONE 1462916-F
  misc_feature: Encodes the peptide sequence at SEQ ID NO. 50404
  misc_feature (39)..(39): n is a, c, t, g, unknown, or other
  misc_feature (48)..(48): n is a, c, t, g, unknown, or other
ggttggtctgcttacctcccttttcaactttgtgttcgncccccggtnaaaaacacaaaagtggaactcccccgcggtggcgcgccgctctataactattggatcccccgggctgcaggaattcgcacgagaccattacctacaaatcctaatcgaaaaattcccccacacctggatccctctggtcggaggccatggcgacggggaggctccgatcctcggcctccctccgcggggctctcctccgccacttatccgttggacccgcctcgacttccgcgcgccgatctcccgggtccgagatttccagggtcctcacctctattatatgaaggcattttgcaccgtccaggcctaattctcttgcatgacacgacaactctgccctcatggcctgtttgcccctccgtatacgatgctttctcataagatgatgtttcccaaagaaaccccaatccaactagccgcaagacaaacccacgcgtgtgtgagtggttggttgtggattccccacacgatggagccaaggatgtcttgccctggttattccccatgcccccctattcactcgacccactacagtaaaacaggaactctctctctccccgggaacaccctgctagccttttccgctgccatcctgtgcgatccactgaataatattttcctgtgaacttccgtcgtgactttgaaaggtggaccctcttcttagggatagccccgttgttaatttccaacggttctttttttgggtttacacaccccactatttaacaacatatcacagttccacaccctcg

SEQ ID NO: 50404 - protein, 45 aa, Zea mays
  misc_feature: Ceres CLONE 1462916-F
MATGRLRSSASLRGALLRHLSVGPASTSARRSPGSEISRVLTSII

SEQ ID NO: 50405 - DNA, 760 bp, Zea mays
  misc_feature: Ceres CLONE 1462917-F
  misc_feature: Encodes the peptide sequence at SEQ ID NO. 50406
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (367)..(367): n is a, c, t, g, unknown, or other
  misc_feature (760)..(760): n is a, c, t, g, unknown, or other
tccccgcggtggcggccgctctataactagtggatcccccgggctgcaggaattcgcacgagaccattacctagaacatcctaatcgaaaaatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgagggnnnangaggtctgattggatacatggcaacgccgagttgaactacccaagcttctttatcagtagcagagcatgctactctatgtacttttggaacctaacctattagacctgtcagtgttggatgtctggatctttgctttttggaaaaataccattttccctcgttcaaggatgccagcatattttctggtttaacggcacattactttatatttatgcccggttccataacgaaaaaaaaaaaaagctttatcataccgtccaacctccggggggggcccggaaccccattcctcctaaaggagaggcgaaattactccggttcactgggcctcgttttccaaacgcttggctggggaaaactctgggcttcccccaattttatccccctcgccn

SEQ ID NO: 50406 - protein, 69 aa, Zea mays
  misc_feature: Ceres CLONE 1462917-F
  misc_feature (2)..(69): Pfam Name: Ribosomal_L38e Pfam Description: Ribosomal L38e protein family
  misc_feature (66)..(66): Xaa is any aa, unknown, or other
  misc_feature (67)..(67): Xaa is any aa, unknown, or other
MPKQIHEIKDFLLTARRKDARSVKIKRSKDVVKFKVRCSKYLYTLCVFDAEKANKLKQSLPPGLRXXEV

SEQ ID NO: 50407 - DNA, 759 bp, Zea mays
  misc_feature: Ceres CLONE 1462924-F
  misc_feature: Encodes the peptide sequence at SEQ ID NO. 50408
ctccccgcggtggcggccgctctagaactagtggatcccccgggctgcaggaattcgcacgagaccattacctagaacatcctaatcgaaaactcgaaccccccaaaacccaagcccctgcgaccccgagataccaaagccagcagaagaagggatgcagcagccgatgcacatgcagccacaggcgccggcgataaccccagctgccggaatcagcacggagcagatccaaaagtatctggatgagaataagcagcttattttggctattttggaaaatcagaacctaggaaaattggcagaatgtgctcagtatcaatcacaacttcagaagaatctcttgtatctcgctgcaatcgcagatgctcaaccgcagactgctgtaagccgccctcagatggccccacctggtggatcacctggagaagggcagtacatgtcacaggtgcctatgttcccaccgaggacacctcttacaccccagcagatgcaggagcagcagcttcagcagcagcaggctcagttgctaaacttcagtggccaaatggttgctagaccaggcatggtcaacggcatggctcagtccatgcaagctcagctaccaccgggtgtgaacaacaggatgctggcggggtcgcctctgagcctcgggcactgagagccacagagccctggtggtgaccaatgtgaaagcgactaagccaagaagcctggaaaatttacgagctagccttttaggccgcgaaataggctggatac

SEQ ID NO: 50408 - protein, 167 aa, Zea mays
  misc_feature: Ceres CLONE 1462924-F
  misc_feature (17)..(84): Pfam Name: SSXT Pfam Description: SSXT protein (N-terminal region)
MQQPMHMQPQAPAITPAAGISTEQIQKYLDENKQLILAILENQNLGKLAECAQYQSQLQKNLLYLAAIADAQPQTAVSRPQMAPPGGSPGEGQYMSQVPMFPPRTPLTPQQMQEQQLQQQQAQLLNFSGQMVARPGMVNGMAQSMQAQLPPGVNNRMLAGSPLSLGH

SEQ ID NO: 50409 - DNA, 934 bp, Zea mays
  misc_feature: Ceres CLONE 1462926-F
  misc_feature (18)..(18): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (425)..(425): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (472)..(472): n is a, c, t, g, unknown, or other
  misc_feature (478)..(478): n is a, c, t, g, unknown, or other
  misc_feature (479)..(479): n is a, c, t, g, unknown, or other
  misc_feature (485)..(485): n is a, c, t, g, unknown, or other
  misc_feature (810)..(810): n is a, c, t, g, unknown, or other
catatgggaaaccaaaanacaacaannnnnnnnnnnnnnnnncaaaaacggagctccccgcggtggcggccgctctagaactagtggatcccccgggctgcaggaattcgcacgagaccattacctagaacatcctaatcgaaaaaaaaaatcgacccacccagccctcacatggatagaagccccactgcatcacgcaccacccaccgagcggcgacggaagaaggccaagccgcagggaacacatcccgcgagcgcaggcatggctgagtgggtgcacggccccctcaacctgtgactcatgcgcctgccgggggcaggggcggttcccgaacagacggcgccgcaggaacccacattgacagccaccggatccggaactacagagcgacccggcgtgagggagccgactctgtagggagagnannnnagcccctgattggaatttagaacaaaaagggaattttttctncccctnnctcttnaaaatggggtttggtcgtcggagtatatattgaaaaaactctcggtcggggaaaggggccgctctactgttaatatctctatagatcttagcaaacggaactatacttcggaggcgaggaagctggaggacctccgggaatcctatatcgagtctcgcgcgggtctcgcgactcctcggcaatttctcagtgtgtaggttggcgggagtagcatgtccgacttctacgatagaagagctgtctctattgcccatcgcattcgcccgaatctctttaacctcggtcaagggacccactcctctggtcgattggcacaggtcggganaagttgacaacgtactgcgcgtctgtcgactagtacatgttgacccgaacaagaacagaactctgcacttccccttcagggctcgcgtgtgctctaccttacgggtttgatgtgtgtgtcttgt

SEQ ID NO: 50410 - DNA, 684 bp, Zea mays
  misc_feature: Ceres CLONE 1462928-F
  misc_feature: Encodes the peptide sequence at SEQ ID NO. 50411
tggagctccccgcggtggcggccgctctagaactagtggatcccccgggctgcaggaattcgcacgagaccattacctagaacatcctaatcgaaaacttttatcagtagtagtcatcactgagtagactgcagagcaggagaagatgttcacttacgtgctcgcggccgccgccgtgcttatcgtgttcctctacctcatcggctgcgtcgcgcaccgctccttgcgagagctgcaaattcgccatggcgggagcggcggcctcctctatctgcagctcgggcgcaggcggactttggcggtgtcggacctgttcaggaaccacgacctcgccttcgcctcccgcccgcacagcgtgtcgttcgcgccatatggcaggagctggcgccggggcaagatcaccacggtccacctcctctcccagcgccgcgtggagtcgttcgcgctcgtgcgggccgccgaggtagcagggcttatcgcgtacacgccgcgccgcggaggcgggggaggccgtggagctcaaggacctcctgtaccgctacaccaacgcggtggtcactcgcgcggccaccggggccgccggggcaacagcaggatgtgctgccggacgcgccagcgaggtttgtgagatgggcgacgggccttgataagaagctcgccgacatggccgaggcgtgggacagg

SEQ ID NO: 50411 - protein, 160 aa, Zea mays
  misc_feature: Ceres CLONE 1462928-F
  misc_feature: SWISSPROT Homolog: EC 1.14.13.21 Flavonoid 3'-monooxygenase
MFTYVLAAAAVLIVFLYLIGCVAHRSLRELQIRHGGSGGLLYLQLGRRRTLAVSDLFRNHDLAFASRPHSVSFAPYGRSWRRGKITTVHLLSQRRVESFALVRAAEVAGLIAYTPRRGGGGGRGAQGPPVPLHQRGGHSRGHRGRRGNSRMCCRTRQRGL

SEQ ID NO: 50412 - DNA, 685 bp, Zea mays
  misc_feature: Ceres CLONE 1462932-F
  misc_feature: Encodes the peptide sequence at SEQ ID NO. 50413
  misc_feature (685)..(685): n is a, c, t, g, unknown, or other
ggatcccccgggctgcaggaattcgcacgagaccattacctagaacatcctaatcgaaaaccggccgcctcgtcttcaagggcggcgaagccgcctccatccacaagccaaagaagcacaagaagaataagaagcccgcgtcggacgccctcgccgacggcgacatcgaggccgcagccgcggccgcggagggtgctgaaggcggcggaggtgccggcagcggcactggcgacgactacaccatcgacgcggcgaagaagatgaagtacgaggaactcttccctgtggagtcgaagaagttcgggtatgaccccgacaacgccgcccgtgctgccgcccggaaccgcaccgtcgaggaagccctcgacgaccgcgtccgcaagaaggccgaccgctactgcaaatgaggttcactcattggtcattgctgttgtttgcagctgtattgctcagtgtattgaagatggcctctttggagaattatgatccttcccggcctgttgtttagtagtcaaagtgctagtcaagcattttccttaggcatatttgtaccttttaattcgcacaccttaggatttctttgcccatggttattcccgataaacttgttccgggcctcctttgggtttgattaagaaaaatactacccgccctggaagattgtttatttttgggagggcctggn

SEQ ID NO: 50413 - protein, 48 aa, Zea mays
  misc_feature: Ceres CLONE 1462932-F
MKYEELFPVESKKFGYDPDNAARAAARNRTVEEALDDRVRKKADRYCK

SEQ ID NO: 50414 - DNA, 693 bp, Zea mays
  misc_feature: Ceres CLONE 1462940-F
  misc_feature (230)..(230): n is a, c, t, g, unknown, or other
ggagctccccgcggtggcggccgctctatatactagtggatcccccgggctgcaggaattcgcacgagaccattacctagaacatcctaatcgaaaaatatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttncggccgcaagaagacggctgtggcccggtcgccctacccccaacccgggggggcgggtttgtttttaagggtgaaaaggcggtccccaaattggggattcttctatgggggggggaaaaaggcccccccccaaagggcttttaaaaaaccctctcccttgggggtggggggggggtggtccggtacttggggaacccctcaataagaacacccccccccccacaaccggggggaaaaaaatcgaaaaaaatttctcctctttcctgagaggggcttctcagagggggggttcccctcccccttcccaaaaaaattgtcctctccaaatcccgcccccacaaaagggggggtgtcgcttatttctcccctgagtaagaaaaatcgctttttttttttccttcctccaaacaccagggttgtttattaaaaaaaaaaaaataccgctggggctccccccccgccg

SEQ ID NO: 50415 - DNA, 700 bp, Zea mays
  misc_feature: Ceres CLONE 1462944-F
  misc_feature: Encodes the peptide sequence at SEQ ID NO. 50416
aagctggagctccccgcggtggcggccgctctagaactagtggatcccccgggctgcaggaattcgcacgagaccattacctagaacatcctaatcgaaaaaacacaacccaccttcacatcaagcagtacaccgccgtgtccccgatccagccacacgagtcgacactcgacacaggcccgcgatccgctcccctttcttccttccccggattcgcggcgatctagccggcggcgggcggcgcagcgatggcggggcaaaaccagcggctcaacgtcgtgccgacggtgacgatgctcggcgtcatgaaggcgcggctcgtcggcgccacccgcggccacgcgctgttgaagaagaagtccgacgcgctcacgggtcagttccgcgccatcctcaagagatcgtagccgccaagggagtcatgggcgagacgatgcgcgcctcctccttctcctcgcgaaggcaagtatgcgccgggggaggggtccgtcagtcgtcctccagtcatccgggccgcctcgtcccggtcaaacccaccagaaaatgccccggggtaaattcccaagtttaatcaatttgtcaacccccccggggatcgggggggccccaaagggttccaaaactttaggggtcccccccggggggggaaaagggccccccctcgccccccccccaaaaagagcaataggggggtctccaa

SEQ ID NO: 50416 - protein, 52 aa, Zea mays
  misc_feature: Ceres CLONE 1462944-F
  misc_feature: SWISSPROT Homolog: EC 3.6.3.14 H(+)-transporting two-sector ATPase
MAGQNQRLNVVPTVTMLGVMKARLVGATRGHALLKKKSDALTGQFRAILKRS

SEQ ID NO: 50417 - DNA, 697 bp, Zea mays
  misc_feature: Ceres CLONE 1462945-F
  misc_feature: Encodes the peptide sequence at SEQ ID NO. 50418
aagctggagctccccgcggtggcggccgctctagaactagtggatcccccgggctgcaggaattcgcacgagaccattacctagaacatcctaatcgaaaagctcttgctgtcctctgtgctatccgctagggtttatctgctcgaggaatggcgtcggtgcaggtctccggcgcgggggtcggtgccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgaggagaagacaactggtggaatcttgctccctacgactgctcagtccagacctcaaggtggcgaggtagttgctgttggagaagaaagattattgggataagaaagtgaagtcagcattcaggttgaagctcaagttgtgtattcctaatacgctgggaaccgaggccccgttaaacgataccaccttctggttctcaaagaggaagaacgtataggtttcctagaaacctgaagaccggaaaaaatttgagccccttgaaacaaccggtttctaatccagggtggttaaacctaaaaaaaaaaccccaggaggcc

SEQ ID NO: 50418 - protein, 110 aa, Zea mays
  misc_feature: Ceres CLONE 1462945-F
  misc_feature (62)..(109): Pfam Name: Cpn10 Pfam Description: Chaperonin 10 Kd subunit
MASVQVSGAGVGAAAFSVKGKASTGALRLRSTLTFGEVCPARRAFRGLVVRAATVVAPKYTTLKPLADRVLVKINSSEEKTTGGILLPTTAQSRPQGGEVVAVGEERLLG

SEQ ID NO: 50419 - DNA, 715 bp, Zea mays
  misc_feature: Ceres CLONE 1462947-F
  misc_feature: Encodes the peptide sequence at SEQ ID NO. 50420
  misc_feature (715)..(715): n is a, c, t, g, unknown, or other
aagctggagctccccgcggtggcggccgctctagaactagtggatcccccgggctgcaggaattcgcacgagaccattacctagaacatcctaatcgaaaaaactcgcagatggaagcccgaatacatcgaactgcaaccgctcgacgtggggtagaatataatctggtgcgctccccccgcgaacaacttcctgcttgcacgcaagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgtaaggttaatcccaattctgaagtcatgggtgcgcttccagtcgcagcgtctttagctaacaagctcgcatacatataggcaacttggaatgagcttatgtattacggatatggtttgtggggcaaactgcccatgaatattgacctccttgcatatattgacatgtgacaaggatcacn

SEQ ID NO: 50420 - protein, 73 aa, Zea mays; identical to SEQ ID NO: 39404
  misc_feature: Ceres CLONE 1462947-F

SEQ ID NO: 50421 - DNA, 820 bp, Zea mays
  misc_feature: Ceres CLONE 1462949-F
  misc_feature (37)..(37): n is a, c, t, g, unknown, or other
  misc_feature (43)..(43): n is a, c, t, g, unknown, or other
  misc_feature (46)..(46): n is a, c, t, g, unknown, or other
  misc_feature (47)..(47): n is a, c, t, g, unknown, or other
gggggccccccggggcggggtcgggcgtccaatctcnaagagngtnnttttttaaaactggagctccccgcgggggcggccgctctagaactagtggatcccccgggctgcaggaattcgcacgagaccattacctagaacatcctaatcgaaaagagacccgaccaagagaggaaggtcagccagccaaacgccaccgccgtcgtgctcgcgacgtaggcaagtttcagctctctgacgcctcctcctccgttgattccgacgagagagacgcaaaccaccgaggtaggaaggagcgcgaagatgggagcgggggacggtgaggtcgctgccagaaaagacaaggccagcggcggcggtgccgagcggcacgtcgctggacggcgtgtgggataagaacgggatgcagcttaaaaagcttagtagggtggtagggccctgtccgctacaatgaaaaatactaccaggacgccttcggcctgcgagggattgtctcccaaactagcatacgttaccccaccatttgggggtggtggcgataagctggctcttcctcccccaataagggaaggaaggagccagtcctgagtttatatccgtagaccttaggcgggtacccggccccgggatccgtgggtcgtgagcactggccgcccaagggcgggtggaatcccgcgggtccgcaccctctgacgggaagaccaaaacttttctccttataataaaagcttgacagtgggtccgaacccgcgccacccttgtagaggaaggtgggctgtccacaaaaaaaagacggtgcgcggtgttcggaaaaaaaaag

SEQ ID NO: 50422 - DNA, 885 bp, Zea mays
  misc_feature: Ceres CLONE 1462952-F
  misc_feature: Encodes the peptide sequence at SEQ ID NO. 50423
  misc_feature (20)..(20): n is a, c, t, g, unknown, or other
  misc_feature (21)..(21): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
tgttttgtgggggggggggnnctctaaatcatacagcggcaggnnnnggnnnnntttcaaagctgggactccccgcggtggcggccgctctattactagtggatcccccgggctgcaggatttcgcacgagaccattacctagaacatcctaatcgaaaactcgacagatcggcgtcttcgaagccgccggggcaggcgccctccagcggaggcgccgcgtggtgccagctgctcctgctcctgactgtcctcccgctcacgctcgctgcgctggctctcctgctccagtgtgccggcggcggcggcgtccatgcaccctacccgtcgttggccctcccacgacatccccggtatggtcagatcccacccccaccgtcccacgcccatggtcctactgccgcgaattcgctcttggtgaaccttccgtccgccgttgtttgggggtacacccagggtgatggttcttttcccgctggagaaatgcggacccccctacacggtgggggtcgcgtggatgagggggaccgcttcggtccacctcccaaaagtgcggggcccaggcgcgccgaaatatacgttgctcttcgtgtgtcggggggcgctggggaacgagttgtttcctcggcctcctggtgccccccgtcgctctccctaccttggtgtgtacccggggagacgccgtacgtaatattggagaaggcgcgcgcccggagaagaattgccccacggagacccgctaaactcagtatcaggtcccgccctaagctcccactaaattttcggacccctctgggggataatacaccggcagatcactgatacgtcaggcgatctgacggaggccgtgtagataccttaaccaaacctcaacactataacctcaa

SEQ ID NO: 50423 - protein, 272 aa, Zea mays
  misc_feature: Ceres CLONE 1462952-F
  misc_feature (7)..(7): Xaa is any aa, unknown, or other
  misc_feature (15)..(15): Xaa is any aa, unknown, or other
  misc_feature (16)..(16): Xaa is any aa, unknown, or other
  misc_feature (17)..(17): Xaa is any aa, unknown, or other
  misc_feature (18)..(18): Xaa is any aa, unknown, or other
VLWGGGXSKSYSGRXXXXFKAGTPRGGGRSITSGSPGLQDFARDHYLEHPNRKLDRSASSKPPGQAPSSGGAAWCQLLLLLTVLPLTLAALALLLQCAGGGGVHAPYPSLALPRHPRYGQIPPPPSHAHGPTAANSLLVNLPSAVVWGYTQGDGSFPAGEMRTPLHGGGRVDEGDRFGPPPKSAGPRRAEIYVALRVSGGAGERVVSSASWCPPSLSLPWCVPGETPYVILEKARARRRIAPRRPAKLSIRSRPKLPLNFRTPLGDNTPADH

SEQ ID NO: 50424 - DNA, 818 bp, Zea mays
  misc_feature: Ceres CLONE 1462960-F
  misc_feature: Encodes the peptide sequence at SEQ ID NO. 50425
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (595)..(595): n is a, c, t, g, unknown, or other
  misc_feature (615)..(615): n is a, c, t, g, unknown, or other
  misc_feature (695)..(695): n is a, c, t, g, unknown, or other
ggggtccgcccggccgcgggcgcccctcacccactanaaacccacnntcgtataaagctggagctccccgcggtggcggccgctctagaatagtggatcccccgggctgcaggaattcgcacgagaccattacctagaacatcctaatcgaaaagagaccagaggacgacacgtcacgcctgcgcggatgcgcccaccatggacgaggatgagtttcggcgcatgctggacctcttcccggtcgtccgctcccgagactactgctgctccgatcttggatcatcctgcagaggaaccacacagcgatcacgagtctaggaggccactgagggcgatcatatggactcgtccggcggacgagatatgttcatcccgacattgaagatggctgcggtgattaagattggcgcggcgaaggcagagtttttgtgaaaaatgttccatcacgttcatgtgaacctccgccccccgaggggtgaatttgggatgctgctcacaggtccctgagcccctctgagagccgatcgccaacactacgttaaagcctgcttacagccccgcacttcccccactgatcgcggaaactgtcccgaancgcccggggattctggtccncgcccccaaactcttcggcggcccgcccacacagcatacctcaccccctggcctgtggacctgccagcgactgtggttantgaagttcgctcagggttcgctacttttttttgtggacgctccgctagtcccactaaacgatgtgacctcccaggcgtagaacaaattcggcgtcgcgcctcccgcccgtgaatgtgtgtgtg

SEQ ID NO: 50425 - protein, 39 aa, Zea mays
  misc_feature: Ceres CLONE 1462960-F
MDEDEFRRMLDLFPVVRSRDYCCSDLGSSCRGTTQRSRV

SEQ ID NO: 50426 - DNA, 688 bp, Zea mays
  misc_feature: Ceres CLONE 1462963-F
  misc_feature: Encodes the peptide sequence at SEQ ID NO. 50427
ctggagctccccgcggtggcggccgctctagaactagtggatcccccgggctgcaggaattcgcacgagaccattacctagaacatcctaatcgaaaaatcgccccgcgaaccctagctcccgcaactgccgccgccactcccacgctcgcagccatgccgcccaagctcgacccgtcgcaggtggtggaggtgttcgtccgtgtgaccggcggcgaggtcggcgcagcgtcttcgctggcccccaagatcggcccgctcggtctttcccccaagaagatcggagaggacatcgccaaggagacggccaaggactggaagggcctccgcgtcaccgtcaagctcaccgtccagaaccggcagggccaggtctccgtcgtcccctccgccgcggcgctcgtcatcaaggcgctcaaggagccagagagggacccgcagaaaggtcagaacatcaggcacaggggcacatcagcttcgacaacgtcatcgaaatcgccaggaccatgaggcacaggccatggccaaggaattggccggaccttcaagaaaacctccgaacctggctccagctcgggggcccgccaaaggaaagaaccccaggacctcccacggaaattgaccaccggaaggggaaacccctccccttaaaaggattggggcccaaattggttttttttcgggaaaacctt

SEQ ID NO: 50427 - protein, 116 aa, Zea mays
  misc_feature: Ceres CLONE 1462963-F
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLRVTVKLTVQNRQGQVSVVPSAAALVIKALKEPERDPQKGQNIRHRGTSASTTSSKSPGP

SEQ ID NO: 50428 - DNA, 963 bp, Zea mays
  misc_feature: Ceres CLONE 1462968-F
  misc_feature (16)..(16): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
gtttccctcccccccnttcccccgttccttgcgggngggggttnnnntntcttttgttctcccctccgtggcggccgctctagaactagtggatcccccgggctgcaggaattcgcacgagaccattacctagaacatcctaatcgaaaaagggtttttttgtttttttcctcgcggcgccgcctcctctctcgttccggcgggcttgggagttgatctaaccgcgcgccgcccacattgattttctccccagaacaaccccctgggggtcttggcgggctcccccttccaaagaaggggggggtcgtgtgccacgaaatagctataccttgggcgtaacaccccccaaaatggagatggcttaaaccctccccgcggacccccctcaacatggcgcgcgcgcgacgcataaatgaatatatttttgggaaatgttttttttttgggggtggctttgtagcccccccggggcagggccaccacctcgataggtttataatatattccaccccccctcccccctggggatatgtctctttcttttcaacccatggtgccttgtttatcttgggctagcttctgtcttttaacgtgacactcacgggggtgttcctcaatcaggcgacgtcggcccggggcaacagcttgccgcctggacagttggtgtgtcgttgtagcattagtccctgtctctttctctgcttcgcacttttacatctccgctcttcgtacccgtgccgtcctaaactccccttgcgcgtcggccgttgccttcttcctcgccctattaatctcgcgcctctccgttagttgttgttactcatgtacgcgagtctcgcttgctttgcttcttcctccctctatctcgcccgtgttctttcgtctccccacgcccgtcctgtcgtgcacgccgctgaccaaatatacaacccgccgcgctattttgcgcccagtcccacgctc

SEQ ID NO: 50429 - DNA, 700 bp, Zea mays
  misc_feature: Ceres CLONE 1462970-F
  misc_feature: Encodes the peptide sequence at SEQ ID NO. 50430
tggagctccccgcggtggcggccgctctagaactagtggatcccccgggctgcaggaattcgcacgagaccattacctagaacatcctaatcgaaaagaatctttcgccgccccatcagcccagcaattcttcgctgttcgttgccgttggttccatcggttgatcgaccggccggaagcagagagagagagatgggcaagtcctgggcgctcatcagccacctccacaccgtcgccgggccgagcatcaccctgctgtaccctctgtacgcgtcggtgtgcgcgatggagagcccgtccaaggcggacgacgagcagtggctgtcctactggatcatacactccttcgtcaccctcctggagatgctcgccgagccgctcctccactgggtacccgtgtggtacccggccaacgtgctgttcgcggcgtggctggccctgccccagttccagggcgcctccttcgtctacaagaagctcgtcagggaacagctccggaactacccgcgccaggtacccgcgcaagggcgccgccgcccgccgccgccgtcgggcgacgactactaactacctttaggtgccactttcccaagcgataaccctgttgaaaaccaccccaggagcttaaccggaaatcccccccagcgaaccttccggcaaatccggcggtccccagcgggctctttctgatggccccccg

SEQ ID NO: 50430 - protein, 124 aa, Zea mays
  misc_feature: Ceres CLONE 1462970-F
  misc_feature (4)..(101): Pfam Name: TB2_DP1_HVA22 Pfam Description: TB2/DP1, HVA22 family
MGKSWALISHLHTVAGPSITLLYPLYASVCAMESPSKADDEQWLSYWIIHSFVTLLEMLAEPLLHWVPVWYPANVLFAAWLALPQFQGASFVYKKLVREQLRNYPRQVPAQGRRRPPPPSGDDY

SEQ ID NO: 50431 - DNA, 706 bp, Zea mays
  misc_feature: Ceres CLONE 1462973-F
  misc_feature: Encodes the peptide sequence at SEQ ID NO. 50432
ctggagctccccgcggtggcggccgctctagaactagtggatcccccgggctgcaggaattcgcacgagaccattacctagaacatcctaatcgaaaaatcagacaacagacattcaaactacacgtcgatcatcgcatcgcactcaccacacggcctgcctgaataatccgtccgtccggtccaccgaccgccaatggcgcagatggagcgcgagcacctcagcgtggtcatgttcccgtggctcgcgcacggccacgtcaccccgtacctggagctggccaggcgcctcacctccgccaacgacgccgacatcgacgtgaccgtccacctcgtctccacgcccgtcaacctgtcggcgatcgcgcggcaccagacccctcggatccgcttcgcggagctccacctcccggcggcggcgggacctgcccccccgaactgcacaccaccaaggacctggcccgcgcgccttattgccggggctcaagcgcgggtgcgaaccccccccccccccgctttcggggcccttgctggaaaaaaacccccccggaaccccccccttttaattttccctaacccggggggccccccctcaaggccccccccccgcgggttggccccccgggcgccttataacactttttagggcccccccccccccccccttttctttgggaattcgccaaaagccccgccccccccccaaa

SEQ ID NO: 50432 - protein, 149 aa, Zea mays
  misc_feature: Ceres CLONE 1462973-F
  misc_feature: SWISSPROT Homolog: EC 2.4.1.236 Flavanone 7-O-glucoside 2''-O-beta-L-rhamnosyltransferase
MAQMEREHLSVVMFPWLAHGHVTPYLELARRLTSANDADIDVTVHLVSTPVNLSAIARHQTPRIRFAELHLPAAAGPAPPNCTPPRTWPARLIAGAQARVRTPPPPAFGALAGKKPPRNPPLLIFPNPGGPPSRPPPRGLAPRAPYNTF

SEQ ID NO: 50433 - DNA, 736 bp, Zea mays
  misc_feature: Ceres CLONE 1462978-F
  misc_feature: Encodes the peptide sequence at SEQ ID NO. 50434
  misc_feature (686)..(686): n is a, c, t, g, unknown, or other
tggagctccccgcggtggcggccgctctagtactagtggatcccccgggctgcaggaattcgcacgagaccattacctagaacatcctaatcgaaaaacaccactgccctcttctgcacaccactgccctcttctgcacaccactgccctcttctgcacaccactgccctcttctactctcgtcgcgccggtaactcccgtccctcttcctcacgctgtcgctccgcctggtcccctccgtggacggcttcctcctcatcctgctccacgcgctcaccgtggccgccgccgtggccgggtgcgccgtcatcgctgcgcccgacccgccgcgcggccgctgctacaccgcccacatgtccgccaccgccgtcgtgtccatcctgcagggcgccgccgccgtgctcgccttctcccgcacctcggagttcctcgccggcgggctccggtcgtacgtccgcgaggaggacggcgccgtcatcctccgcatggtcggcgggctcggcgtcgccatcttctgcctcgagttggtcgcgctcgcgctcgccttcgtgctcaggtactacgcctacgtcgacagggagtgcggcggcaacccgcagcgccgcagcgccaaggtcggcggcgaggacggcgccggcacctggcccttccaggtctgagggctggtcacattggccttggctgcnggaaggtggaactgagaaccgtgtgctcttggaagggaaatcagcgtcga

SEQ ID NO: 50434 - protein, 101 aa, Zea mays
  misc_feature: Ceres CLONE 1462978-F
MSATAVVSILQGAAAVLAFSRTSEFLAGGLRSYVREEDGAVILRMVGGLGVAIFCLELVALALAFVLRYYAYVDRECGGNPQRRSAKVGGEDGAGTWPFQV

SEQ ID NO: 50435 - DNA, 762 bp, Zea mays
  misc_feature: Ceres CLONE 1462981-F
  misc_feature: Encodes the peptide sequence at SEQ ID NO. 50436
  misc_feature (762)..(762): n is a, c, t, g, unknown, or other
ctggagctccccgcggtggcggccgctctagaactagtggatcccccgggctgcaggaattcgcacgagacaattacctagaacatcctaatcgaaaaattccccgccgcctcgcgcccccgctcgcttcacttctctaggtgcgcaccgatcagaaggtgcctgcctcctcctcgtcagcgaaaagatggcggtgccgctgctgacgaagaagatcgtgaagaagcgggtcaagcagttcaagaggccccacctcgaccgctacaagtgccttaagccaagctggcgcaggccaaagggtattgactcccgtgtcaggaggaagttcaagggatgcaccttgatgcccaacattggttatggttctgacaagtcgaccaggcactacctccccaacaagttcaagaagtttgcggcccacaacgtttctgagctggagttgctcatgatgcacaacaggacctactgcgctgaaattgctcacaacgtgtccactaagaagcgcaaggagatcgtggagcgtgctgcgcagctcgacattgtggtcacgaacaagcttgctaggctccgcagccaggaggacgagtagtctggtttcttgtcttaacgacgaactggatgttgccattcctttctgtaggaaactactttgcttgtgtcttgttagtactgaaaaccagagtcactcctacctttttgcaatcagtagctactaaaatgtggcagattccactaaaaaaaaaaaaaaaaaagcttatcgan

SEQ ID NO: 50436 - protein, 133 aa, Zea mays
  misc_feature: Ceres CLONE 1462981-F
  misc_feature (14)..(123): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPNIGYGSDKSTRHYLPNKFKKFAAHNVSELELLMMHNRTYCAEIAHNVSTKKRKEIVERAAQLDIVVTNKLARLRSQEDE

SEQ ID NO: 50437 - DNA, 748 bp, Zea mays
  misc_feature: Ceres CLONE 1462982-F
  misc_feature: Encodes the peptide sequence at SEQ ID NO. 50438
  misc_feature (378)..(378): n is a, c, t, g, unknown, or other
cccccgggctgcaggaattcgcacgagaccattacctagaacatcctaatcgaaaagatactccctcagattcttaccaaaacacaggagcccgtcggccgtcgcaaaaaaacaaaacaagaccaccgcaccatggaatcgctgacgcttcgcgcttcgacggccgcctcgccgctgcagcgacgccggctgctccccgggcggcagcgcgcgacgtacatccgcgccacggcctccgccggcgagccggacctctccgtgcgcgtgaacgggctgcacatgcccaacccgttcgtgatcgggtcggggccaccgggtatcaattgaaccgccatgaagagggcattcaacgaggggtggggcaaccctttccccaanactgtgtcattggatgctgaaaaaggtaccaacgataccccacaaaaaaaaaaacttccggcataaccaaatggggctgccatgggggtgaatctttgcgtggcagaacattgaaactcttggtgaaaggccttctggagacaatggttgaacggtttcacgccgttgaagaaaaaatatatctgacgcgaaaacttatgggctcccttatggaggaattaccaataaactggcctggcaatgagctttaatgtacctggtttaaaaagccctggagtggaatacctcttggaaataaattttctctggggccacatggagattgcccatatataataaaatagtgcggccccgcgatggagcaaaagaa

SEQ ID NO: 50438 - protein, 64 aa, Zea mays
  misc_feature: Ceres CLONE 1462982-F
MESLTLRASTAASPLQRRRLLPGRQRATYIRATASAGEPDLSVRVNGLHMPNPFVIGSGPPGIN

SEQ ID NO: 50439 - DNA, 767 bp, Zea mays
  misc_feature: Ceres CLONE 1462983-F
  misc_feature: Translation starting site: 172
  misc_feature: SWISSPROT Homolog: EC 5.2.1.8 Peptidylprolyl isomerase
  misc_feature (657)..(657): n is a, c, t, g, unknown, or other
  misc_feature (738)..(738): n is a, c, t, g, unknown, or other
ctggagctccccgcggtggcggccgctctagaactagtggatcccccgggctgcaggaattcgcacgagaccattacctagaacatcctaatcgaaaaaaaggactatctcagcgatttccgaaccctccccacccccacacccacccgatccaaccgagtcccggcggcgatggcggcggcgacgaacgccgatgtggaggtggtcgacttcgacctcgatgacgacgacctcatggacgaggacgccgggccagatccagcaccgccccccgcctcccgcctccgctccaccatcgcgggcgacgacgcgccgcgtaggaccaagggccgcggcttccgcgaggaccctaactccctccgctacccgcgactcgcgctttggcgcggggggacgcgccgacctcgactcgcttggcggcccaggacccatccagtcaattgaaggatggattgtgttggtcacaggagttcacgaagaagctcaagaagatgaccttcaaaatgctttccaagaatttgggcaggtcaaaaacctgcatttgaatttggaccgccgcaccggatttgtcaaggggtacgctttgattgaatacgagaagtttgaagaagctcaggctgcaataaaagaactggatggagctgagctttataaccnaagaatgagtgttgattgggcatttagcagtggccctgctaaacgcgaaatactcggaaaaggtcaccacccagagctcgnttcaggaccccacccagagaaggcactga

SEQ ID NO: 50440 - DNA, 760 bp, Zea mays
  misc_feature: Ceres CLONE 1462994-F
  misc_feature: Encodes the peptide sequence at SEQ ID NO. 50441
  misc_feature (413)..(413): n is a, c, t, g, unknown, or other
aagctggagctccccgcggtggcggccgctctagaactagtggatcccccgggctgcaggaattcgcacgagaccattacctagaacatcctaatcgaaagctcgaccattttcccatttccattcccatcccaattcccagcggtttcatttccacctcctccttttccaatttcgactcgattcgaaacaggataccaaatgcatgatcgatcccacaagccgcagccggcggaggccggcaacggcgggccggctggcgagggcggcggcgggaacgtggatcgggtgctcttcaagaacctcgtcgagatggtgccgctcgtcgagtcgctcatggaccggagggtcaacccggcatactcgcgtcgcgcttcgctggtctacacgccggcgccgcccaagaggcaagncgattgaaaagtgtcaaatttgcacagagcgtatcagccaaaaagcagagagaccctggtgatatagccaaaagaagcccccagaatctaacggcaacaacggttccagtgggccattaacccctgtcaggtggtgaaaaaatcccccagggagaagtttgcttggctaagcgagcaaaacaatgccctaaaaaaaaaactccttgaaaaagaagaagccactaagtctgggaaaaaacctcggcccggaataaaaagcccaatatgccaatttcgggaaaaccaaaccccggggggggaaaaaaaaacttttaaaaaaacaacccaaattccccggggggggaaaa

SEQ ID NO: 50441 - protein, 72 aa, Zea mays
  misc_feature: Ceres CLONE 1462994-F
  misc_feature (71)..(71): Xaa is any aa, unknown, or other
MHDRSHKPQPAEAGNGGPAGEGGGGNVDRVLFKNLVEMVPLVESLMDRRVNPAYSRRASLVYTPAPPKRQXD

SEQ ID NO: 50442 - DNA, 751 bp, Zea mays
  misc_feature: Ceres CLONE 1462999-F
  misc_feature: Encodes the peptide sequence at SEQ ID NO. 50443
  misc_feature (362)..(362): n is a, c, t, g, unknown, or other
  misc_feature (399)..(399): n is a, c, t, g, unknown, or other
  misc_feature (410)..(410): n is a, c, t, g, unknown, or other
ccccgcggtggcggccgctctagaactagtggatcccccgggctgcaggaattcgcacgagaccattacctagaacatcctaatcgaaaaaagtagggcggtaggtatacgtgcacgtctcaccaacgcaacacaccgttgcctgtgaagcaccgcagcgcggagcggaagggtccagcgaccgcaactgatggggaggagcggcggcgagacggcggggaagaggcagcacctcgggagcatggaggagttctggggcttctacctgagccagcactccaagccgggcacgcggcggtggcacttcctcggcacgctggcctcgctcgcctgcgcggtgctcgcggccgccactggtgaanccacggacctcctcgcgggccccgttctcgggtactnccccccccggnacaaccacttcttcgtggagggcaaccggcccgccacgttcggccaccccgtgtggtccttcctctgcgacctccgcatgttcctgctcatcctcaccggtcgtatcggaccctagctcgggcgcctccacgtccggtcgacgggcgagtctcccgacgccggggtggtctcctgggcaccatgactgaaccgaactccccctggtcgcctgttttggcctttccggtttcccgcaaccccggtttaattgtaggccctcatcgattgaattacccgccggcgttccgaagctggtctttgggtatatccgggaacaacacccatttgcgcttgtgttctc

SEQ ID NO: 50443 - protein, 111 aa, Zea mays
  misc_feature: Ceres CLONE 1462999-F
  misc_feature (58)..(58): Xaa is any aa, unknown, or other
  misc_feature (70)..(70): Xaa is any aa, unknown, or other
  misc_feature (74)..(74): Xaa is any aa, unknown, or other
MGRSGGETAGKRQHLGSMEEFWGFYLSQHSKPGTRRWHFLGTLASLACAVLAAATGEXTDLLAGPVLGYXPPRXNHFFVEGNRPATFGHPVWSFLCDLRMFLLILTGRIGP

SEQ ID NO: 50444 - DNA, 814 bp, Zea mays
  misc_feature: Ceres CLONE 1463001-F
  misc_feature: Encodes the peptide sequence at SEQ ID NO. 50445
  misc_feature (362)..(362): n is a, c, t, g, unknown, or other
  misc_feature (363)..(363): n is a, c, t, g, unknown, or other
ctccccgcggtggcggccgctctttaactagtggatcccccgggctgcaggaattcgcacgagaccattacctagaacatcctaatcgaaaaatacgccgccatcttcgcaagccaccgcaaccgaagcccgccttcgccgccgccgcctctgcaatccccgcaaggtcgcaaacatgtctaccgtgctccagcgcccgacccccggcacggaccagtgcttcggccgcaagaagacggctgtggccgtcgcctacaccaagccgggccgcggcctgatcaaggtgaaccgcgtcccgattgagctcatcacgccggagatgctccgcctcaaggccttcgagcccatcctgctggcggggnnacccaggtttaaggacatccaacatgaggatccgtgtttccacccccccggaagacgtctcaaatctaccccatccgcccaggccgccgcccaagggggctcgtcccctactaccagaaatacctccaaacaagtccgctaaaaaggagggtaaagggaattcttctgcggggaacaaccgaaatctttattctttgcccaaccccagggcgttggaagccaaaaaaattttcggtgggtgaggggcccctgcccaaggttttaaacaatccctccgttataatgctctcggtgcccctcttttgtagaaacacttttctctgagtttggacaaaccgggaaaatttcactcgcgcgcaccccgcgggtctaattttttcccgtacgcgaacggcacttatggggctccccagaaaaatagggtgtgttcaccgacccactaaaggctcat

SEQ ID NO: 50445 - protein, 109 aa, Zea mays
  misc_feature: Ceres CLONE 1463001-F
  misc_feature (17)..(94): Pfam Name: Ribosomal_S9 Pfam Description: Ribosomal protein S9/S16
  misc_feature (63)..(63): Xaa is any aa, unknown, or other
MSTVLQRPTPGTDQCFGRKKTAVAVAYTKPGRGLIKVNRVPIELITPEMLRLKAFEPILLAGXPRFKDIQHEDPCFHPPGRRLKSTPSAQAAAQGGSSPTTRNTSKQVR

SEQ ID NO: 50446 - DNA, 795 bp, Zea mays
  misc_feature: Ceres CLONE 1463003-F
  misc_feature: Encodes the peptide sequence at SEQ ID NO. 50447
aaagctggagctccccgcggtggcggccgctctagaactagtggatcccccgggctgcaggaattcgcacgagaccattacctagaacatcctaatcgaaaagtagttattaccagcatcggtggtgcgccatccaacaagcatcagagctcggtgtcacaaaacctgaccgatggcggcccggtgctccacagctgcctccgtggtcagaacaggatcgcgagacctctccccctccctttccttcacagccgcggcgctccctttcgcgcgtctgaggcccgtaggagcgtgggtccccggtgaagggtaacctggcagctccgcgccgtctgcgccagtgggttccgggccttttgttccaattcccggccccccacacgcttttggaaaaacccaggggaaacccaccccccacccccatttaaaaagaatggaaaaaaccccctaattaaaaaaaattttttttttccccccaaaaggggcccctaaaaaaccttcccggggaaaatcggaatataaacccccccggtttttatcggggggtgtgggcacccccctctgtttaaaccccaaaaaatttaagggggggggggggcgcccccttttaaacccctttgggagagagggggaaagatttttttttttttttttttttccccccccaacaagggttgcacccccccgtagacttccgggggggtctttctataaagccccccccccgagagagaaaaaaattttattaaggctgctgaagagaacccccccctcgtgtggtgttttttatgagac

SEQ ID NO: 50447 - protein, 46 aa, Zea mays
  misc_feature: Ceres CLONE 1463003-F
MAARCSTAASVVRTGSRDLSPSLSFTAAALPFARLRPVGAWVPGEG

SEQ ID NO: 50448 - DNA, 783 bp, Zea mays
  misc_feature: Ceres CLONE 1463010-F
  misc_feature: Encodes the peptide sequence at SEQ ID NO. 50449
  misc_feature (409)..(409): n is a, c, t, g, unknown, or other
  misc_feature (410)..(410): n is a, c, t, g, unknown, or other
  misc_feature (425)..(425): n is a, c, t, g, unknown, or other
  misc_feature (426)..(426): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
tggagctccccgcggtggcggccgctctagaactagtggatcccccgggctgcaggaattcgcacgagaccattacctagaacatcctaatcgaaaagtttccaacacagcgaggcccacgttgtagggttttttgcttgcttcgcccggcccccggcggtaaagctgagcgcggcgagagccggagaccgaagaagcgcggccggtcatggagatcggacagtaccccgcgagcggctgctccaaggagcaccagaagatctaccaggagtggttcgcgctcgcggacgcagatggggatggccgcatcacgggccccgatgcgatcaagttttttggcatgtccaagctctcccgccctgacctcaagcaggtctgggctatcgcggacaccagaaggtaggggtcnnccccccccgcggaanncnnnagggggatgcagctagtctctctggcacaggcaggcaacgagatttcttcagatagccttaaccgagatgaattgagcaggttgaatcccccttgtgatggaaggtttgggatgccctctttggaaaatctaagcatttggtgcaacctggttgatccaccaaatggatgggatttcctccgggaacatcctccttttaacaaccaattgggtttagctcaaagtcatcaaaaaaaaattccctcttgactgcccctccccttcctggttatcccttggtcttggaaaaaacttttttttccgcaaacagttgaaggccttctgggaagttaacctcacaaggtttccttgta

SEQ ID NO: 50449 - protein, 64 aa, Zea mays
  misc_feature: Ceres CLONE 1463010-F
MEIGQYPASGCSKEHQKIYQEWFALADADGDGRITGPDAIKFFGMSKLSRPDLKQVWAIADTRR

SEQ ID NO: 50450 - DNA, 698 bp, Zea mays
  misc_feature: Ceres CLONE 1463014-F
  misc_feature: Encodes the peptide sequence at SEQ ID NO. 50451
  misc_feature (486)..(486): n is a, c, t, g, unknown, or other
  misc_feature (698)..(698): n is a, c, t, g, unknown, or other
ctggagctccccgcggtggcggccgctctagaactagtggatcccccgggctgcaggaattcgcacgagaccattacctagaacatcctaatcgaaaatagcttttgttctatcatggattcttcatcactgtcgggagctcagtttatatctggtttggtcatgggcatcactgggctcccttcggacatacctgtggtggtgactgcgaacaacatcacgacgaggccgtcgactcccctcagcgacatcgtcaacctcaggcggcggtcgtgtaaggtgctccgcgacgcaacggtgacaagggaagttcagctatgcatggccgtgcggagagagtggaagctgcaccggtgacgaggttcatggtccccggccttcggggggggggggaaaaaaaagggggtgaaccccccgagggaacttttttttttttttcccccccccgcgcgggggaaaagagaccccccccccctcccctcctcngcaacaaaaaaaaagcaccccccccttttttttttggggggtcccccccccccccccctgctcggggcgggagcgaagcagcaggaaggaggatacgcttttgtgttttgtataaaacatggcccgccccccctgggcagataaaatactttatctccccccccgcccgcgcgcgcgggggtgatagaaaaaaaacaaacactccccccccn

SEQ ID NO: 50451 - protein, 80 aa, Zea mays
  misc_feature: Ceres CLONE 1463014-F
MDSSSLSGAQFISGLVMGITGLPSDIPVVVTANNITTRPSTPLSDIVNLRRRSCKVLRDATVTREVQLCMAVRREWKLHR

SEQ ID NO: 50452 - DNA, 742 bp, Zea mays
  misc_feature: Ceres CLONE 1463019-F
  misc_feature: Encodes the peptide sequence at SEQ ID NO. 50453
  misc_feature (372)..(372): n is a, c, t, g, unknown, or other
tggagctccccgcggtggcggccgctctagaactagtggatcccccgggctgcaggaattcgcacgagaccattacctagaacatcctaatcgaaaaatcttcactcacctcccgcatttctgtccacctcctggcctggccagccactgccgcaagcccgcaccgcaactgcagttgagtgagaccagttcgccgcccctagataatctcgcctctccagggacggcaggccgtgccgtgccgtcacgacagaccagaccagaccagaccagagagagctagtgcgtgccagcgcgcggtgggagagagagacttcgttctagagctcccgtgaggacgatggagcggggcagttcctggcggctcacggnggtcgccggcacccttgtctgcgcgtccctcttctcccccccctccgccgcgctcaatgtcggcgtccagtccgccggcgacgacgcgagcaagcagcaggcgtgcagccgcacgtgcgagtcggaccactgcacgacgccgccgttcctgcggtacggcaagtactgcggcatcatgtacagcggctgccccggcgagccgccgtgcgacgcgctggacgcctgctgcatgcaccacgacaactgcgtccaggaaagatggactacctgagcacgcctgcaacaaggcgctgctggactgcctgcccaactgcgggaaggcacgtccacgttcaagggaaacggtgcatgatccaccaggtcatcaacg

SEQ ID NO: 50453 - protein, 100 aa, Zea mays
  misc_feature: Ceres CLONE 1463019-F
  misc_feature: SWISSPROT Homolog: EC 3.1.1.4 Phospholipase A(2)
  misc_feature (11)..(11): Xaa is any aa, unknown, or other
MERGSSWRLTXVAGTLVCASLFSPPSAALNVGVQSAGDDASKQQACSRTCESDHCTTPPFLRYGKYCGIMYSGCPGEPPCDALDACCMHHDNCVQERWTT

SEQ ID NO: 50454 - DNA, 768 bp, Zea mays
  misc_feature: Ceres CLONE 1463023-F
  misc_feature (379)..(379): n is a, c, t, g, unknown, or other
  misc_feature (381)..(381): n is a, c, t, g, unknown, or other
  misc_feature (384)..(384): n is a, c, t, g, unknown, or other
  misc_feature (405)..(405): n is a, c, t, g, unknown, or other
  misc_feature (428)..(428): n is a, c, t, g, unknown, or other
  misc_feature (476)..(476): n is a, c, t, g, unknown, or other
aagctggagctccccgcggtggcggccgctctagaactagtggatcccccgggctgcaggaattcgcacgagaccattacctagaacatcctaatcgaaaagtcttctccgttcagcctccgccctccgctctgcctctgcgtcttccaccctttgccatttgcttgcaatgtctaatacctgagtgagagagcttcctcagtccatggaggtgtcgtcgaggctccaaagcctcctcagacccttcctactctgccgctcccgcgccgcagggatgaccctccaaaccctagctctttgctccccgccgcctcctccgcgcatcccatcttccttcctccctcgaacgcgccgtctacctcctccctttcccatggcngnccnatccgtcttctttttcacagnaccttcgcctccgtctccccggnccccgcccctggctcagggaaggaccacctcaactccagggaacaggnacccccgcccgggcccttgctcccgcaacggcagaggagctccgccccaaaaacaaatcctataccacaaacccttttcgaaatgggccaggaaaacagtaccggggcccccccgtaagggtttttttttttggccaaattccacctgggaagctggggcccaaaatttctttagggttttcccccctatggggggcccccaaaaaagtgcccttaaaaacacaaagtgggggaacccccgggttttttttgggggctataaaaaaaaccttcccacaggggggttttttaa

SEQ ID NO: 50455 - DNA, 755 bp, Zea mays
  misc_feature: Ceres CLONE 1463027-F
  misc_feature: Encodes the peptide sequence at SEQ ID NO. 50456
  misc_feature (487)..(487): n is a, c, t, g, unknown, or other
aaagctggagctccccgcggtggcggccgctctagaactagtggatcccccgggctgcaggaattcgcacgagaccattacctagaacatcctaatcgaaaaattccgctcactcaccttttgcagaaaacccaccgacttctccaaagcatcccatttccgcccctcctcgctgccctccttcccaatctccgcaccgccaccgcgagcggcggtacgcgcgcgccagatcgcccgccccctcgccgccgcaccggcgcaggtccgccgcgcccccggccgccgccattgcgcgcggacgagcgaccccgccccgccccgccccctgaaggacgcgaggcgccgcacccaccccgcgcgcggggggagggcgccgccgcggcgcgtacggcgatggtgatgatcagcaggcagctcctgctcacctacctctacctgctcatctacatctgcctctcgtcgggggtcatcctcttcaacaaatggntgctatctcctaagtacttcaaattcccctttcccattactctcacaatgattcacatgtcattttctggagtcgtggcgttcttcctagtccgtgttttcaaggttgttgcacctgtcaagatgactttccaaatatatgccacatctgtaattcccattagtgccttctttgcgtcaagtctttgggtcggaatacagcatacttatacatttcagtgggcttcattcaaatgctcaaggctttgatgcctgtggcgacatttata

SEQ ID NO: 50456 - protein, 113 aa, Zea mays
  misc_feature: Ceres CLONE 1463027-F
  misc_feature (32)..(32): Xaa is any aa, unknown, or other
MVMISRQLLLTYLYLLIYICLSSGVILFNKWXLSPKYFKFPFPITLTMIHMSFSGVVAFFLVRVFKVVAPVKMTFQIYATSVIPISAFFASSLWVGIQHTYTFQWASFKCSRL

SEQ ID NO: 50457 - DNA, 733 bp, Zea mays
  misc_feature: Ceres CLONE 1463034-F
  misc_feature: Encodes the peptide sequence at SEQ ID NO. 50458
  misc_feature (550)..(550): n is a, c, t, g, unknown, or other
  misc_feature (667)..(667): n is a, c, t, g, unknown, or other
aagctggagctccccgcggtggcggccgctctagaactagtggatcccccgggctgcaggaattcgcacgagaccattacctagaacatcctaatcgaaaactctctcccagtccccagtccccacccaccaccagtcttcctcgctctccaaatctcgcgacgagaaagcccatctaggaccacaggggcgcgccagccggcaggaacgacgggagaggagggcatggagccggctgagcggatcgagtcggccgggacggcgctggggaagcgtccgaggagcagggtgctgccgcgcacggccagcatggtgacggtgccgtcggcggcgaagcaggggcgccaggagcggggcgccggcgtgccgtcgtcctgctcactgccggctgcctgcgccgggatggtggccgtgccggggggttactactactgtggcacctcgttcgcggcggtggagacggcggccttcctgaaggcgtgcggcctctgcaaacgccacctcgggcccggccacgacaccttcatctacaggttccagtcggcgtggntttttttttttgtttttttttttttttttttgcttaggaacgcatcttttcccttcatattcatggcccctattttactttacattatgaggcacataatagtttttttttaatcanctgtcacagaactcgctgagtgggtgggaacctaatccctctaagattttttttttggtggaaggg

SEQ ID NO: 50458 - protein, 145 aa, Zea mays
  misc_feature: Ceres CLONE 1463034-F
  misc_feature (109)..(109): Xaa is any aa, unknown, or other
MEPAERIESAGTALGKRPRSRVLPRTASMVTVPSAAKQGRQERGAGVPSSCSLPAACAGMVAVPGGYYYCGTSFAAVETAAFLKACGLCKRHLGPGHDTFIYRFQSAWXFFFVFFFFFLLRNASFPFIFMAPILLYIMRHIIVFF

SEQ ID NO: 50459 - DNA, 746 bp, Zea mays
  misc_feature: Ceres CLONE 1463035-F
  misc_feature: Translation starting site: 234
  misc_feature (346)..(346): n is a, c, t, g, unknown, or other
  misc_feature (388)..(388): n is a, c, t, g, unknown, or other
  misc_feature (436)..(436): n is a, c, t, g, unknown, or other
ctggagctccccgcggtggcggccgctctagaactagtggatcccccgggctgcaggaattcgcacgagaccattacctagaacatcctaatcgaaaacaagaattcgcacgagaccattacctagaacatcctaagcgaaaactgagtcccctccgccgcctgccgcactctcccgcgacgccaccaccacacgttcacggtagcgagagcttatcgtcgtcggcggcgaagatggtgtcgctgaagctgcagaagcggctcgccgcgagcgtcctcaagtgtgggaaaggcaaagtctggcttgacccccatgaagtcagcgagatctccatggctaactcccngcagaacatccggaaagtggttaaggatggggttatcatcangaagcctcagaaggtcacctctagtcccgtgcaagaaagccacatgangccaagccgaagggaaagcactctggaattggcaggcccaggggtacagggaagctaggctccccacaaaattcttgaataaaaaagatccgtttctaaggccccggcctgaaattcccgtgggcccaaaaatccaaagccctgtttttggcttttcctgaagggaggggaaattttaaaaaaaggggggttttgggagagtccccactcccgggggaaaaggccaaaaaaaaactttttataatttttggggccacgcaaaaaaaaaggccccccgaaaagaatattttgggggagaaaaggcgccccc

SEQ ID NO: 50460 - DNA, 891 bp, Zea mays
  misc_feature: Ceres CLONE 1463038-R
  misc_feature (1)..(1): n is a, c, t, g, unknown, or other
ncaattgggtaccgggccccccctcgaggtcgacggtatcgataagcttttttttttttttttttgccgatgggcaataagggtaggtgacaatgttagcattgagtccactaaaccatgcagtcgtgatccaatttgttttgacaacgccactgcacattcagccattatacattaaagtggaataatggcagttcaagatggtataaattgggaacccggaagtcaatactacgcatgtgttggtctgccactgttaaacagactaaattgttgaaaaacaaccccataatgtacgagagggttcctaacaacatgcagaaatctgttggtatgctcacaactagaacgacagagatgtccaaacccgatgccaatcaactaacatgatgcgcattatgttggccaaaatcaaggggtcgcacctgggtgatagtttaaaataagcattgctcaacccaacatggcagatcatggtgtcgacctgctgagctagaatgaggatcctcgtcttgacttcgagggcgatcgctttgacgtctgccttgcggagccccttgacaccatagaggaggtctctgcatccttttcatcgccattctgaggtgagggggtaattcaggaaaacggatccgatcaacggtggttcctaaccgcagacaaaatacgggggaacatcgtgggggttgggtttctccaggggtcttgggggtggggcaaatgtttgcggatgatgggaaaccagggtttgggccgtccctccttggccggggcccccaaacttaaaaaggaggttgggggcgaacttttagaagggcggggggaacccatgggagaatgggggcccttggttgggacaacggaggcggttttatttgtgtggtgtggggg

SEQ ID NO: 50461 - DNA, 872 bp, Zea mays
  misc_feature: Ceres CLONE 1463038-R2
tcgggaggtgttatatttagcattggtccactaatccctgcagtgtgatcagtcatgttcgcgcaacgccacagcagattcggccattatacgtaaagtggaataatgccagttcaagatggttaatattggcaaccaggaactcaatacaggcatatgtagtctgcgacctgctaacaagacttagttgctaaaaaaccacccactatgacaaacagggttactagtaacatagaaaaatctgttggtatgctcagaactagtaggacatagatgtccaatcccgttgcctattaactaagatgatgcccattttgttggctacattaaggggatcgcactcgggtgacattttcacataagccttcttcttcccaacatgcctgatcagggtgttgaccttctttgctagaatgacgtacctcttcttgactgcaggcgtgatcgctttcatgtctgccttgaggtcgacactagacacccgagagtaggtatcttcaatcttcttcgttgcagattctgaggtgagggggtacttcaggatttggtactgatcccgcgtgttttctacgagcgagctgattctggagaacatccgggcgttcggcttcttcggggtcttgggctgggtaaaatgttgccgatgatgggcacctggcttggtcctccttcttgctcggcccccaaattaagggacgttgggccaactttgaagggcgggggccctttggcattggcgccttgctgggccccggggcggtttgtagggagggcgttatagtgccttttcccaaaaaacaccatgcctttttcagttctcgcaccgccccggggttggaaaggggggacctttgaagacaaatattaaccgg

SEQ ID NO: 50462 - DNA, 836 bp, Zea mays
  misc_feature: Ceres CLONE 1463040-F
  misc_feature: Encodes the peptide sequence at SEQ ID NO. 50463
  misc_feature (514)..(514): n is a, c, t, g, unknown, or other
ggagctccccgcggtggcggccgctctagaactagtggatcccccgggctgcaggaattcgcacgagaccattacctagaacatcctaatcgaaaaatcagctaagatagctgcaaaacaagcgagttacttacaaccaaacagaagggtagaaaccacctgaagccatgtgcattgctgcatggatttggcaggctcaccctgtgcaccaactcctcctgcttctcaacagaaatgagttccacagcaggcctacaaaaccagtaggatggtggggggaaggctcaaaaaagatccttggtggcagggatgtgcttggtggaagaacatggatggggtgcaccaaagatggaaggcttgccttcctgaccaatgtgcttgaaccagatgccatcccctgttcacagactaaggtaagatcgttcctcctcagatgccctggcggagaaacaggaaccccacgacgaaggtatcaccttgattggcgggaaaaaaaacttaataaattcctgtnggatggcgcccatcctacctgaactgattctaaacaactaattgttcatttgtggtagttgtaggggaccgcttaccttaattgtaccagccctaaacaccgaattgcgggcgccgttttcgaacctaataacctccggttgggggtgaacggcatgggggttaaaggtgggtttaagccattggtatagggaaaataaaaagtgcaaccagtggaagtgggaatctatacggggggattcgttaattggggttaaccggtgccatatcgttaggtcggattaatcatacatagtcttctggtcttgttttaatatagggtc

SEQ ID NO: 50463 - protein, 122 aa, Zea mays
  misc_feature: Ceres CLONE 1463040-F
  misc_feature (116)..(116): Xaa is any aa, unknown, or other
MCIAAWIWQAHPVHQLLLLLNRNEFHSRPTKPVGWWGEGSKKILGGRDVLGGRTWMGCTKDGRLAFLTNVLEPDAIPCSQTKVRSFLLRCPGGETGTPRRRYHLDWREKKLNKFLXDGAHPT

SEQ ID NO: 50464 - DNA, 768 bp, Zea mays
  misc_feature: Ceres CLONE 1463041-F
  misc_feature: Translation starting site: 359
  misc_feature: SWISSPROT Homolog: EC 2.2.1.2 Transaldolase
  misc_feature (641)..(641): n is a, c, t, g, unknown, or other
  misc_feature (724)..(724): n is a, c, t, g, unknown, or other
  misc_feature (755)..(755): n is a, c, t, g, unknown, or other
ctggagctccccgcggtggcggccgctctagaactagtggatcccccgggctgcaggaattcgcacgagaccattacctagaacatcctaatcgaaaagacgagcaacagaactagtagtacaggtcgcaacaaccccccaccgtgagggacgcgaccaaacacacgcccctcttcgcacctcccaccaaccccgacgagcggcgatgaccggcacggtgtccaagctggcggcgccccgtccggcggcaccgccgctccggccggcgtccctccgcaccgccgccctcgccttcgccccttccccgcgccgagtccgcgtttccgtcgccgggcgagccaggagccccatcattgcgatggcttcggccaaggaaggaagcggtgcaccgaccaagaggactgcgcttcatgatctctacgagctccagggcctgtccccgtggtacgacaacctatgccgccctgtcacagacttgctgcccattatcgccagcggcgtccgtggagtcaccagcaacccaacgattttccaaaaggccatttcatcgtccagcgcatatgatgatcagttcaagcagctcatttcggcaggaaaggatgcggagagcgcttactggggactcgtattaaggatatccnagatgcgtgcaaactttttgagcccatctacgacgagactgatggggctgatgggtatgtctccgtaaaagtgtctcctaggntggcaaatgacactcaggaactggtgaagcngcaaagtgttacc

SEQ ID NO: 50465 - DNA, 680 bp, Zea mays
  misc_feature: Ceres CLONE 1463050-F
  misc_feature: Encodes the peptide sequence at SEQ ID NO. 50466
ggagctccccgcggtggcggccgctctagaatagtggatcccccgggctgcaggaattcgcacgagaccattacctagaacatcctaatcgaaaaaggctgctagctagtgctacctttcaaaaaacccctacatcctgccatccatccgcggtccgccgccgccgccatctcctcccactctcttccccccactcctaccaaaccctattcaatatccatttctccatccatggcgtggcgcggccccgccacccgggccgtcctcgccgccgtccgccgcccggcagcggccgcgcgcctccacgccccgcgccgccgcgtcccgcccgccttcgccaccacctcctccccgctcccgtccgcgcggcctctggcggcgttgatggggtccccggtgacggtggccgcggtgatggcgcgcctcacggcgcatcccggcgccagcgcgcgcgcgtgctgcgagctttccagggtacttgaatctgttgtgtagaccccatccttttcaaaagaataaatgaatgttatcttttgggggaataaaagctatatgggctttccttcccgccaaagttcgaagaaattaccccacaaaagttagtttcccctttggaattcaaaacccttaataatttaacgttcccgggcggggtttggtgggaaaacaaaaattggaaa

SEQ ID NO: 50466 - protein, 36 aa, Zea mays
  misc_feature: Ceres CLONE 1463050-F
MGSPVTVAAVMARLTAHPGASARACCELSRVLESVV

SEQ ID NO: 50467 - DNA, 869 bp, Zea mays
  misc_feature: Ceres CLONE 1463051-R
  misc_feature (851)..(851): n is a, c, t, g, unknown, or other
tcgaggtcgacggtatcgataagcttttttttttttttttttgatgcagatatcaacactcctttatcaaactctcatactatatacacagtgttactacgcacttgacagttctgtttccttgggcgttaaaccaaagtcgaacaagtataggttgcaaggtccaacagagcgggaagcaagtacttcctcccgttggcaccattggcattgtagctcacccccgtcgtgccgtccacggccaggttgtctgcgaaaccggggtatgcgccgctgccatagacccccgtgcaggcggtggcggcctctacccgctcatcattgtcggcctggtagaacccgtctcggaacgggttggttaccgcgccggcgaccatgctggcgatgttgaccaccatgccatcacatgccgacgtcgccgctaggtggcacgagcgcctggcgcctggggcccgtacaggcggctggtggaacggccacgcgcactgcccggggcactgcttttcggcgttgccgacccaaacgtaggcggcctcagcacccgggcatcggagacatgcaagtcgcatcggcctcggtgaaaaaccgtccacggcccacttcttgcgcggtgtaccactaacacgacgccgccctttcggcgccgggcccaggtccgcgccgcccagctgaggcaacttgggaacaggaggggagggctctttccccagtggaagcaccctttggtctgggggcccttgttccaaggaagggccaacctgtggtgtttggtcacaagccggcccgtttcgtgggctttttggaaaggggaaaaaggtgggtgttcaagagggggcccctcacccaatggnaaatccgggagaacgggg

SEQ ID NO: 50468 - DNA, 1313 bp, Zea mays
  misc_feature: Ceres CLONE 1463051-R2
  misc_feature (11)..(11): n is a, c, t, g, unknown, or other
  misc_feature (69)..(69): n is a, c, t, g, unknown, or other
  misc_feature (817)..(817): n is a, c, t, g, unknown, or other
  misc_feature (863)..(863): n is a, c, t, g, unknown, or other
  misc_feature (936)..(936): n is a, c, t, g, unknown, or other
  misc_feature (1217)..(1217): n is a, c, t, g, unknown, or other
tctttactttncatagaaattaaataggagaacttacggaatgccaagaaaggtatttttgggggccgncgcgggggattcacactcgctttataaaactctcatactatatacacagcgttactacgcacttgacagttctgtttccttgggcgttaaaccaaagtcgaacacgtagaggttgcagggtcgaacagagcgggaagcaagtacttcctcccgttggcaccattggcattgtagctcgcccccgtcgtgccgtccaccgccaggttgcctgcgaaaccggggtaggcgccgctgccgtagacccccgtgcaggcggtggcggcctctagcggcgcatccttgtcgccctggaagaacccgtctcggaacgggttggtgactgcgccggcgaccatgctggcgatgttgaccaccatgccatccatgccgacgtcgccgctcggtggcacgagcgccggcgcctggggcccgtacagcggctggtggaacggtcacgcgcactgcccggggcactgcgttttcggcgttgcccaacccaaacttaagacggccccgggccccgggcgatcggaaccgattcagggcccccattgtgcttctgtgacgagaattctgtataacgggcgccacgttccctgtttatagatgaaggaaacctaaggtaacgaaaatttatatccccttataggacgtgctcggggcccgcgtcgacccggcggggccgtaccagaacgtatagaaaggttaagtaatctttagggtaaccatcagccctacagaaaagtgttgcgcgtctgtattcttctcnggaaatagataagtataagttaaagaccgtggttgtctctctcttntcatcttgattttttctttctcactctcttattgcaaacggcatagatatctgaaaaacagtgtgtgtataanagatgccgtcgggcgctcaaagaatttatatttgtcccctttctaggcagcgccaaaatagtggtgtgatgtggttataagagtatagagatattatataattcccatgatgttgattaacaagatatctcttgagcgtatctatctagtagatttgtgacccgcgcccagaatacccacacccccgcgtgacttaatgctaggcatacctaccgcgggagatactatatttctgcacaactcctcaggctagattcgtgatgactttgtcccgcagaganttatttatctatctgcgtgacatcatcacattacgctattgcatgtccagatttatccccctacctttaaaatcactactgtatggcagactacta

SEQ ID NO: 50469 - DNA, 771 bp, Zea mays
  misc_feature: Ceres CLONE 1463054-F
  misc_feature: Encodes the peptide sequence at SEQ ID NO. 50470
  misc_feature (642)..(642): n is a, c, t, g, unknown, or other
  misc_feature (647)..(647): n is a, c, t, g, unknown, or other
  misc_feature (708)..(708): n is a, c, t, g, unknown, or other
  misc_feature (717)..(717): n is a, c, t, g, unknown, or other
  misc_feature (727)..(727): n is a, c, t, g, unknown, or other
  misc_feature (734)..(734): n is a, c, t, g, unknown, or other
  misc_feature (739)..(739): n is a, c, t, g, unknown, or other
ctggagctccccgcggtggcggccgctctagaactagtggatcccccgggctgcaggaattcgcacgagaccattacctagaacatcctaatcgaaaaaactgtcacggccgcttccagcacgcatcattctcgtctcccgtctcgagagattgcagggggcggcgctcgaagctggaggaagcggacgggttcgcgatggggtccgagggatcctcgggtccggtcgtcgttcccagaaactttaggctgctagaagaactagaacgtggtgagaagggcattggtgatggaactgtgagctatgggatggatgatgctgatgacatatatatgcggtcctggacaggaactataattggtcctcccaatactgttcacgagggacgaatctaccaattaaagctgttttgtgatacagattatccagataaaccaccgacagtccgattccagactcggatcaatatgacatgcgtgaaccaagaaactggattggtacttgtgcatttttgtttcttacagcgtgcaacctgggccagggcatttacgaatgatattaggcccattgcttagctagcactttttctaggttgaaccaagtctatttcctatgcttgggcagtggggaagggaacatacnatggnagacatcctggccagcttaaaaagggagatgtccactcctcagaaacgcaggctgtaccancctcatgangggtacgaanatccaanagtanagcagaaagggctgtccccttagatgtgtcgc

SEQ ID NO: 50470 - protein, 125 aa, Zea mays
  misc_feature: Ceres CLONE 1463054-F
  misc_feature (17)..(118): Pfam Name: UQ_con Pfam Description: Ubiquitin-conjugating enzyme
  misc_feature: SWISSPROT Homolog: EC 6.3.2.19 Ubiquitin--protein ligase
MGSEGSSGPVVVPRNFRLLEELERGEKGIGDGTVSYGMDDADDIYMRSWTGTIIGPPNTVHEGRIYQLKLFCDTDYPDKPPTVRFQTRINMTCVNQETGLVLVHFCFLQRATWARAFTNDIRPIA

SEQ ID NO: 50471 - DNA, 742 bp, Zea mays
  misc_feature: Ceres CLONE 1463057-F
  misc_feature: Encodes the peptide sequence at SEQ ID NO. 50472
tggagctccccgcggtggcggccgctctagaactagtggatcccccgggctgcaggaattcgcacgagaccattacctagaacatcctaatcgaaaaaatttttctccagccgccgcgctcctgatccttatctctgcgcgcgctgcatcggcgcccgccgggaggcggatcccgcccgcctcgtccatgttgtgggtccgcaatatccgccgcttcgtcgacacgggcgccggcctcggatccgaggccatcatggaactggagactaaaaggatattgcttgagattttcaaggagcggcagcggaagagtgccgaggctggttccatcccaagtttttacaagaaacctgaagaaggatccattagctctagagttcaaaggttggccaagtacaggtttctaaagaaacaatcagagcttctgctgaatgctgatgatcttgatgccatgtgggtttgtctcaaagaaaattgtgttattgatgatgctactggtgctgaaaaaatgatttatgaagatttctgccatatcgccccagtctgcactgagtagattggtcagaaatgcaaacgatttttcagccctttcaacttcatgaagtctgcacggaacacttgcacatattgtttggctaataacaaaaatatctcagggttttggtttgaatttaaaggaccctatgtataaaatatgatgggccccctttatattaaattaattattttttataaaatatgg

SEQ ID NO: 50472 - protein, 184 aa, Zea mays
  misc_feature: Ceres CLONE 1463057-F
GAPRGGGRSRTSGSPGLQEFARDHYLEHPNRKNFSPAAALLILISARAASAPAGRRIPPASSMLWVRNIRRFVDTGAGLGSEAIMELETKRILLEIFKERQRKSAEAGSIPSFYKKPEEGSISSRVQRLAKYRFLKKQSELLLNADDLDAMWVCLKENCVIDDATGAEKMIYEDFCHIAPVCTE

SEQ ID NO: 50473 - DNA, 656 bp, Zea mays
  misc_feature: Ceres CLONE 1463121-F
  misc_feature: Translation starting site: 460
aagctggagctccccgcggtggcggccgctctagaactagtggatcccccgggctgcaggaattcgcacgagaccattacctagaacatcctaatcgaaaactaaaccctacccgactccgccgccgctcccgctccgccccagcgcatcgcccgccgccacagcgtaccgcgacctcatctatcaccttcagctttcaatcatggcggacgtcgatgtcgaaccggaggttgccgccggagctcccaagaagaggacgttccgcaagtacagctaccgcggcgtcgacctagatgcgcttctcgacatgtccactgacgacctcgtccagctcttccccgcgcgcgccaggagaaggtcatctcatccctgacggcttccctgaggttcgatggtgctctgaacgttgatgtgaacgagttccagaccaacctggtgccctacccgaggatccacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggc

SEQ ID NO: 50474 - DNA, 655 bp, Zea mays
  misc_feature: Ceres CLONE 1463134-F
  misc_feature: Encodes the peptide sequence at SEQ ID NO. 50475
aaagctggagctccccgcggtggcggccgctctagaactagtggatcccccgggctgcaggaattcgcacgagaccattacctagaacatcctaatcgaaaagtttcctcctccattccctcccccccgcctccactaccccactcccaggcgccgcacaagtacgtcgccggcggcgatgaacaacgcgcttccagaataaccgcaagaagcgcggccacgtgtccaccgggcacggccgcatcggcaagcacaggaagcatcccggaggtcgcggtaacgccgggggcatgcaccacccccgcatcctcttcgacaactaccatcccggctacttcgggaaggtcggcatgcgctacttccacaagctccgcaacaagttctactgccccgcgctcaacatcgagcgcctctggtcgatggcgcccgccgaaaaggcggctgaagccggcggcgacaatgccccgcatatcgacgtcacgcagttcgactacttcaaggtgctcgggaagggggtgctgccacccaagcccatcgtcgtcaaggacaagctcatctccgaggtcacccagaagaagatcaatggcgccggcggcagcgtcgtgctcaccgcctacttttcattccttattcccctcttagatttgagatctat

SEQ ID NO: 50475 - protein, 121 aa, Zea mays
  misc_feature: Ceres CLONE 1463134-F
MHHPRILFDNYHPGYFGKVGMRYFHKLRNKFYCPALNIERLWSMAPAEKAAEAGGDNAPHIDVTQFDYFKVLGKGVLPPKPIVVKDKLISEVTQKKINGAGGSVVLTAYFSFLIPLLDLRS

SEQ ID NO: 50476 - DNA, 660 bp, Zea mays
  misc_feature: Ceres CLONE 1463135-F
  misc_feature: SWISSPROT Homolog: EC 2.4.1.12 Cellulose synthase (UDP-forming)
  misc_feature (660)..(660): n is a, c, t, g, unknown, or other
aaagctggagctccccgcggtggcggccgctctagaactagtggatcccccgggctgcaggaattcgcacgagaccattacctagaacatcctaatcgaaaaatctcttctctctcactcccatctcttccaccaggacgaagccgccgccgcctctgccagcgcacccgcctcgcccccgctcgctgcggccgcctctgccagcgcacccgccccgcccccacccgccgcggccgccctcgcccgttgctctcgccgacgcggccacctccggccccgcccgccgtggccgccctgctgtacggctacaagaacaacaacctcaagtggctggagcgcttcgcctacatcaacaccaccatctaccccttcgccttgctcccactgctcgcctactgtaccctgccagccgtctgcctcctcaccggcaagttcattatgccgtcggtggatgcgtgcaggtcacaggatcttcaggggctgtagcctgcaggaaaagagggcttttgataatactgagagatgagataatgaatttggtggccgagcctcacatggtgatggtgatccttgtaccttgtccttctctggttcatccataggcgcatgagaggctgctgcatttatcatcgggggctatccgggtctggaccggagctn

SEQ ID NO: 50477 - DNA, 658 bp, Zea mays
  misc_feature: Ceres CLONE 1463148-F
  misc_feature: Encodes the peptide sequence at SEQ ID NO. 50478
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (131)..(131): n is a, c, t, g, unknown, or other
  misc_feature (363)..(363): n is a, c, t, g, unknown, or other
  misc_feature (381)..(381): n is a, c, t, g, unknown, or other
  misc_feature (394)..(394): n is a, c, t, g, unknown, or other
  misc_feature (461)..(461): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaagctgggactccaccgncggtgggcggccgctctagaactagtggatcccccgggctgcaggaattcgcacgagaccattacctagaacatcctaatccaaaaatcaaagaaaataactcgtgaggcaatttcagcttttgctgtgtcacccaacggtgctcttcttgcaattggaacaatagaaggaagcatcatcatagttggctcaaaagacatgcggacacttgtaaacagtaaaaaggctcatnctggtatttgtactacgntgaccttctctcnaggatcagaaacatgctgtcacttccttcgactcttctgcaagggtgacatctgttgggtccctaanaagtaatggaacaagcatatgggccatgctaactagttggtattccttgcaattttgggggactacgtggaggccgcccaaaaaaaaaatttttggcaatgtttccaccctttaaaaaaaatttttggttcaacccccctgaacgggtttaacctgggtggagaaaaataaataaaggggtttctctccaaaaaaaa

SEQ ID NO: 50478 - protein, 45 aa, Zea mays
  misc_feature: Ceres CLONE 1463148-F
  misc_feature (12)..(12): Xaa is any aa, unknown, or other
  misc_feature (18)..(18): Xaa is any aa, unknown, or other
  misc_feature (22)..(22): Xaa is any aa, unknown, or other
  misc_feature (44)..(44): Xaa is any aa, unknown, or other
MRTLVNSKKAHXGICTTXTFSXGSETCCHFLRLFCKGDICWVPXK

SEQ ID NO: 50479 - DNA, 680 bp, Zea mays
  misc_feature: Ceres CLONE 1463161-F
  misc_feature: Encodes the peptide sequence at SEQ ID NO. 50480
  misc_feature (380)..(380): n is a, c, t, g, unknown, or other
  misc_feature (435)..(435): n is a, c, t, g, unknown, or other
  misc_feature (443)..(443): n is a, c, t, g, unknown, or other
  misc_feature (447)..(447): n is a, c, t, g, unknown, or other
  misc_feature (452)..(452): n is a, c, t, g, unknown, or other
  misc_feature (510)..(510): n is a, c, t, g, unknown, or other
aagctggagctccccgcggtggcggccgctctagaactagtggatcccccgggctgcaggaattcgcacgagaccattacctagaacatcctaatcgaaaaaatttcagtcatgaaggcccaggtcgcagcagcaactgtcttggtcttgctcctcctgacctttgctgcggaggctcgtacgtgcatgtcgcgaagccaggaacagaaagggaggtgctttcacgatacggattgtgccgccgtctgcgtcaaacagagcttcaccggaggcttatgcaatgggcggccgccgttcaagcagtgcttctgcactaatccatgcaagagagagagagctgatgctacactccggtcgtcaggcctctgatcatgttgtgntagatccggatgacagcgcgactctcggttgtatgcctaggttgacgcgaatgtnatagatanaccnaatantaaatgacatgttttttcttacttgaaagtcaagcgattttgtttatctgaccgggantgtgtccccaacaaaaaaaaaaaaaaaactttatcaatacccttcaaccctctagggggggggcccggtaacccaattccccccttataagcgagtcgtaattacagccacgcctcaccgcgccagtcccttttataaagggagaggtggattgagcaaaagacccttgg

SEQ ID NO: 50480 - protein, 85 aa, Zea mays
  misc_feature: Ceres CLONE 1463161-F
  misc_feature (23)..(71): Pfam Name: Gamma-thionin Pfam Description: Gamma-thionin family
MKAQVAAATVLVLLLLTFAAEARTCMSRSQEQKGRCFHDTDCAAVCVKQSFTGGLCNGRPPFKQCFCTNPCKRERADATLRSSGL

SEQ ID NO: 50481 - DNA, 657 bp, Zea mays
  misc_feature: Ceres CLONE 1463183-F
  misc_feature: Encodes the peptide sequence at SEQ ID NO. 50482
aaagctggagctccccgcggtggcggccgcttttcaactagtggatcccccgggctgcatgtattcgcacgagaccattacctagaacatcctaatcgaagacacagccacgagccaagcgcgacggatcccaatccatcttctcctcatccccaccacgaccaaaaaaaaatccggtcgccgatgccgtctgctgcctgacatcggtcagccagggtaaatcgcgcaggcaggcaggcagccccacacacatacgaaacccaatcctgcttcgatcccgtcggccggcgatggagggccggcggccgggcgcgcccgtggcgggcctgcccatcggcttccgcttccgccccaccgacgaggagctgctgctgcactacctccgccgcaaggcgctggcctgcccgctccccgccggcgtcatccccgacgccgacctcgcgcgcctccacccgtgggacctcctccccgccgccgccgccgcaccagggggatccggagccgacaccgacggggagcgcttcttcttccaccgcccggtgacgcggtgctggcgaaagggcggcggggcgcccaggggagccggcaccggcgtctggaggccgtccggcaaggacaccctcgtcctgtccccgcgctgcaagcggcccgtcggca

SEQ ID NO: 50482 - protein, 122 aa, Zea mays
  misc_feature: Ceres CLONE 1463183-F
  misc_feature (13)..(122): Pfam Name: NAM Pfam Description: No apical meristem (NAM) protein
MEGRRPGAPVAGLPIGFRFRPTDEELLLHYLRRKALACPLPAGVIPDADLARLHPWDLLPAAAAAPGGSGADTDGERFFFHRPVTRCWRKGGGAPRGAGTGVWRPSGKDTLVLSPRCKRPVG

SEQ ID NO: 50483 - DNA, 656 bp, Zea mays
  misc_feature: Ceres CLONE 1463185-F
  misc_feature (574)..(574): n is a, c, t, g, unknown, or other
aaagctggagctccccgcggtggcggccgctctagaactagtggatcccccgggctgcaggaattcgcacgagaccattacctagaacatcctaatcgaaaaacaggcactcctttcgcctcatagagagtaatcaccatggggagagaaggtagaagggagtagaggtctagggcgttgccgacgtcgtcttctgccatcacgtcatccagtgctcgtgtggaggtcctggggaaccaacgtgccgtaagggacctgggcgaacctctctcgtgcaaggattcggccgggctcgccgggaatttctcactgacgcaagccactgccgtggatcgagctctgctgtggccggagcgctacgcgacagaccctctggtgaagagcaggtggcctcggaggaacactactacgaggagtttgacgaggtctaggagtcgtctcccagtcgacttaatggcgtcaaggaaataatattagttcattttatttttatcagttattttgtaagacattctcgttatgtaataatgtttgtgacatttaaaaaaaaaaaaaaaaaagcttatcgataccngtcgacctcgagggggggcccggtacccaattcgccctatagtgagtcgtattacgcgcgctcactggccgtcgttttacaa

SEQ ID NO: 50484 - DNA, 782 bp, Zea mays
  misc_feature: Ceres CLONE 1463186-F
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (53)..(53): n is a, c, t, g, unknown, or other
  misc_feature (55)..(55): n is a, c, t, g, unknown, or other
  misc_feature (385)..(385): n is a, c, t, g, unknown, or other
  misc_feature (401)..(401): n is a, c, t, g, unknown, or other
  misc_feature (455)..(455): n is a, c, t, g, unknown, or other
  misc_feature (506)..(506): n is a, c, t, g, unknown, or other
  misc_feature (526)..(526): n is a, c, t, g, unknown, or other
  misc_feature (543)..(543): n is a, c, t, g, unknown, or other
  misc_feature (550)..(550): n is a, c, t, g, unknown, or other
  misc_feature (551)..(551): n is a, c, t, g, unknown, or other
  misc_feature (649)..(649): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (672)..(672): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (692)..(692): n is a, c, t, g, unknown, or other
  misc_feature (695)..(695): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
ttgtttggggtggnnncnnnnncagtctctcacgacccctcccattaatcttngngggaaaactggaactccaccgcggtggcggccgctctttaactagtggatcccccgggctgaaggattttcgcacgagaccattacctagaacatcctaatcgaaaaatatgaaaattcacaacttggtggagccaataataacatcttgaaagatctcactggagattttgagacatacttccataatcttcagtatgcgcaagggttccagcaagataatccagtaaacacgttttcctctggaaggcctgctccaccatccctgcaatgtaaaaaaacgtgcccttcaaatggtcttggaagaaaaaaccaatatttttatgctaancttgaaaggtgcaganccattgcccttctttgttatttttgttttttttgttggtgggtgttttcctttnttccaactgtatgttttttgtgggtttgtggtgtgcaaccccgccggcgcnaacccttttttttttcgagnccgggtgcattgggggnctaattnnggttagctggaggggacgtgtgggaggggggggaagaaaaaaaagagagggcgttggggatatttaacaagacgcctcacaacaccacgaccagaaancannnacgacccctgacacattnggacaacgaggnnnntgccnttngggggggttaggagaagttcgaggtgcccactacccagggcaaccnnncaaaatccgcactgcgtaccctccaccaacgaaatccac

SEQ ID NO: 50485 - DNA, 537 bp, Zea mays
  misc_feature: Ceres CLONE 1463189-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (138)..(138): n is a, c, t, g, unknown, or other
  misc_feature (142)..(142): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttnnnnnnncccaaagctgggactccccncggntgggcggccgctctagaactagtggatcccccgggctgcaggaattcgcacgagaccattacctagaacatcctaatcgaaaaaccaccacgcggatgggctcgggcgacccggcggccgaccccctttcttccttcctccgccaccccgggcgcgttctcctttctccccgtcgcgtcgcccatggccgcgggggacgccaaccggccaaaattcccgtgggcaaggggtttccggcccccttggggttccgtttgaaccctttcccttccccggtttcccctgggggggggcccctccccctaaaatgggcccggccccccaaggtttttttttggcccccttccggggttttaaagggggggattttttacacgggggggtttccccccacc

SEQ ID NO: 50486 - DNA, 651 bp, Zea mays
  misc_feature: Ceres CLONE 1463195-F
  misc_feature: Translation starting site: 174
gcggtggcggccgctctagaactagtggatcccccgggctgcaggaattcgcacgagaccattacctagaacatcctaatcgaaaagaggaggcggccggttcggtactgagtgctgagttgttgaccaacgggaagtccagtacccaagcggagccaccaaggaaaggaggaatggaagccaccggcgcagcctcgcagccctcggcgccgcagacaactcacccggcggtggcgccgctggccttcctactggggaagtggcgcggggaaggcgagggcagcttccccaccatatcctccttccggtacggcgaggagctcctcttctcgcatcatccctccaaggcgtgtggccctctctacctgcgatgtttctctcgcgagaaaatcttcccttcggctgccaaattcttagagctttttctttggcttacggatcggcggtggtgggtggctgcagccagtgatctcgtacacgcagaagacgtggaagacggcgtctggcgagccgatgcacgccgagagcgggtactggcggccccgccctgacggctccgtcgacgtggtcatcgctcagagcactggcctcgccgaggtccagaagggttcatttgatgctgaaaagaaacagtgacactccaagcggact

SEQ ID NO: 50487 - DNA, 702 bp, Zea mays
  misc_feature: Ceres CLONE 1463202-F
  misc_feature: Encodes the peptide sequence at SEQ ID NO. 50488
  misc_feature (35)..(35): n is a, c, t, g, unknown, or other
ccgagacacgagaacaccagcaacaaccctcaaanaattgtccataccacccttacccccaaataccaccccccacgggggcggccgctctataacagtggatcccccgggctgcaggattacgcacgagaccattacctagaacatcctaatcgaaaaaaataataaagccgccatgcgtgtgcccggcactgcacaacatccatcgtccatcgacccacccaacctcctcctccgccccgcgcttcgcctgggtaccggcgtccgccgcgccccgtaccgtctcgtccaggaacaggaagagcagtaacccatccacccatccatcggggatcaccaggggtcaggggagcaagatgtcgactgccaccgccccaagattgcccgctcccagatccggggcaagctatcactatcagacgaccgcggctccggcggccaacaccctctccttcgccggccacgcgaagtaggaggcccgcgcgtccgggccacggctgtccagcaggttcatggcttccgccgcggcgcgtgctgcccaaggtgaagctggtctgcccggaccggacggagcacaagttcgaggccccccaccacatttacatcctcgacgcccgtgaaaacaccccggccggaacctgctcttttccccccccgccggggccccgccccacttgtccccaggaagcaacatccccccgc

SEQ ID NO: 50488 - protein, 38 aa, Zea mays
  misc_feature: Ceres CLONE 1463202-F
MSTATAPRLPAPRSGASYHYQTTAAPAANTLSFAGHAK

SEQ ID NO: 50489 - DNA, 670 bp, Zea mays
  misc_feature: Ceres CLONE 1463208-F
  misc_feature: Encodes the peptide sequence at SEQ ID NO. 50490
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaaaggaaaaaacaatggcggtgctactccgccgcgccgcggcgctcctcgtcgtcgctgctgtctgcgcggacggcgcctccacgttctactcctccgaccccaacctcggatccgcccgcgtcgtcttccagacgaattttggtgatattgagtttggcttctttcctcatgttgcacctaagactgtcgaacacattttcaaacttgtgcggcttggatgctacaacacaaatcacttcttccgggttgacaagggtttcgttgcacaagttgctgacgttatgtcaggtcgaaccgcccctatgaatgaggagcagaaaaaccaccccnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 50490 - protein, 106 aa, Zea mays
  misc_feature: Ceres CLONE 1463208-F
  misc_feature: SWISSPROT Homolog: EC 5.2.1.8 Peptidylprolyl isomerase
MAVLLRRAAALLVVAAVCADGASTFYSSDPNLGSARVVFQTNFGDIEFGFFPHVAPKTVEHIFKLVRLGCYNTNHFFRVDKGFVAQVADVMSGRTAPMNEEQKNHP

SEQ ID NO: 50491 - DNA, 669 bp, Zea mays
  misc_feature: Ceres CLONE 1463216-F
  misc_feature: Encodes the peptide sequence at SEQ ID NO. 50492
  misc_feature (404)..(404): n is a, c, t, g, unknown, or other
  misc_feature (483)..(483): n is a, c, t, g, unknown, or other
  misc_feature (524)..(524): n is a, c, t, g, unknown, or other
  misc_feature (532)..(532): n is a, c, t, g, unknown, or other
  misc_feature (563)..(563): n is a, c, t, g, unknown, or other
  misc_feature (578)..(578): n is a, c, t, g, unknown, or other
gcggtggcggccgctctagaactagtggatcccccgggctgcaggaattcgcacgagaccattacctagaacatcctaatcgaaaagaggaggcggccggttcggtactgagtgctgagttgttgaccagcgggaagtctcagtacccaagcggacccacctaggaaaggaggaatggaagccaccggtgcagcctcgcagccctcggcgccgcagacaactcaccctgcggtggagccgctggccttcctactgggtaagtggcgcggggaacgccagggcagcttccccaccatatcctccttccggtatggcgaggagctcctcttctcgcatcatccctccaaggcgtgtggccctctctacctgcgatgtttctctcgcgagaaaatgttatgtttggntgccacattcttagagctttttctttgggttattgatcagcggtggtgggtggctgcaaatagtgatttcgtactctcngaagacttggaagatggtttctggcgagccaattccccccnaaagcgcntactggaggaccggccctgacggcttccatngacccggttcctggnttataaacattggcctccctcgaaggccccccaaacggtttcattctgcacgctctcaaactaaaaccaggcgtacgccccccctgccccc

SEQ ID NO: 50492 - protein, 125 aa, Zea mays
  misc_feature: Ceres CLONE 1463216-F
  misc_feature (77)..(77): Xaa is any aa, unknown, or other
  misc_feature (117)..(117): Xaa is any aa, unknown, or other
  misc_feature (120)..(120): Xaa is any aa, unknown, or other
MEATGAASQPSAPQTTHPAVEPLAFLLGKWRGERQGSFPTISSFRYGEELLFSHHPSKACGPLYLRCFSREKMLCLXATFLELFLWVIDQRWWVAANSDFVLSEDLEDGFWRANSPXKRXLEDRP

SEQ ID NO: 50493 - DNA, 705 bp, Zea mays
  misc_feature: Ceres CLONE 1463238-F
  misc_feature: Encodes the peptide sequence at SEQ ID NO. 50494
  misc_feature (309)..(309): n is a, c, t, g, unknown, or other
  misc_feature (345)..(345): n is a, c, t, g, unknown, or other
  misc_feature (527)..(527): n is a, c, t, g, unknown, or other
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcgaaaaatctccaaacctctcacttgcacgggagcacgtacagtcgtacacgctgagccaaagcgatcggcgccgcggcgttaagacgtcggcgacggcgacgatgacgtggcacgaggacctggccactcacgtggggaacacgggcgttcgcctccccggcgccggaggccacgcgccggcggcggcgaatgttgctgcggcgggggccgnggtggtacgggcagcagaaacagggtacgacgcagncaccgtagctgaaaacggcgggtgcaagtgcggatgcaactgccagtgggacccctgcaattgtgggaagccacccacgtgcttccccccgcaggccgggccggaggaagcttcctaattattttaagctaattaaagtataccggggaccgctggggtgggtttccgagccgtcagttaanttaatttgacccccaagggttggccatgctctgaagcctcaacacctgggtttatccctcaaggaggagcgttttggtacccggaggacccccccntggccccctccgtggcccctcctcggccgccgacccccccgccgttgtgtgtcccccatttagcaccggatgcagccccccc

SEQ ID NO: 50494 - protein, 87 aa, Zea mays
  misc_feature: Ceres CLONE 1463238-F
  misc_feature (37)..(37): Xaa is any aa, unknown, or other
  misc_feature (49)..(49): Xaa is any aa, unknown, or other
MTWHEDLATHVGNTGVRLPGAGGHAPAAANVAAAGAXVVRAAETGYDAXTVAENGGCKCGCNCQWDPCNCGKPPTCFPPQAGPEEAS

SEQ ID NO: 50495 - DNA, 635 bp, Zea mays
  misc_feature: Ceres CLONE 1463247-F
  misc_feature: Encodes the peptide sequence at SEQ ID NO. 50496
ggagctccccgcggtggcggccgctctagaactagtggatcccccgggctgcaggaattcgcacgagaccattacctagaacatcctaatcgaaaaattcggtttgggtctttctttcagttctccaatgtggcaatgtcagcacagcccgagcccaaggcggcaaggcccaccagtggaaaccctatcccgattcccgtggccgccgcctgccagacgccacgccagccttgcccttgcccgtggccgccgcccgccagcgccagccgccttcgccgttcgccctgtcggctgacggctgtcgcccagcgccggagcgccccaagtccccaaccggccaacccatacgtggagacgccaagcccagtcactccctctcgcggtcgcgggtcgcgtcacgcggtcggcagtcccgccgccgcgggcttgcggctgtctcctggctgcaggctgctcgctcgctcgtgtgttagtgtgtgctggactgctggctcatcgttgatcaacaaagcaagttgcaagcggtgaaagcgactgcgctggtgtctctgtccggctagctccaagctcctcgctcctgcggctacaaggaccatgacagggagagatgaaagctccgaccgtagttcggcgtg

SEQ ID NO: 50496 - protein, 130 aa, Zea mays
  misc_feature: Ceres CLONE 1463247-F
MSAQPEPKAARPTSGNPIPIPVAAACQTPRQPCPCPWPPPASASRLRRSPCRLTAVAQRRSAPSPQPANPYVETPSPVTPSRGRGSRHAVGSPAAAGLRLSPGCRLLARSCVSVCWTAGSSLINKASCKR

SEQ ID NO: 50497 - DNA, 633 bp, Zea mays
  misc_feature: Ceres CLONE 1463252-F
  misc_feature (214)..(214): n is a, c, t, g, unknown, or other
  misc_feature (234)..(234): n is a, c, t, g, unknown, or other
ccccgcggtggcggccgctctagaactagtggatcccccgggctgcaggaattcgcacgagaccattacctagaacatcctaatcgaaaaaagaaaagaaagaagagagagagagagagagagtcgtttcctttcctcgaacttattccatggagacctcttctcacaagcgggcgcgggaggcggtcgatctcgccgcccgcgcccgccgcgncggagaagcccgtgtggccngatccccacgcaaagaagctggcggccgcaggacctgctcgaactgctcgagggacaaccccaacgcgggcggcgcccgggaacctgggttccgtcttggggaacctggaagagagaaaataacccccttcaacaaagcccccggaagggggccccctcccaaaaacccggaaattggggtttccttgtctaaggcccccaaaaaaaaaaatttggggccttcccccccccagaatccccccccccctccttttaaagaggggcggggttcccgggcccccccaaaaaccccccccccccccggggggggggggttttttagggaaaatatgggtgctcttttaaaaaaaaatttcgggggggtttttttgggggttctccccccccaaggggcccccc

SEQ ID NO: 50498 - DNA, 795 bp, Zea mays
  misc_feature: Ceres CLONE 1463254-F
  misc_feature: SWISSPROT Homolog: EC 1.11.1.15 Peroxiredoxin
  misc_feature (1)..(1): n is a, c, t, g, unknown, or other
  misc_feature (2)..(2): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (422)..(422): n is a, c, t, g, unknown, or other
  misc_feature (425)..(425): n is a, c, t, g, unknown, or other
  misc_feature (585)..(585): n is a, c, t, g, unknown, or other
  misc_feature (589)..(589): n is a, c, t, g, unknown, or other
  misc_feature (592)..(592): n is a, c, t, g, unknown, or other
  misc_feature (617)..(617): n is a, c, t, g, unknown, or other
  misc_feature (662)..(662): n is a, c, t, g, unknown, or other
  misc_feature (679)..(679): n is a, c, t, g, unknown, or other
  misc_feature (687)..(687): n is a, c, t, g, unknown, or other
  misc_feature (688)..(688): n is a, c, t, g, unknown, or other
  misc_feature (735)..(735): n is a, c, t, g, unknown, or other
  misc_feature (768)..(768): n is a, c, t, g, unknown, or other
  misc_feature (776)..(776): n is a, c, t, g, unknown, or other
nnccttaggttaaataaaccgccccggaggggggggccaaanggtggggnnnnttaaagctggagctccccgcggtggcggccgctctagactagtggatcccccgggctgcaggaattcgcacgagaccattacctagaacatcctaatcgaaaagaattagggtttcccagtctttggacgaggacgacgacgaagatcaccaccccctgctcacccaggcgttccctcctgatcttcgatggctcccatcgctgtcagtgacgccctcccagaaggccaattcgggtggtttgactataacgagtacttgcagatggtctccgaccgcacgcgttacttccggtaatgaggtcatccctcttcagctcgcctggagctttctccccgacctggcagcaccagaatgatgcagggcttcntcnctgtgggttaagaggattcatgcccactgggaagcaggagactcgggcttattgttggttactgactccgtttcgccattgagggcggtgggggaatgaactagcctggaagatcagggatggtggaaattaccaagctggaccctacccgggtagcggngggnaanaaagccccgcaggccttaggggttnagaaataaggggaaaaaaagagccttgagagtttgtttctcaagnaaaagggaaagattccncggggggnnggatccccccaacggcgggtctcccccacgggcaaaccccccctaanaaaacgggcagggtgggtggtaggaaaaaaccntgggacgntaggcctagactcccttag

SEQ ID NO: 50499 - DNA, 673 bp, Zea mays
  misc_feature: Ceres CLONE 1463311-F
  misc_feature (403)..(403): n is a, c, t, g, unknown, or other
tccccgcggtggcggccgctctagaactagtggatcccccgggctgcaggaattcgcacgagaccattacctagaacatccaatcgaaaaatattatattcgcgcaccatcgcagcaacttgcacgggcgccgatgactagttgcgccagatgcactgcatctgctcggcgtggtgcctccaacgtccaacccctcttcctcttgtctctcgtctacctctcttctgcccctctgcgtccgtgtctccatcgtcttcgctgcgtgaggttgacgacgaccagtcacaggatctgttcgttcctcatgcgacccagctagctaaaactggcatgcatggacatgctacgctgctgcgtcaatccatctcaccagggctagctagctagatctggtctgattagncgccccaccgggggggagacggagtgcttcacctcaaagactgctagtggaaggctgggtacttacctgtgtgcctgtgtccagtgcgcactggccactgcctgcccggccccttggcctcaaaatggccgcccaccccatgccaggaggcttccgcctgaaaccaacccctcccgggggggccgccctcgtttcccccgggttcttgaccccccggaaactaagaagcataacccgggccggacgaccttcggccaattgttccacccc

SEQ ID NO: 50500 - DNA, 652 bp, Zea mays
  misc_feature: Ceres CLONE 1463339-F
  misc_feature: Encodes the peptide sequence at SEQ ID NO. 50501
ccccgcggtggcggccgctctagaactagtggatcccccgggctgcaggaattcgcacgagaccattacctagaacatcctaatcgaaaaatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcacgctcgaggaggcccgcagcctcgtcgaccacctccaggagcggctcggcgtcaccgccgcggccttcgcgccggccgccgtcgtcgcggcgcccggggcgggcggcggggccccgtcccaggaggaagcccccgtccaaaagacggagttcgacctgatgatcgaaaaggtgcccagcagcgcgcgtaccgccactatcaaaggggggcgcgccctcaccagcctcgggttcaaggaggccaaggacccttatcgaagggtctcccccaagaagggccaagga

SEQ ID NO: 50501 - protein, 160 aa, Zea mays
  misc_feature: Ceres CLONE 1463339-F
MASTTLSSAFTLLSRPSTSPCPAASLPRSSHAAPHIRRGRRAVAVACTATESPKILELGDAIAGLTLEEARSLVDHLQERLGVTAAAFAPAAVVAAPGAGGGAPSQEEAPVQKTEFDLMIEKVPSSARTATIKGGRALTSLGFKEAKDPYRRVSPKKGQG

SEQ ID NO: 50502 - DNA, 641 bp, Zea mays
  misc_feature: Ceres CLONE 1463342-F
  misc_feature: Encodes the peptide sequence at SEQ ID NO. 50503
gcggtggcggccgctctagaactagtggatcccccgggctgcaggaattcgcacgagaccattacctagaacatcctaatcgaaaaattgccatccatcacatcctctcccaccttactcaagctagtgcgagcatagcaatggggttcgcccggaagagtggagttgcagcagtaggggtttggtggctcctcctgctcgccggcgtgctgttgcctttggcggcggcatttggccggcacgccgatgccggcaacgacatgtgcgacatcaagtgccagcatcacagcgacccggccaggaggcagcagtgcgtggatgagtgccatagccgggagcaccatcaccctagcagagagttttgcgagatgaagtgccagcaccaccaggaccctgcaaggaaagagatctgcgtacagcagtgcatgagctatggtctcagccaccgtgcgagtgccagtgttgttgatgagggtgaaaagcgcttccatggctgggaaacgacggtggccggaggaatcctcgaggcggtgtgacgacgtacgacgttatataacagtacgtcataattaataaaataagctacacccgcgtttcccttatatatatgtcttgctatgcatagagatatcatggcaaag

SEQ ID NO: 50503 - protein, 131 aa, Zea mays; identical to SEQ ID NO: 16978
  misc_feature: Ceres CLONE 1463342-F

SEQ ID NO: 50504 - DNA, 641 bp, Zea mays
  misc_feature: Ceres CLONE 1463344-F
cgcggtggcggccgctctagaactagtggatcccccgggctgcaggaattcgcacgagaccattacctagaacatcctaatcgaaaaagatagagctcgccgagcaagcaagcaagccaactcggccgtccgaacgaaagcgaagcgcggccaaactcactcgctaaacgctcccgttctcctccgcctgccccccaccgggctccccttgtacaccagcgccggagacgccatggcggcgggcgcagccgaagccgggccaaaggctgggccggtttgccgaaggcgcttccccttccccgccaacccttggattcccccccctttcccccgcgggaaaatctgacttgccttcgaaaaacccccctcttttggggggggggtgtgggggggacctttctttttccttcaaaaagaaacctttcccccccttttccagggggcgcctcccgggggaaaaaaggggggttttaaaaccttttcccttttttgccccctggggggggggagagggggaaacaaaatggcgcggctctttttttggcccacacccccccccctttctttttgaagaaggggtttttccccccaaaagagggcgcctttttttttttgtgccccccgcggggaccgcccccttt

SEQ ID NO: 50505 - DNA, 661 bp, Zea mays
  misc_feature: Ceres CLONE 1463359-F
  misc_feature: Encodes the peptide sequence at SEQ ID NO. 50506
  misc_feature (345)..(345): n is a, c, t, g, unknown, or other
ctggagctccccgcggtggcggccgctctagaactagtggatcccccgggctgcaggaattcgcacgagaccattacctagaacatcctaatcgaaaaacgctgtgagtgactcggtcgcatcttccccattctccatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaaactgcctcaggagcccttcaagtctgaagccgcgtcccgcgagaaaggtcatttctcatttccnagtggacggatggcaagcaagaaaagcccactgtccgcacagaaatcgatgacctagggctggcggcatggcgacattatcctttctacgatgatttgaaacgtctttgcaagtttcgggaaactgttatttagttggcttgattggaaacaaggccgaaagaaaaaatcctttttgcaaaaatggtctttttacaagggccggggggtttccttggcaaaatggccctggcccaccctaaaccaagctggggaactatggggaagggtttcttttttgggccaaaaaaaaaaaaaaaaagcttttcccttcccgc

SEQ ID NO: 50506 - protein, 70 aa, Zea mays
  misc_feature: Ceres CLONE 1463359-F
  misc_feature (9)..(54): Pfam Name: ATP-synt_Eps Pfam Description: Mitochondrial ATP synthase epsilon chain
MSATTAAVPFWRAAGMTYIGYSNICAALVRKLPQEPFKSEAASREKGHFSFPSGRMASKKSPLSAQKSMT

SEQ ID NO: 50507 - DNA, 672 bp, Zea mays
  misc_feature: Ceres CLONE 1463364-F
  misc_feature: Encodes the peptide sequence at SEQ ID NO. 50508
  misc_feature (1)..(1): n is a, c, t, g, unknown, or other
  misc_feature (266)..(266): n is a, c, t, g, unknown, or other
  misc_feature (381)..(381): n is a, c, t, g, unknown, or other
  misc_feature (382)..(382): n is a, c, t, g, unknown, or other
  misc_feature (402)..(402): n is a, c, t, g, unknown, or other
  misc_feature (429)..(429): n is a, c, t, g, unknown, or other
  misc_feature (431)..(431): n is a, c, t, g, unknown, or other
  misc_feature (454)..(454): n is a, c, t, g, unknown, or other
  misc_feature (456)..(456): n is a, c, t, g, unknown, or other
  misc_feature (457)..(457): n is a, c, t, g, unknown, or other
  misc_feature (672)..(672): n is a, c, t, g, unknown, or other
nataactggagctccccgcggtggcggccgctctagaactagtggatcccccgggctgcaggaattcgcacgagaccattacctagaacatcctaatcgaaaagaaactgctgcatttctgcttggcaggacaattgggaggccttatgttctttcaaatgcacagattaccctaagtttcaagcagtagctattgccatcaaaatatctggcttcaagatcgtgttggtaataaggatggtacctttacttccgttcaacagggnggacctacccgtaacacggaattcccgcccggaggaggaaaatacatgcccgccttcttggtttgggaatgatcccaatccttcctggctttgggttacttttcgaccccccccnnaagggggggggggggggcgnaccccccccccccaaaaaaaccccccncnctttgggtgggttccccccccgntnngggccattgtattttttgctggccccccctggttgtggggtgggtgaacaacccccaaaaaacttttttttagaaaaaacacttttggagaaaatttgcaacaatttgataaaaaaaaacccccccctttcccccggggacttccccccccgcccccattgaaaaaaaaattttggaaaaaaaaaaaatcccccccccccaatatctttttcgcn

SEQ ID NO: 50508 - protein, 88 aa, Zea mays
  misc_feature: Ceres CLONE 1463364-F
  misc_feature (10)..(10): Xaa is any aa, unknown, or other
  misc_feature (49)..(49): Xaa is any aa, unknown, or other
  misc_feature (65)..(65): Xaa is any aa, unknown, or other
  misc_feature (73)..(73): Xaa is any aa, unknown, or other
  misc_feature (74)..(74): Xaa is any aa, unknown, or other
MVPLLPFNRXDLPVTRNSRPEEENTCPPSWFGNDPNPSWLWVTFRPPPXGGGGGRTPPPQKNPPXFGWVPPPXXAIVFFAGPPWLWGG

SEQ ID NO: 50509 - DNA, 631 bp, Zea mays
  misc_feature: Ceres CLONE 1463380-F
  misc_feature (566)..(566): n is a, c, t, g, unknown, or other
tggagctccccgcggtggcggccgctctagaactagtggatcccccgggctgcaggaattcgcacgagaccattacctagaacatcctaatcgaaaaaggaacgttttttttttgtgctagccgagagagaatcaagaggaagagagagagaaaaccatgcgctgtggcctgacaaccggtgtcgcggggtgtgaagctcgccggacttgggtcgtctggcgctgcttgtccacggcgtgggggctgccgctggccgtgagagctctctgctcgggcgccgtcgttcgatcgtgtggcagacggatgcaagcgtggggtggtgccgactgtgcggttagctgtctggcgctgcttgtccagcgcgtgagttgccatctcccatctgggatctctgcgcggacactcgcactcggacgaagcgtggtctggagcgacacatggcgaggggactggacatcggagtttagagcgtcgtcgtaatccaagcgccacgtcagtcaactttgctccatcgacgcgagaggtaccaagatctgaggaatcaccctggtaactggaatctcangtgccaggtccagaacaggtaccgcaggataaagcgcatggaggatgttgtgcaatttcgtgaaa

SEQ ID NO: 50510 - DNA, 663 bp, Zea mays
  misc_feature: Ceres CLONE 1463386-F
  misc_feature: Encodes the peptide sequence at SEQ ID NO. 50511
  misc_feature (403)..(403): n is a, c, t, g, unknown, or other
aaagctggagctccccgcggtggcggccgctctagaactagtggatcccccgggctgcaggaattcgcacgagaccattacctagaacatcctaatcgaaaaaagactctggactggagggcaccaagctaacatttagttgcaaaggagcgctaggaagaagaagcaacgagccatggcctccggtggcccgaaacccaaactggcctacatcatcttgtacgtgagggacgtggagaaggccccctccttctacgacgccgccttcggctacaccgtccgccgcctcgacccagtccgcaagtgggcggagcttgagaagcgggcaacaaccatcgcgttcacgccgctgcaccagcgggagacggacaacctgtcgggggcggtgcagctgccggactcntcggccgccgggaagggctccttagaagtctgcttcgcctacgcggacgtcgacgcggcgtacaagcgcgccgtggacaacggggccgtggccgtgagcgcgcccggaggacaagccctggggccagaagtccggcttcctgcgggacattgaccggaacctcgtgcgcatcgcgagctacgtggcgaaagtaatcccattccgctgcatcaaccttgggtcgatcgatcaccctttcccatgggatgtctcggaaacaa

SEQ ID NO: 50511 - protein, 126 aa, Zea mays
  misc_feature: Ceres CLONE 1463386-F
MASGGPKPKLAYIILYVRDVEKAPSFYDAAFGYTVRRLDPVRKWAELEKRATTIAFTPLHQRETDNLSGAVQLPDSSAAGKGSLEVCFAYADVDAAYKRAVDNGAVAVSAPGGQALGPEVRLPAGH

SEQ ID NO: 50512 - DNA, 722 bp, Zea mays
  misc_feature: Ceres CLONE 1463387-F
  misc_feature (184)..(184): n is a, c, t, g, unknown, or other
  misc_feature (203)..(203): n is a, c, t, g, unknown, or other
  misc_feature (204)..(204): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (220)..(220): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (722)..(722): n is a, c, t, g, unknown, or other
tctgaactagtggatcccccgggctgcaggaattcgcacgagaccattacctagaacatcctaatcgaaaacagcctctgcgagcatccaacgccgaccaaccaccaccacaagttcaccgctaccaccactgcacggagtcacggcgatgacgccgcctcaccaccccgtaaacttcgccgtncctttcctttccctctttnntnnnnnncccnnntcngacnnntgttttttgttttttttgtccattctccccttttttttttcttttttattttattattagggttatatatttttccaacaccacccactaatgccaaaccacccccctcccggcggcatgctactctgggaccgctcctcttctgtttaaaaccccccacagaatatataattagatgcgctaccccccttttaacgaaaaaaccttctcttatactcctccccctttatacccctcccgcttttctagtgctcaaattcttttatccccttatttcttgtataatcatattgtcccctaaagaccccacctattatacccacccccccgttactccccatcctttcgtcacccctccattattttttccctcacccccccttattccccgccccctcccccccatttccccttttaatctccccctattacccaccccttatatctcctttattcctccccctccaccccactcccttattttttgttccctatn

SEQ ID NO: 50513 - DNA, 716 bp, Zea mays
  misc_feature: Ceres CLONE 1463390-F
  misc_feature: SWISSPROT Homolog: EC 1.1.1.195 Cinnamyl-alcohol dehydrogenase
  misc_feature (384)..(384): n is a, c, t, g, unknown, or other
aaactggagctccccgcggtggcggccgctctagactagtggatcccccgggctgcaggaattctcacgagaccattacctacaacatcctaatcgaaaaactcctaatcatcaaatttacttgcccccccccatcaaccaaagaacccactcttcactgccgaaatgaatcgcctgaggtcggttggaccgccagggacacatacggagtcctctccccctacttgttctcacgaaggggtatgatggataacgatgacgccatcacggagctctaacgggtacctgtgccacctcgccgtccacgtcgaccagatcgagtgaagcgacgccctctacccagtcgtcccggggactgataatgttggtgacgtcagtgaggangaacccaacttgttcactttcgatgacgggaatgcccctgggcgccgggtatctttttcggctcccgcccctcctcccttgtttggttgggttatagccgagaagaactagagccaaggttgtgtctctcctccatttcccgggaaagggtatgaggatccaccctcatggggatcctttgatcggaattcctttctcccttctagcaaggggcaaactttcgttccccctcttccccgctaggggccttgaccccctttaggagcggtcgccagtccacacaaaatgttcaagggaggccacgtcccccacaccgggttatccatttgacc

SEQ ID NO: 50514 - DNA, 656 bp, Zea mays
  misc_feature: Ceres CLONE 1463392-F
  misc_feature: Encodes the peptide sequence at SEQ ID NO. 50515
tacccgcggtggcggccgctctagaactagtggatcccccgggctgcaggaattcgcacgagaccattacctagaacatcctaatcgaaaaattcgcaccaccgccgcgccgcccaaatcacagccaccgccgccatggccgcctccagccgccctctcgtctccgtgaaggccctggagggcgacatggtcacggacgcccccggcatcgccttgccgcccgtcttcggtgcgccgatccgcccggacgtggtccgcttcacccacaagctgctgtcctgcaacaagcgccagccttacgcagtctcccgccgcgctggccaccagacgtcggccgagtcctgaggtacgggccgcgctgtgtcccgtatcccccgcgtccccggcggcggcacccaccgcgccggccagggagcattcggcaacatgtgccgcggcggacgcatgttcgcgcccaccaagatctggcgcaagtggcaccgccgcgtcaacgtcaacctccgccgcgtcgccgtcgcctcggcgctcgccgccaccgccgtcccggccctcgtccaggcgcgcggccaccgcatcgagaccgtcccagagatgcccctggtcatctctgactcggcggagtccatcgagaagacctccaggcgctcaagatctca

SEQ ID NO: 50515 - protein, 76 aa, Zea mays
  misc_feature: Ceres CLONE 1463392-F
MCRGGRMFAPTKIWRKWHRRVNVNLRRVAVASALAATAVPALVQARGHRIETVPEMPLVISDSAESIEKTSRRSRS

SEQ ID NO: 50516 - DNA, 644 bp, Zea mays
  misc_feature: Ceres CLONE 1463394-F
  misc_feature: Encodes the peptide sequence at SEQ ID NO. 50517
ggagctccccgcggtggcggccgctctagaactagtggatcccccgggctgcaggaattcgcacgagaccattacctagaacatcctaatcgaaaagacggtacttccgggtgtgtctagtctctagtctagctaggcactactctagctcccaagtggccaggtatactcgccagagtacgtacagtgtatttgagcgtcttccaaggatggcgtgtacctcccgccgcatggtcgcgtccgcgctcgtcttcctgctgatgctgctcgccgcctcagacatggggactacgagggtggcggaggctaggcactgcacgtcacatagccaccggttcgtcggcgcctgcatgagcaagagcaactgcgagaacgtctgcaggacgtagggcttcccgtgctgcgagtgcatgtggcacgacatataccgcaagtgccactggcagcgaatctgctagtaattaactacccggctgtgcagcgcatgcatgcacgacgaccgacctacctgctgctggtccgtttgcgtatgattgctgtcctttgggccttgatgtggcgcgcaatcttgcgtacccgcggtgtgcgggtgtcttttcaggactctcaattactcatacaaacgcgcctgggtgccagcatat

SEQ ID NO: 50517 - protein, 59 aa, Zea mays
  misc_feature: Ceres CLONE 1463394-F
MACTSRRMVASALVFLLMLLAASDMGTTRVAEARHCTSHSHRFVGACMSKSNCENVCRT

SEQ ID NO: 50518 - DNA, 676 bp, Zea mays
  misc_feature: Ceres CLONE 1463397-F
  misc_feature: Encodes the peptide sequence at SEQ ID NO. 50519
gctctagaactagtggatcccccgggctgcaggaattcgcacgagaccattacctagaacatcctaatcgaaaaactcttcgtcctcctcgatcgtcccaacaaccgcaatggcgcagcagaggcttctcgctctcctcctggtggcggccctcctcgcgctctccttctcgcaagggcaggtggaagcgcggaaggtgcaggtgcggcgcgcgcccctcggcggaggcggccgcctgcttccggaggcgatgatggcgtacacgacgacggactacgggccccccacggccaacaccaacacccacggcggcatggtcccgtcgccggacgacccctcctcgccgccgacgcactgaccggccagtcgatctcaccggcaacaactgtgttattcttccccattgtgagcttcggaaaaaaatatttgtagtaaaggatctgaagaacctggtctttgttcttctcccttatttgggcccgcggtgtattgtttccccgctgcttgggacctctgtagctccccgtggtcactggcccctagagccttaacctgaattaatgttgggaccgtgccgtgtggcccacaaagtattccgccagggcctccgggttggggggaacaccgtctgaaaaaaaaaagaataaaagaaagttttactcccattgacccctcc

SEQ ID NO: 50519 - protein, 82 aa, Zea mays; identical to SEQ ID NO: 44249
  misc_feature: Ceres CLONE 1463397-F

SEQ ID NO: 50520 - DNA, 661 bp, Zea mays
  misc_feature: Ceres CLONE 1463400-F
  misc_feature: Encodes the peptide sequence at SEQ ID NO. 50521
ccccgcggtggcggccgctctagaactagtggatcccccgggctgcaggaattcgcacgagaccattacctagaacatcctaatcgaaaaacccatccactcccaagtcccaacacccgtcggcgtcgagcagcggcggcgatgacgacgagcctgaagaagaaccggaagaagcgcgggcacgtgtcggcggggcacggccgcatcggcaagcaccggaagcacccgggaggccgcggcaacgccggcggcatgcaccaccaccgcatcctcttcgacaagtaccacccgggctacttcggcaaggtgggcatgcgctacttccacaggctccgcaacaagttccactgcccgtcggtcaacgtggagaggctctggtcgatggttcccgccggcaaggccgcggaggcggtcggcgcggaccaggccccgctcgtcgacgtgacgcagttcggctacttcaaggtgctcggcaaggggatgctgccgtccaggcccatcgtcgtcaggcccagctcatctccaggtcgccgagaagagatcaaggctgccggaggcgccgtcctgctgaccgcttaggtccttttgcatcttgtttcaactatctgcgcctagaaatattctatcctttttggggtggatttatgaagccttgctcttg

SEQ ID NO: 50521 - protein, 145 aa, Zea mays
  misc_feature: Ceres CLONE 1463400-F
MTTSLKKNRKKRGHVSAGHGRIGKHRKHPGGRGNAGGMHHHRILFDKYHPGYFGKVGMRYFHRLRNKFHCPSVNVERLWSMVPAGKAAEAVGADQAPLVDVTQFGYFKVLGKGMLPSRPIVVRPSSSPGRREEIKAAGGAVLLTA

SEQ ID NO: 50522 - DNA, 653 bp, Zea mays
  misc_feature: Ceres CLONE 1463406-F
  misc_feature: Encodes the peptide sequence at SEQ ID NO. 50523
  misc_feature (401)..(401): n is a, c, t, g, unknown, or other
  misc_feature (460)..(460): n is a, c, t, g, unknown, or other
  misc_feature (504)..(504): n is a, c, t, g, unknown, or other
  misc_feature (505)..(505): n is a, c, t, g, unknown, or other
  misc_feature (515)..(515): n is a, c, t, g, unknown, or other
  misc_feature (653)..(653): n is a, c, t, g, unknown, or other
ggagctccccgcggtggcggccgctctagaactagtggatcccccgggctgcaggaattcgcacgagaccattacctagaacatcctaatcgaaaaatccctatcttcttgctgcgttgttcgctcgcctgctgtgcctgtgcatgcagaccaggtcgagcggaggcgggcgggcctggcgttccagtacggcgtgctggtgctggagctggtgacggggcagtccccgggcgccgacggcgagctcgtgcgctgggcgcaggaccccggctccgccgcctccgtgcaccggatggtggacgccgacctcggcggcgtctacgacgcctgcgagctccgcgacctcgtcgccgtcgctaggctctgcaccagtgacgacaggtacgagggcgctggcgtcntcaccattccgcagatcgtcaagtacctccaggggaaagctgacgcgatcgggtgccangccagttcggatgatggtgatggttcgccctgcgtgcgtgcacnncgtctgtggngtctttcctcctctttacagcctgtctgtaccatcaatgtacaaaagcgcgtggcttttttcttctgtgatgcccagactctgttggtgtcgatcagtcgacaaaggaacaaagtgagttgctgactgcatttggaan

SEQ ID NO: 50523 - protein, 115 aa, Zea mays
  misc_feature: Ceres CLONE 1463406-F
  misc_feature (37)..(37): Xaa is any aa, unknown, or other
  misc_feature (56)..(56): Xaa is any aa, unknown, or other
  misc_feature (71)..(71): Xaa is any aa, unknown, or other
  misc_feature (75)..(75): Xaa is any aa, unknown, or other
MVDADLGGVYDACELRDLVAVARLCTSDDRYEGAGVXTIPQIVKYLQGKADAIGCXASSDDGDGSPCVRAXRLWXLSSSLQPVCTINVQKRVAFFFCDAQTLLVSISRQRNKVSC

SEQ ID NO: 50524 - DNA, 658 bp, Zea mays
  misc_feature: Ceres CLONE 1463411-F
  misc_feature: Encodes the peptide sequence at SEQ ID NO. 50525
  misc_feature (398)..(398): n is a, c, t, g, unknown, or other
  misc_feature (487)..(487): n is a, c, t, g, unknown, or other
tggagcaccccgcggtggcggccgctctagaatagtggatcccccgggctgcaggaattcgcacgagaccattacctagaacatcctaatcgaaaactaacccctccttcgttggcccatcctcgggacggctcctcgccagtcgcctcgtctctccctgccgcgtcacctccagttccgcctccgccgcgcctcccgcctccgccgtgcctgacgaacgcattataggactgtgcaggtagagaggaggagggtccggcgagatgtggatgcgagataagaagtggaacctgaagcgagtgctcgcgcgccgtaccgcggcaccgcgcccaggcgagggcaaggatttcctgccgctggaaggaggccccggctagacgcatctgaaggtgcatcancctgaagagcccgaaaacacagccacaatcgtctacattgggcatatcccccatggtttctacgaggacgagatgaaaggcttcttcangcagttgggggttataaagaggcttaggatcgctcgtaaccgcaagacaggaaagtccagcactatggattcattgaggttggagaacctgctgtggcaaaggtcgtagcaaagaaatgaatactatctcttgtttgagcccactttgcagtgcacttgatgaccagagaa

SEQ ID NO: 50525 - protein, 37 aa, Zea mays
  misc_feature: Ceres CLONE 1463411-F
MWMRDKKWNLKRVLARRTAAPRPGEGKDFLPLEGGPG

SEQ ID NO: 50526 - DNA, 645 bp, Zea mays
  misc_feature: Ceres CLONE 1463427-F
  misc_feature: Encodes the peptide sequence at SEQ ID NO. 50527
tggagctccccgcggtggcggccgctctagaactagtggatcccccgggctgcaggaattcgcacgagaccattacctagaacatcctaatcgaaaaaccaccactcatcaccaccagctgccattgccatctactgacctgtgacctccgcatttccaaacagcccgacgacgagcgagctagcagagcggcaggcacctccctcctcaaggaacatggcccgcatgcagcagttggcagtggcgacggcggccgtggtggccttggtgctgctggcggcggcgacgtcggaggcggccatcagctgcgggcaggtggcgtcggccatcgcgccctgcatctcctacgcgcgcggccagggctcggggccctccgccggctgctgcagcggcgtcaggagcctcaacaacgccgcccgcaccaccgccgaccgccgcgccgcctgcaactgcctcaagaacgccgccgccggcgtcagcggcctcaacgccggtaacgccgccagcatcccctccaagtgcggcgtcagcatcccctacaccatcagcacctccaccgactgctccagggtgaactgaaccctaacgacgacgacggcgccggcggccgcctgaagacaatcatatctatcccgccgtcgacgg

SEQ ID NO: 50527 - protein, 120 aa, Zea mays; identical to SEQ ID NO: 45903
  misc_feature: Ceres CLONE 1463427-F
  misc_feature (31)..(116): Pfam Name: Tryp_alpha_amyl Pfam Description: Protease inhibitor/seed storage/LTP family

SEQ ID NO: 50528 - DNA, 696 bp, Zea mays
  misc_feature: Ceres CLONE 1463430-F
  misc_feature: Encodes the peptide sequence at SEQ ID NO. 50529
cgggccccccctcgagccactgcagtggtaaaggcgaagcttatcgcttatcatccgcgcctctacatttcttctctctctggtcctccgcctccgcctccgcctgatccatccaagacagggatcgccatgtcggactcggaggatcaccacttcgaagcggggggcgacgctggggcttccaacacctaccctcagcaggctggtacctaccgtaaaaacgggttcgtcgagcctcaaaaaccctcccttgcaatgtgctacccctcaattgctttttcttcgaagtgagggaggagaaaatctccaattttttttttgtccaccaatactgatcataacgcccccaaactttttttttttcccaccttccccggggggaaagaaaggggggggaattccctcactacaccccttttttttcaattccaaaaaaaaaaaaaccaaccactattgagtcaagggggggtgggtcccaccggttatcgcattcactccggggatagcaaatggaggaatcatgatgtaccaaaaggtcctacaagaggggcagggagttctaccaccccaccgcgcctctctggacgtttaacccattagtatcgacacccccctggcggggcatcccgcttggctcgtcgcactcaatttacaatgttgtttgaacccccgatcgcgactagtcccggaggggag

SEQ ID NO: 50529 - protein, 53 aa, Zea mays
  misc_feature: Ceres CLONE 1463430-F
MSDSEDHHFEAGGDAGASNTYPQQAGTYRKNGFVEPQKPSLAMCYPSIAFSSK

SEQ ID NO: 50530 - DNA, 661 bp, Zea mays
  misc_feature: Ceres CLONE 1463434-F
  misc_feature: SWISSPROT Homolog: EC 2.7.11.1 Non-specific serine/threonine protein kinase
  misc_feature (412)..(412): n is a, c, t, g, unknown, or other
cgattgggtccgggccccccctcgagccctagcgtggtatagggtggcggtcggtgtgcccttggaacatgacggagttcctgaatctggacttctcggcggacgacgggatgtactgtctcagggacgactactcatcggcaagggccgagctccgggatcttgtaccacatacgtgactcgcgggggcacgtatctggcgatcaagcttctggtggggagaggagtgtggagacctacgaccgcgggttcaccgcagacgtcacaacgctgggcctcatctggctccgcatcatcgtgcggctggtcggcttcttctccaaccggtagggccacctgctgctgtacaactacatgcccaacgggtcgataggctagatgctgcgcggcgtctagggcttcctccttggtngagacgcccggctcgcgcgtctcggctgaggcgacgcgcgtcatctgctacctgcgccacgactgcgcgatccggataattcagcgatgacgcaagacagaacatgtcatcctcgactccgccttcgacgcgcacgctcagaacgttgcgctcgtcagttccctccggtagccgtcgccccccctgacgagtgtctgtatgtcgtacgctgatcctacaggtggctacacccgacaggactatacacat

SEQ ID NO: 50531 - DNA, 855 bp, Zea mays
  misc_feature: Ceres CLONE 1463438-F
  misc_feature: Encodes the peptide sequence at SEQ ID NO. 50532
  misc_feature (13)..(13): n is a, c, t, g, unknown, or other
  misc_feature (17)..(17): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
ggtgtgggggttnttcngatcgtttttacgtatcacgtttatattttttttgnnnnttcgattgggtacgggccccccctcgagccctgcagtggtaaagggcttgccctgcccgtcgccttggtgccacgcgcgccatgaccaagaccaagccttccgtcatgggcggctccccgctactcggcaagtacgagctcggccacctcctcggccggggcaacttcgccaaggtataccacgcgcgctgcctcggaggaggcaaccccgtggccctcaacgtgctgcacaaggacgggctggccgccacgggcatggcagcgtgggtactgcttgaggtgtcctgcctgcgacgcctgatccatctttgagtggttacgactccacgaagcgctcgctatcccctccctggggtacctcgtgtattcagtttagtcccctggtgaggggacatcctaaacccgggagtggagtaacactgaaatacaggttcccccccctccgaggctcacacaactcccggcctatgaggtatccctccccatacacgggctatcggggcccccgggatcataacagtccctccacctgccgtaggggaggggcggaaaacaaaccccgcggatcttgggcaaggggcgactcaacaatcaagtgattttccctgcgaaagcccctccacgcggaatactcctcctagtgtggggaccctaaacttcctcggaccacggttgtgggcgttttagacgtactgctgtatttcgggccacctacagagtgttttcctgtattatacagggtttgtctcttaaataccctaaaaagtatgcagcccgtctctgctagttgaatacccct

SEQ ID NO: 50532 - protein, 76 aa, Zea mays
  misc_feature: Ceres CLONE 1463438-F
  misc_feature: SWISSPROT Homolog: EC 2.7.11.1 Non-specific serine/threonine protein kinase
MTKTKPSVMGGSPLLGKYELGHLLGRGNFAKVYHARCLGGGNPVALNVLHKDGLAATGMAAWVLLEVSCLRRLIHL

SEQ ID NO: 50533 - DNA, 648 bp, Zea mays
  misc_feature: Ceres CLONE 1463444-F
  misc_feature: Pfam Name: UDPGP Pfam Description: UTP--glucose-1-phosphate uridylyltransferase
  misc_feature: SWISSPROT Homolog: EC 2.7.7.23 UDP-N-acetylglucosamine diphosphorylase
  misc_feature (514)..(514): n is a, c, t, g, unknown, or other
  misc_feature (606)..(606): n is a, c, t, g, unknown, or other
caattgggaccgggcccccctcgagccctgcagtggtaaaggtggaggacaggtctgcagaggaaaagaacgatggtggaagaatgggttgaaagccatctcggaggggaagctggccgttgtccttttggccggtggtcaaggtactcaagtggaaaactcagatcctaagggatgtttcaatatccgacttccatcaggaaagtcacttttccagctcacatctgaaaggattctgtgcgtatcaaagctggctgctcaatctacctaaagcccgagtaacactgtgccgatccactgcgtacataatgacaagcccctttacagatgctgccaccgccaaattctttgaaactcgtagatattttggcttaaaccctgaccaagtgacatttttccaacaatgcacacttccatgcgtttctgccgatggtacatttattatggagacagcatatatggtagcgaaggctcctgatggcaaacgtggagtttatgctgcactgaagtcaangaacttgatggaatatctgtccgcgacgtgtgtgacatacgtagattgctactgagctgacaacgcgctggttcgagatgcaaatcctacgntcatacggtacttcattgacatgggagcatcatctgccagcg

SEQ ID NO: 50534 - DNA, 700 bp, Zea mays
  misc_feature: Ceres CLONE 1463453-F
  misc_feature: Encodes the peptide sequence at SEQ ID NO. 50535
  misc_feature (216)..(216): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (266)..(266): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (300)..(300): n is a, c, t, g, unknown, or other
  misc_feature (301)..(301): n is a, c, t, g, unknown, or other
  misc_feature (303)..(303): n is a, c, t, g, unknown, or other
  misc_feature (304)..(304): n is a, c, t, g, unknown, or other
  misc_feature (314)..(314): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (356)..(356): n is a, c, t, g, unknown, or other
  misc_feature (357)..(357): n is a, c, t, g, unknown, or other
  misc_feature (359)..(359): n is a, c, t, g, unknown, or other
  misc_feature (362)..(362): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (376)..(376): n is a, c, t, g, unknown, or other
  misc_feature (396)..(396): n is a, c, t, g, unknown, or other
  misc_feature (397)..(397): n is a, c, t, g, unknown, or other
  misc_feature (405)..(405): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (427)..(427): n is a, c, t, g, unknown, or other
  misc_feature (428)..(428): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (438)..(438): n is a, c, t, g, unknown, or other
  misc_feature (439)..(439): n is a, c, t, g, unknown, or other
  misc_feature (464)..(464): n is a, c, t, g, unknown, or other
  misc_feature (465)..(465): n is a, c, t, g, unknown, or other
  misc_feature (468)..(468): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (498)..(498): n is a, c, t, g, unknown, or other
  misc_feature (500)..(500): n is a, c, t, g, unknown, or other
  misc_feature (502)..(502): n is a, c, t, g, unknown, or other
  misc_feature (505)..(505): n is a, c, t, g, unknown, or other
  misc_feature (508)..(508): n is a, c, t, g, unknown, or other
  misc_feature (510)..(510): n is a, c, t, g, unknown, or other
  misc_feature (521)..(521): n is a, c, t, g, unknown, or other
  misc_feature (531)..(531): n is a, c, t, g, unknown, or other
  misc_feature (555)..(555): n is a, c, t, g, unknown, or other
  misc_feature (562)..(562): n is a, c, t, g, unknown, or other
  misc_feature (564)..(564): n is a, c, t, g, unknown, or other
  misc_feature (569)..(569): n is a, c, t, g, unknown, or other
  misc_feature (571)..(571): n is a, c, t, g, unknown, or other
  misc_feature (579)..(579): n is a, c, t, g, unknown, or other
  misc_feature (583)..(583): n is a, c, t, g, unknown, or other
  misc_feature (593)..(593): n is a, c, t, g, unknown, or other
  misc_feature (595)..(595): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (628)..(628): n is a, c, t, g, unknown, or other
  misc_feature (632)..(632): n is a, c, t, g, unknown, or other
  misc_feature (634)..(634): n is a, c, t, g, unknown, or other
  misc_feature (638)..(638): n is a, c, t, g, unknown, or other
  misc_feature (639)..(639): n is a, c, t, g, unknown, or other
  misc_feature (670)..(670): n is a, c, t, g, unknown, or other
  misc_feature (698)..(698): n is a, c, t, g, unknown, or other
cgattgggtacgggccccccctcgagccctgcgtggtaaaggatccgatcgatccgctcgactccaagcgcaatggctcatccttgcttaattaccaaggtacctttgcagctgcaggtaggtaggtagctagccgccatagcaagctaggccgaagcagaggagtgatggccaaggtccaccccaacgccgcggagtccgtcgtcgctccccagngccaaaaannnnnnnnttttttttaaaaaaaaaaaagggggcccccccanaaaaaaaaaaaaaaaagannnnnnnnnnnggggnngnngtgtctcccngtgnnnnnaaaaaaaaaaaaaaaaagaagggggggggggggnngnggnggnnnnngnnnntntttgttgttttgtttttttnnaaaaaaanaaaaaaaaaaaaaaannnnngnngggggnnngnnggggggggggggggggggggggggnnggngnnnnnnnnnnnnnnnnggnnncnnnnccncncnccncgncnctgctgtgtgntttctttttncttgtagtcgctgcccacccgccnccccccncnccccncncccaccgnccgnggggagggcncngtggggagggcggcgcggggcgcgcannnctgncgananaatnnccgcccccggcgcccccgcccgccgcctcgngtcacgccgccaccgtcgtccgcgccgnca

SEQ ID NO: 50535 - protein, 40 aa, Zea mays
  misc_feature: Ceres CLONE 1463453-F
IGYGPPLEPCVVKDPIDPLDSKRNGSSLLNYQGTFAAAGR

SEQ ID NO: 50536 - DNA, 685 bp, Zea mays
  misc_feature: Ceres CLONE 1463458-F
  misc_feature (397)..(397): n is a, c, t, g, unknown, or other
  misc_feature (398)..(398): n is a, c, t, g, unknown, or other
  misc_feature (401)..(401): n is a, c, t, g, unknown, or other
  misc_feature (402)..(402): n is a, c, t, g, unknown, or other
  misc_feature (407)..(407): n is a, c, t, g, unknown, or other
  misc_feature (464)..(464): n is a, c, t, g, unknown, or other
  misc_feature (620)..(620): n is a, c, t, g, unknown, or other
atcgattgggtccgggcccccctcgagccctgcagtggtaaagggcacctcaccacacaccaccatctcacgcactgctagtaagcgagcttagctactgatcgtcgtcaagcactctcgagctcgatctctcgaaggggctagctgctagcagccaattaatggcgaagccttcgcaggtgctggtgtccgctctcgcccccctgggcgggggtcctgctgctgctgtgccccgccgcgccgcggggcgcccacacggccacggagtgcgactccgcgcatctgaaccccggcggggggggcatcatcgggagctcgccgccttaccgcggctgctggaagaggttcaaggaaaaaaatttttcccccccccccaagggggggaggggggggattnnaannttacntcaactcccccccccggaaaaaaaacatgagccacgtgaaggggggcgggggcggcnagcaaaatttaactttcttttagcggcccccgcgcggcaccaaaaaaactaccttttcctcaaaccccacagggttaaatttcctccccccccccccttggcccaaggggagaagggagacaataagggcctcctccttttctcttcaggcttcgnggccgggggggaacggggggatggcggaaacccccctgtcccccgcggttccccctttggaggag

SEQ ID NO: 50537 - DNA, 654 bp, Zea mays
  misc_feature: Ceres CLONE 1463464-F
  misc_feature (1)..(1): n is a, c, t, g, unknown, or other
ncgattgggtaccgggccccccctcgagccctgcagtggtaaaggaatagaaccaatcctccatcaccgccaccgcccgagccccgaggcctaggccctgatctctgcctaccaaacaatggaagccacagcagccaccttgtcccgctccgcctccctctccgccggccgcccccaccgctcccgcaccgccaggttcccgccaccacccccacacctcaccccgctctcggctgccgcgtccccgcgcggcctcccgctccgccgagccaggaccgacgccgaggtcgcctacttcgcgagatccgccgtcctcgtccgccacgctccgatccccgccattatcgtggccgacgaggaagagcgccaggatgacaacagcaaggcgccagcaggcctcgacggcgccggcgccggcaggaacggcagcagccaccgcggcggcagcggacgccgtgacggcggcagcagcgacgacggctgtgacatgggcgagtactaccgccgcgagctgcggctggatcccggaaaccgctgctgctgcacaactacggcaagtacctgcacgaggtgaagcgcgacctgtcgggcgacgagggctgctactcgcgcgcgctgctggcgtgccccggggacacccacctgctcatcctc

SEQ ID NO: 50538 - DNA, 655 bp, Zea mays
  misc_feature: Ceres CLONE 1463467-F
  misc_feature: Encodes the peptide sequence at SEQ ID NO. 50539
cgattgggtacgggcccccctcgagccactgcagtggtaaagtgtgcggggacccctgcgccggcgccggcacggccgggtgggagtgggccggcggcgccgcggcgtcgaccgtcgccgagtgggggctcgtctgtggcgagcgctacaaggtcggcctcgcccaggccgtgttcttcgccggctgcatgatcggcgcgggcgtgttcggccacctctcggactcgttcctgggccggaaggggtcgctgcaggtggtgtgcgtgctcaacgccgccttcggcctgctgaccgcgctggccccgacctactgggcctacgcggcgctgcgcctcctcacgggcttcagcacgggcagcgtcggcgtgctggccttcgtgctggccaccgagcccgtcggccccgcccgccgcggcgccgccggcatgtccgccttctacttcttctccggcggcatcgcggcgctcgccggcgtcgccgcgctcctcccgcgctcctggggcctgctctacgccgccacctcgctcccctcgctcgtcttcgccgtcgccgtcgtcccgttcgtctccgagtcgcccaggtggtacctcgtgcggcgccgcccccacgacgcctttgcgggtcgtccgtgccatcgcggcccgcaaatggcagg

SEQ ID NO: 50539 - protein, 217 aa, Zea mays
  misc_feature: Ceres CLONE 1463467-F
IGYGPPSSHCSGKVCGDPCAGAGTAGWEWAGGAAASTVAEWGLVCGERYKVGLAQAVFFAGCMIGAGVFGHLSDSFLGRKGSLQVVCVLNAAFGLLTALAPTYWAYAALRLLTGFSTGSVGVLAFVLATEPVGPARRGAAGMSAFYFFSGGIAALAGVAALLPRSWGLLYAATSLPSLVFAVAVVPFVSESPRWYLVRRRPHDAFAGRPCHRGPQMA

SEQ ID NO: 50540 - DNA, 704 bp, Zea mays
  misc_feature: Ceres CLONE 1463475-F
  misc_feature: Encodes the peptide sequence at SEQ ID NO. 50541
  misc_feature (400)..(400): n is a, c, t, g, unknown, or other
  misc_feature (459)..(459): n is a, c, t, g, unknown, or other
  misc_feature (687)..(687): n is a, c, t, g, unknown, or other
ggagctccccgcggtggcggccgctctagaactagtggatcccccgggctgcaggaattcgcacgagaccattacctagaacatcctaatcgaaaagcctcgctcccgtcgcttgacctgtactgtccccacggagatcacgacacgaaccgagcaagaaccgcacgagccgagcccagcagcaggatggcggcggcggcgagcgggaaggcgccgtcgctggtggtggcggcgagcatgggcgcggtggaggcgctcaaggaccaggcgggcctgtgccgctgggactacgcgctgcgctcgctctaccaccgcgccgccgccgcgccccggatccgcgcgctgtccgccgcgctctcggactccgtgtccgtgccggcggacgcccccccgcgggcgntcgcggccaccgccccccgccggcgcccgcgggacgcggacaggatgcgcaaggcctanccacctcgtgtgctggggccccaactgatcggcgggcgggcgccgactgcatgcctgtagctgtagctgtagcgcgctgaccaagcctggctggggtgtggttgtctgtagcttcttcttcttgttgtttcgcctctcgtgcgtgggggggggggtgtgttgctctcgctccgtcatcgattccatccgtgtccgtcggcagatgagatgagatgagatgagaatganaaggcgatgtgatgctc

SEQ ID NO: 50541 - protein, 110 aa, Zea mays
  misc_feature: Ceres CLONE 1463475-F
  misc_feature (72)..(72): Xaa is any aa, unknown, or other
  misc_feature (91)..(91): Xaa is any aa, unknown, or other
MAAAASGKAPSLVVAASMGAVEALKDQAGLCRWDYALRSLYHRAAAAPRIRALSAALSDSVSVPADAPPRAXAATAPRRRPRDADRMRKAXPPRVLGPQLIGGRAPTACL

SEQ ID NO: 50542 - DNA, 750 bp, Zea mays
  misc_feature: Ceres CLONE 1463479-F
  misc_feature: Encodes the peptide sequence at SEQ ID NO. 50543
  misc_feature (353)..(353): n is a, c, t, g, unknown, or other
  misc_feature (354)..(354): n is a, c, t, g, unknown, or other
aaagctggagctccccgcggtggcggccgctctagaactagtggatcccccgggctgcaggaattcgcacgagaccattacctagaacatcctaatcgaaaattcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttanngagctttgagtgaagaaagaagcatatggtgtggagcttgatcagcgagaggatggctcaaagattcaggatgcctacttgaaataattgggcaggcgaactggtccctcaggttttttgcccagggaagccccctggggggttctgaacaaacggttgactccctacaaaggggaaaatgggttaaatctttaaaactcggaaaacggggaaacctttagaggagagtgcaaaccggccccccggttctttgtgttaaaaccggacggggtaaaaaaacccaaaagggtttttccccccggggaccccccccccccccccaaaggggttttttttccggagagaggcccccacccttttttttttttaaccacggatttttttggggcaccaaaa

SEQ ID NO: 50543 - protein, 65 aa, Zea mays
  misc_feature: Ceres CLONE 1463479-F
  misc_feature (63)..(63): Xaa is any aa, unknown, or other
MVALLGRRIGVAAAAAAFIALVAFGSASSSPKSFVKSTVSAHDVVIFSKSYCPYCKRAKAVFXEL

SEQ ID NO: 50544 - DNA, 690 bp, Zea mays
  misc_feature: Ceres CLONE 1463480-F
  misc_feature: Encodes the peptide sequence at SEQ ID NO. 50545
aagctggagctccccgcggtggcggccgctctagaactagtggatcccccgggctgcaggaattcgcacgagaccattacctagaacatcctaatcgaaaattctgtcaccaatatccttgtacctgcatctccacctcaccggcgtccggcggtggaatcacaatggtggcattgctggccccgcggatcaggctggctgcggcaactgccaaggttctctccctcgtggtgttcggaaccacctcatcctcgcccaagtccttcgagaagtccaccgtctccgcccaggacgtcgtcatcttctccaagtcatactgcccgtactgcaaaagaccaaaggccgtgtttaacgaccttgatttgaaaaaagagccatatgttggggagcttgatcagcgagaggatgggtcagacacccccgacgccttacttgaaatagttggcaggggtactggccctcaagtttttgtccttggaaagcacctgggtggttctgacgatactgttgactcctacgaaagtggaaaactggctagacttctaaacatcggatgtcaggacgacctttgagtgacatgctacatcggtcagcctgttcgtttggtttcaatccgtaccggcttctactacttctatattgtttttgtctctatggattacagctaccacagtctaaatagctgatttt

SEQ ID NO: 50545 - protein, 135 aa, Zea mays
  misc_feature: Ceres CLONE 1463480-F
  misc_feature (44)..(108): Pfam Name: Glutaredoxin Pfam Description: Glutaredoxin
  misc_feature: SWISSPROT Homolog: EC 1.11.1.15 Peroxiredoxin
MVALLAPRIRLAAATAKVLSLVVFGTTSSSPKSFEKSTVSAQDVVIFSKSYCPYCKRPKAVFNDLDLKKEPYVGELDQREDGSDTPDALLEIVGRGTGPQVFVLGKHLGGSDDTVDSYESGKLARLLNIGCQDDL

SEQ ID NO: 50546 - DNA, 764 bp, Zea mays
  misc_feature: Ceres CLONE 1463483-F
  misc_feature: Encodes the peptide sequence at SEQ ID NO. 50547
  misc_feature (511)..(511): n is a, c, t, g, unknown, or other
tggagctcaccgcggtggcggccgctctagaactagtggatcccccgggctgcaggaattcgcacgagaccattacctagaacatcctaatcgaaaaacaatgcgccgcgctgccgcgatcctcctgtccctcgccctcgcagccgccgccccaccacggcggcgacagccgccgagtgtccggcccaagggctgctccctcgactgctatggcatcgacgtggccaccgcgtcgctgctcctgctcgccataatcgctgccagggtcagcatcgtcaaggcgtgcgccctcgccggcgctgacgcggaggtgttcagcgctgcgggctatgtctctaggtggtgcgcagaagaggacggcgctgctcatgcgctggcgctgcccacgacgatggcgacgccagccgcgcgcggccgcgcggtggtgtggtctcgatgaagcagttgatcgacgcgctgccgggtgttcgtgtacgactcgcccatgccatttgttggcggcaaaaaagancaagcaagtccggaaagactcccacctcctgcccggtttttcttggaagaaggtccaggcccgggaaaaatggttcgggcagcttgcctggaaggggggccccttggttccccgtgggagggacataaaacatgggggttggcactccaaagggaatcgggccccctttgggcgaaagagaaagagttcccccccaaaggaggtttttttatataaaaggtcccgggaaaaacctttaaaattccccgggggg

SEQ ID NO: 50547 - protein, 112 aa, Zea mays
  misc_feature: Ceres CLONE 1463483-F
MRRAAAILLSLALAAAAPPRRRQPPSVRPKGCSLDCYGIDVATASLLLLAIIAARVSIVKACALAGADAEVFSAAGYVSRWCAEEDGAAHALALPTTMATPAARGRAVVWSR

SEQ ID NO: 50548 - DNA, 734 bp, Zea mays
  misc_feature: Ceres CLONE 1463488-F
  misc_feature: Translation starting site: 177
  misc_feature (313)..(313): n is a, c, t, g, unknown, or other
  misc_feature (369)..(369): n is a, c, t, g, unknown, or other
  misc_feature (382)..(382): n is a, c, t, g, unknown, or other
  misc_feature (409)..(409): n is a, c, t, g, unknown, or other
  misc_feature (412)..(412): n is a, c, t, g, unknown, or other
  misc_feature (415)..(415): n is a, c, t, g, unknown, or other
caaagctggagctccccgcggtggcggccgctctagaactagtggatcccccgggctgcaggaattcgcacgagaccattacctagaacatcctaatcgaaaagaatttcgaaggagactgtttcataaacaggagccaggcaccggactttccaggaggataccacctcccgaacatggtgcgtcgacgacccgccaccggggcagccccgagaccccacctcgccgccgtcggtcgcgggctgctcctcgcgtccgtcctcgcggccgctgcctcctccctcccagtagccgagtcgtcctgcccgcgagnacactcactggtgagagacataagccgaatgcagcagcgcaactacgggagggaanggatctcgcatantactgtcacaggtgctcttgctcaggnacnaanggaggggaagtgtggctaccaacattggtccaggtcaaaggaccccattcacaggggattcttggaaaaaggttttcattggcctcagggggaaagggccgcccttaatcggggccaagttccttaaatccccgagaaccccccggggagttcctgtctttcaaaaacccatttttcaaatcccgggaaagggacccccccgggcggggatttttgggggccccaaaaaattcgggttttggggaaaaatatcccccccccggggaaaaattttttaccgggaggggggggggtgcccccaaccggggggaagaaaaat

SEQ ID NO: 50549 - DNA, 694 bp, Zea mays
  misc_feature: Ceres CLONE 1463490-F
  misc_feature: Encodes the peptide sequence at SEQ ID NO. 50550
  misc_feature (375)..(375): n is a, c, t, g, unknown, or other
  misc_feature (434)..(434): n is a, c, t, g, unknown, or other
  misc_feature (469)..(469): n is a, c, t, g, unknown, or other
aaagctggagctccccgcggtggcggccgctctagaactagtggatcccccgggctgcaggaattcgcacgagaccattacctagaacatcctaatcgaaaaatatagaattttcgtttcgccgcattattttttcacttctcactccctccttcggtccttcgccttcctcgtgtccccgactctccgatactagtcgagtagtccggtacttcccaccgcctcgcaccgcggccatgttgacaccgcgcgtcctcaaggcttcgctgctccgctgcttgcgcgctaccgccgagctgcctccgttgtggcgaccccggagtctacctgtgcgggtttaccatgtcagaggctattctagtgggggaagctccnagtatgataggccatgagacagttttctgatcagaatggagtcacctctcagccattantataatacattgccccatcggctctgcttgctttngctgggatagcacaattgttcattacatggaggaaggggggcattccccttcctaaaggacccgaaagacaaggttcccaaaaagccctaccattacctgggaagggggggcttttatcttgtgaacccaaaaagtgggggggctgatccaccttcggggaaaggaaacggaggcttttggtcaccccggccccaggggggcccccgaaattaaaaaaattgtgt

SEQ ID NO: 50550 - protein, 51 aa, Zea mays
  misc_feature: Ceres CLONE 1463490-F
  misc_feature (47)..(47): Xaa is any aa, unknown, or other
MLTPRVLKASLLRCLRATAELPPLWRPRSLPVRVYHVRGYSSGGSSXYDRP

SEQ ID NO: 50551 - DNA, 728 bp, Zea mays
  misc_feature: Ceres CLONE 1463493-F
  misc_feature: Encodes the peptide sequence at SEQ ID NO. 50552
  misc_feature (354)..(354): n is a, c, t, g, unknown, or other
caaagctggagctccccgcggtggcggccgctctagaactagtggatcccccgggctgcaggaattcgcacgagaccattacctagaacatcctaatcgaaaaatctttcgctccatcccttactcgcgctcggcacaccggttctcagggcggcggcgctcaggctcgggctctcagcgacggcgtcaacggcttcccctcccgcctccgctcctccgcacaccggccggtgaccctgctgaactatagtcttatggcggcaagcgcgggcgagagccagggggtggaaagactcctctcctatgctgaagatctcgtggccgtcctttgcgtcagcaccgactgcgacgacnatgcacaggtcggtgccggagtgcaaaggctgctgtctgcctgtcaatccgagtctgacaatctcaagatgcagctcaaagagtatcaggaaaaaatcccctcttgcaaagaaaagattgacaaagcaaaggctgaaccctttactggacaatgaatctctgggcccttcaagcaagatggaaaaaaaactggcggaaaaaaaacccccttccccaaaattaaaaagggtcctgggggggctttgggacctaaaaagccaaaaaattttttaaaaaaaaaaaagggttgtttaaaaaaaaaaaaaaaccccccgagggaaagggcccttttccgggggggggggggaaaaaaacccccccattttgaaaaaaag

SEQ ID NO: 50552 - protein, 84 aa, Zea mays
  misc_feature: Ceres CLONE 1463493-F
  misc_feature (34)..(34): Xaa is any aa, unknown, or other
MAASAGESQGVERLLSYAEDLVAVLCVSTDCDDXAQVGAGVQRLLSACQSESDNLKMQLKEYQEKIPSCKEKIDKAKAEPFTGQ

SEQ ID NO: 50553 - DNA, 697 bp, Zea mays
  misc_feature: Ceres CLONE 1463495-F
  misc_feature: Encodes the peptide sequence at SEQ ID NO. 50554
  misc_feature (1)..(1): n is a, c, t, g, unknown, or other
ncaagctggagctccccgcggtggcggccgctctagaactagtggatcccccgggctgcaggaattcgcacgagaccattacctagaacatcctaatcgaaaaagaatcgccgcaagccaatctgtctccgccaggcgccaagccaaccctcaccaccacccgtccacccccatcagtgcatcaccgcccacagcctttactcgccaccgcagcaccccctgctcggccgcccgctcccgcgttcccacatctctctctctctggctctctgctcgccacgcgccgtaccagcgccgcgcgccacatggcttcctcgttcactagcctcctctcggccgcgaactccgccgccgcctcgcggctcccctcggccgccgccggacgggcatccactttcgtgcgcttcccgcatcacccgacgggctgggctggggcctccgtcgcggcgccgcgtacggcgcgcaagcgggcacccggcgtcgcctacgccaccgcagctaccgagaagagcatctacgactacaccgttaaggacattgatggaaaagatgttcctcttaaaaagttcaagaataaggtgttgctgattgttaacgttgcttctcaatgtgggttgacaacagcaaattacactgaactatctcatatctatgagaagacaagactcaaggggtttgagatccttgcatttccttg

SEQ ID NO: 50554 - protein, 130 aa, Zea mays
  misc_feature: Ceres CLONE 1463495-F
  misc_feature (70)..(130): Pfam Name: GSHPx Pfam Description: Glutathione peroxidase
  misc_feature: SWISSPROT Homolog: EC 1.11.1.12 Phospholipid-hydroperoxide glutathione peroxidase
MASSFTSLLSAANSAAASRLPSAAAGRASTFVRFPHHPTGWAGASVAAPRTARKRAPGVAYATAATEKSIYDYTVKDIDGKDVPLKKFKNKVLLIVNVASQCGLTTANYTELSHIYEKTRLKGFEILAFP

SEQ ID NO: 50555 - DNA, 726 bp, Zea mays
  misc_feature: Ceres CLONE 1463503-F
  misc_feature: Encodes the peptide sequence at SEQ ID NO. 50556
  misc_feature (485)..(485): n is a, c, t, g, unknown, or other
  misc_feature (500)..(500): n is a, c, t, g, unknown, or other
  misc_feature (574)..(574): n is a, c, t, g, unknown, or other
  misc_feature (614)..(614): n is a, c, t, g, unknown, or other
caaagctggagctccccgcggtggcggccgctctagaactagtggatctcccgggctgcaggaattcgcacgagaccattacctagaacatcctaatcgaaaatatatagcttgggtctcatattcttacagatggcattcccttcactacgaactgatagcaacctcatacaatttaatcgccaactgaaaagatgtgattatgacttacaagcttggaggaatctggtggagccacgagcgagtgctgagctccggaggggctttgacatcatggatttagacggtggtatcggatgggaactcctcacctcgatggtccggtacaaagcacggcagaggaccagtgctaaggccgcattggcacacccgtactttcaccgtgaagggctccttggcctctccgtcatgcaaaacgtacggctgcaactgttcccgcgcacccagaaggactacagtgaagcagcgcggtgggttatccgccntcatggcaaggtcangaactgaaaaggtgggaggcttttacgaagcccaggcttccggagcttaaggaaataaaacccaagaaaagcgncccccggcgaaccccgccttgcctccgggctgcgcctggnaaggaaaatcttgaaaaccatcggggaaacttgggcaagcctcaacgccggcccaaacccttgggggaacgcggggaaacccctgggagatataccccgcgccccaccccac

SEQ ID NO: 50556 - protein, 124 aa, Zea mays
  misc_feature: Ceres CLONE 1463503-F
  misc_feature: SWISSPROT Homolog: EC 2.7.11.1 Non-specific serine/threonine protein kinase
  misc_feature (118)..(118): Xaa is any aa, unknown, or other
  misc_feature (123)..(123): Xaa is any aa, unknown, or other
MAFPSLRTDSNLIQFNRQLKRCDYDLQAWRNLVEPRASAELRRGFDIMDLDGGIGWELLTSMVRYKARQRTSAKAALAHPYFHREGLLGLSVMQNVRLQLFPRTQKDYSEAARWVIRXHGKVXN

SEQ ID NO: 50557 - DNA, 692 bp, Zea mays
  misc_feature: Ceres CLONE 1463509-F
  misc_feature: Encodes the peptide sequence at SEQ ID NO. 50558
ctccccgcggtggcggccgctctagaactagtggatcccccgggctgcaggaattcgcacgagaccattacctagaacatcctaatcgaaaattccagggcgctcctgcacgtcgctagcgccactagggacctcaagaagcgtgtgccctgggtgctcggtgtcgaggcggaccccagcggcggcccacgggtgcaggaggcggccatgaagctgtaccacagccgtaggcgcggtgagggcgaggaggcaggcaaggtggacctgctccaggccttccaggcggtggaggtggccgtgagaggattcttcttcgggtaccggcagctggtggcggcggtgatgggcacggcggaggcgtcgggcaaccgggcgctgttcgtgccggcggaggagatggatccgctcgcccaaatgttcctggagccgccatactaccccagcctggacgccgccaagacgtttctagcggattactgggttcagcttcagcagatggcggaggcctctgctccgtcaagacaaagctgaaacggcgaaatggcacggctgagccaccgaatcgcgcagttttgcagggactgaagatactatgcatgcatttcgttggggccttttgcccttgtggcgatagagtgattcatttctaaaaaaaaaaaaaaaagcttatcgataccgtcgacctcgagggg

SEQ ID NO: 50558 - protein, 107 aa, Zea mays
  misc_feature: Ceres CLONE 1463509-F
  misc_feature (1)..(94): Pfam Name: Hs1pro-1_C Pfam Description: Hs1pro-1 protein C-terminus
MKLYHSRRRGEGEEAGKVDLLQAFQAVEVAVRGFFFGYRQLVAAVMGTAEASGNRALFVPAEEMDPLAQMFLEPPYYPSLDAAKTFLADYWVQLQQMAEASAPSRQS

SEQ ID NO: 50559 - DNA, 847 bp, Zea mays
  misc_feature: Ceres CLONE 1463515-F
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (783)..(783): n is a, c, t, g, unknown, or other
  misc_feature (792)..(792): n is a, c, t, g, unknown, or other
  misc_feature (822)..(822): n is a, c, t, g, unknown, or other
  misc_feature (823)..(823): n is a, c, t, g, unknown, or other
tggccccccccccccaaccacccggaggcncccgnnntttttgttnntnncaaagctggggctccccgcggtggcggccgctctagaatagtggatcccccgggctgcaggaattcgcacgagaccattacctagaacatcctaatcgaaaaatcggtgagatggtttcggcctctctttgtgtctgcgtagcggtaaaccctatcgtttgtatgcttcactacaggtgtctagaactgagtgtcctcgcgactaagaaatggcccatgctgcggaggacactcacgtgccgttgcgtatgcaggtcctcttcctcgggaggatcggctcctgggaaccgtagctaccccattacctggactccgccacccgcgcgccgtccgacccacaggccagtgggcgtccgatgtcggagggacaccaactaaccacaggggggggaagggcgccttccttgtccttcattaaacacccgcctggcaccgtgatagcgggagggtcaccccgcgcccccggaagggggggaatatggaccttgggccaagtttcatccccaccctggagatcctagccacatatcctctagacccccgcgcacgcgttcgggnnnagaaatggtggtcccccacggcggctttttggctgctctgaccaaaccattgggataccnnnattgttggcgtcttagggctagggaaagacggacaagctctcttattaagccctccgggaaggcctttttttggggacccatgtgagacaatcgtggtaaatttgtttggnaaaaacgcnctacatctagcgggcctttctcgtatgggnnagacaaggaattaaggccccacac

SEQ ID NO: 50560 - DNA, 688 bp, Zea mays
  misc_feature: Ceres CLONE 1463516-F
  misc_feature: Encodes the peptide sequence at SEQ ID NO. 50561
  misc_feature (555)..(555): n is a, c, t, g, unknown, or other
  misc_feature (600)..(600): n is a, c, t, g, unknown, or other
  misc_feature (630)..(630): n is a, c, t, g, unknown, or other
  misc_feature (631)..(631): n is a, c, t, g, unknown, or other
ggagctccccgcggtggcggccgctctagaactagtggatcccccgggctgcaggaattcgcacgagaccattacctagaacatcctagtcgaaaagactacagagaaccggaggactgaggaggaggaggagacgtcacgcctgcgcggctgcgcccaccatggacgaggaggagttccggcgcatgctcgacctcttcccggtcgtccgctcccgagactactgctgctccgatcttggaacatccagcagaggaaccagacagcgatcacgagttcaggaggcaactaagggcgataataaggactcgtccggtggacgagatatgtttatgcagaaattgaagatggctgcggagaataagattggagcgacaaaggcagagttcttctgcaagacattcgaagaagttcatgagaaacttgttcacagagagctgaatttggatgctgctaagaagttcctgagcgcatatgagagctgatgatgaacaataggtagatgctgcttaaggggtcggtagttgccaatgatctgggaaagtgttgatgctngtgagattttgatcacaggcaaactttttacacaggtagatgctngtgagcgcatactgataccgcctgattggnntcacgatcgccccgtagcagctcgtatgcagccaggctgtccagagactgttattgg

SEQ ID NO: 50561 - protein, 107 aa, Zea mays
  misc_feature: Ceres CLONE 1463516-F
MDEEEFRRMLDLFPVVRSRDYCCSDLGTSSRGTRQRSRVQEATKGDNKDSSGGRDMFMQKLKMAAENKIGATKAEFFCKTFEEVHEKLVHRELNLDAAKKFLSAYES

SEQ ID NO: 50562 - DNA, 685 bp, Zea mays
  misc_feature: Ceres CLONE 1463518-F
  misc_feature: Encodes the peptide sequence at SEQ ID NO. 50563
  misc_feature (386)..(386): n is a, c, t, g, unknown, or other
ggagctccccgcggtggcggccgctctagaactagtggatcccccgggctgcaggaattcgcacgagaccattacctagaacaccctaatcgaaaactacgcacccactgaaatcccttcaccaagtcgaggaccccctccgaatccgagggttcaagcgaccgacggcgaacatggcggcggacggcggcccagcgacgtcggcgctggaagaggccctcaagcccttccaggaaagagcctccgaggctgagatacgcatagcgaagctggaagccttgctgtacaacaaagatggtccgagcggtggatccgaggcaacttactctgccgtgaaggatctccagtcgaagctagatgttgttactgcaaaatgcttgactganaaggataagaacaagaagctgaccatggagaacgagaagctccagtaccgcatgacccatctgatccgtgcgataaaagaggcggaatcgagataggagcagcccggcgaggccattcaaagcctgatgtcgaagtgttaccacccgccttgttgatcggtcacgtttgtcctgcatctacctcaagctatcctggtgatcttgagatagagattggtcacagtcaagactgtatatcaaactggtgatcgaagtgatgatgtgtgcacagcttttctgtcttcacctaaaaaaaaaaa

SEQ ID NO: 50563 - protein, 102 aa, Zea mays
  misc_feature: Ceres CLONE 1463518-F
  misc_feature (71)..(71): Xaa is any aa, unknown, or other
MAADGGPATSALEEALKPFQERASEAEIRIAKLEALLYNKDGPSGGSEATYSAVKDLQSKLDVVTAKCLTXKDKNKKLTMENEKLQYRMTHLIRAIKEAESR

SEQ ID NO: 50564 - DNA, 689 bp, Zea mays
  misc_feature: Ceres CLONE 1463521-F
  misc_feature: Encodes the peptide sequence at SEQ ID NO. 50565
  misc_feature (591)..(591): n is a, c, t, g, unknown, or other
tggagctccccgcggtggcggccgctctagaactagtggatcccccgggctgcaggaattcgcacgagaccattacctagaacatcctaatcgaaaaaccgcacccactagggtttccgcaccgcattgcagaacctcgccgcctccacccgcaccacaccaccggcgatgtccacagcggcggcgcagggcggcagcgacaagccggcgctccggaggcccgtcttcaccaaggtcgaccagctcaggccgggcaccaacgggcacaccctcaccgtcaaggtcgtcagcgccacccccgtgcctgggcgcgcgcgcccaggcgcacccgccgccgccccatcccgcgcgccgcgcatcgccgagtgcctcgtcggggacgagaccggcgccatcgtcttcaccgcccgcaacgaccaagttgacttgctgaagcccaatgcgacagtgatcttgcgcaatggccaaaatagacatgttcaaaggatcaatgaagcttgcagtgaacaagtgggggcgggatgaggctgtaaagccagccagtttcacgggtgaaggaagacaaccacctgtcctctatagagtatgaanttggttaatgtggctgagtaactgtcaaatccaggcgtttctgccccctttatttcgtgccctaagaaggaagtaccaggaatgaacattataacccc

SEQ ID NO: 50565 - protein, 118 aa, Zea mays
  misc_feature: Ceres CLONE 1463521-F
MSTAAAQGGSDKPALRRPVFTKVDQLRPGTNGHTLTVKVVSATPVPGRARPGAPAAAPSRAPRIAECLVGDETGAIVFTARNDQVDLLKPNATVILRNGQNRHVQRINEACSEQVGAG

SEQ ID NO: 50566 - DNA, 653 bp, Zea mays
  misc_feature: Ceres CLONE 1463522-F
  misc_feature: Encodes the peptide sequence at SEQ ID NO. 50567
tggagctccccgcggtggcggccgctctagaactagtggatcccccgggctgcaggaattcgcacgagaccattacctagaacatcctaatcgaaaaattccgcctccaccccccgaactccaaaccctagtagcgccgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtccgatgcgaggagatctgcatgtccggcggcctcgtccgccagaagatgaagtacctccgcttcctccgcaagaggatgaacaccaagccctcccacgggcccgtccacttccgcgccccggccaagatcctctggcgcaccatccgcggtatgattccgcacaagaccgcgagggggcgaggccgcgctcgccaggctcaaggcgtacgagggcgtgccgccgccgtacgacgggacaagcgcatggtcatccccgacgcgctcaagttctgaggctgcagcctgggcacaggtactgcctcctcggcagctctccaggaaggcggatgggactacgccgacacatcagggagctggaggaaaaaagaa

SEQ ID NO: 50567 - protein, 131 aa, Zea mays
  misc_feature: Ceres CLONE 1463522-F
  misc_feature (11)..(127): Pfam Name: Ribosomal_L13 Pfam Description: Ribosomal protein L13
MVSGSGVCAKRVVVDARHHMLGRLASIVAKELLNGQRVVVVRCEEICMSGGLVRQKMKYLRFLRKRMNTKPSHGPVHFRAPAKILWRTIRGMIPHKTARGRGRARQAQGVRGRAAAVRRDKRMVIPDALKF

SEQ ID NO: 50568 - DNA, 665 bp, Zea mays
  misc_feature: Ceres CLONE 1463526-F
  misc_feature: Encodes the peptide sequence at SEQ ID NO. 50569
ggagctccccgcggtggcggccgctctagaactagtggatcccccgggctgcaggaattcgcacgagaccattacctagaacatcctaatcgaaaactgttgcgccggccaccacagtgcagaagaacacacagcatccgcctgcctcgccgcagcaatggccgccgccgccgccgtggcgagatcctttctccggtacagcggctcatcgtccctccgcagcgcggcggccagagccgcctcgcgggccggaccggttccgctgccgaggcggatgcccagttctgggccccgcgtactcctaagcgtgtgcctggagtccctgatgcccatgcacagcgccacggcttcggcgctcatgacgtcgctactcgctgccccggcttgcaaggggttgggttggctatcaaaagatggatgatttgtcattattggagacctgcagtgatggtatctggtctggattatggaatacctcgtgaatttatagtacttggttggcgtctcagttaacatgttttgtgctctgggattccagtttgtatgaaatttacataattcttcctgagatttattttggctcactagctgtcaaaaagactttggtcttgacgaccaggctgatcatgtacatctggactgaatgaacttgattaaaggctttc

SEQ ID NO: 50569 - protein, 87 aa, Zea mays
  misc_feature: Ceres CLONE 1463526-F
MAAAAAVARSFLRYSGSSSLRSAAARAASRAGPVPLPRRMPSSGPRVLLSVCLESLMPMHSATASALMTSLLAAPACKGLGWLSKDG

SEQ ID NO: 50570 - DNA, 683 bp, Zea mays
  misc_feature: Ceres CLONE 1463529-F
  misc_feature: Encodes the peptide sequence at SEQ ID NO. 50571
tccccgcggtggcggccgctctagaactagtggatcccccgggctgcaggaattcgcacgagaccattacctagaacatcctaatcgaaaactcgagcagccacttccgtctctaaccctacagcgacgacgagagcgaggccatgaaggggaagaagccggtcaaggagctcaagctcaccgtgccggcgcaggagaccccggtagacaagttcctgacggcaagtggcacgttcaaggatggtgagctgaggctcaatcagagcggcttgcggcttatctctgaggaaaacggggatgaagatgaatctacaaagctgaaggtggaagatgtgcagttatcaatggatgatcttgacatgattcaagtcggtgtggggaaaggaaaccggcggtgttgtccagctcacccacgcacaaatgggtgggcacattattctgccttaaagggtattcaaatgaatattcaggagtcggttcgtaaacaaataggacgggagctccaaaataaaccaagcaacacacacccctccaatagttatggtgcatcaattctttttacccccgaggggggaaaatacgctggttccttggacacccgggaccgggggaaccgccttgccgacctctgttaaccacagcaaaaaactattcctgcgacccctccctttgacaaggaattt

SEQ ID NO: 50571 - protein, 163 aa, Zea mays
  misc_feature: Ceres CLONE 1463529-F
  misc_feature: SWISSPROT Homolog: EC 2.7.12.2 Mitogen-activated protein kinase kinase
MKGKKPVKELKLTVPAQETPVDKFLTASGTFKDGELRLNQSGLRLISEENGDEDESTKLKVEDVQLSMDDLDMIQVGVGKGNRRCCPAHPRTNGWAHYSALKGIQMNIQESVRKQIGRELQNKPSNTHPSNSYGASILFTPEGGKYAGSLDTRDRGNRLADLC

SEQ ID NO: 50572 - DNA, 692 bp, Zea mays
  misc_feature: Ceres CLONE 1463533-F
  misc_feature: Encodes the peptide sequence at SEQ ID NO. 50573
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
ggagctccccgcggtggcggccgctctagaactagtggatcccccgggctgcaggaattcgcacgagaccattacctagaacatcctaatcgaaaagtttcttccacgccgtcgctgccgagttcccatcttccccctcaggtacgagttcccatcttccacgccgccgagtactctttggaaatggaggcgccagcaggtggactcggcagcaggtggcctccacgctgccgagttcccatcttccctcacgcggatggaggcgcctccagcaggcaccaatgcagttgaagctccttctgaagtgtagagattaaatagagtttggaatggtcttttagacgtcattagacacatgcaagtctcagctgatgagttgaggaggttgaccagacgcaatcatgtacctgagtatgtagagtacctgcacaaaaatagcctagttaatgccatgagtgttgtcactgaaattgcacaaggtctagaccatgtgagcacagatctggaggaaagtcttattggtctgtaacctcttcttgaagatatgaagccctggnnnttgtacatgatcgtcgtctaccgcatatgaacgagcgtatatgagatattggttggcgagagagtctgtaccactaatgcatgtatcttatgaattgtactgcctttctgtcaagtctgtatcttatgaagcc

SEQ ID NO: 50573 - protein, 57 aa, Zea mays
  misc_feature: Ceres CLONE 1463533-F
MQVSADELRRLTRRNHVPEYVEYLHKNSLVNAMSVVTEIAQGLDHVSTDLEESLIGL

SEQ ID NO: 50574 - DNA, 659 bp, Zea mays
  misc_feature: Ceres CLONE 1463535-F
  misc_feature: Translation starting site: 368
tggagctccccgcggtggcggccgctctagaactagtggatcccccgggctgcaggaattcgcacgagaccattacctagaacatcataatcgaaaaatcggctgcggccggccgtctcccctgcctacttcggcaacgccatccagagcgctgtgacgacggcgacggtgacggagctgctggcttgcagcgatctacggtgggccgcgggcaagctgaacgcgagcctcgcggcgtacggcgacggcgcgatccggcgcgcggcggcggcgtggcaggccgcgccccggtgcttcccgctgggcaaccccgacggcgcggtgatcacgatgggaagctccaaccggttcccgatgtacgagggcaatgacttcggggtgggggcggcccctcgcggtgcggagcggccgcgccaacaagttcgacggcaagatgtcggcgttcccgggacgcgccggggacggcagcgtggacatcgaggtgtgcctgaccccggacaccatggcggcgctgctccgcgacaccgagttcatgcagtacgtgtcgggcccgtcgcatctgttgtgatgaactactataccggggccctgcctgccgggcccaagtgggggccatcgggtcgggcgggctcagggctggggctgctgtttaatttgcc

SEQ ID NO: 50575 - DNA, 673 bp, Zea mays
  misc_feature: Ceres CLONE 1463541-F
  misc_feature: Encodes the peptide sequence at SEQ ID NO. 50576
ggagctccccgcggtggcggccgctctagaactagtggatcccccgggctgcaggaattcgcacgagaccattacctagaacatccaatcgaaaaaattggagtgcaagcgacgcgtcgagccccatcccgttcccgcgcctcgccgagagatctgcgccgtcgtcggcaccaatccgtacacccgtcagtccgtccgtcgtcggcgccggcgaacgagtagagatggaggagacggcggcagcggcaccggctgagaaggcgtcgtcgtacaggtactgggtgcgggaagccaccggcgacgccgcgccgctccccgtcccgcgcaagctcgaccccgccgccaatgggaacgggaacccgccgcccctcgggtccgtctggaatcaggctggaacttgggaggaaaagaacctcaactcatgggctaatagtaggataaaggatttgctgggctctctaggttcattgaagttccctacagggaatgcatccgttgatgaagtgtccaagtggtcaggcaatgcctttcaggtcactgtccgcaacaagaagagagtaggatataactacaaactaagcttggaatttaaaggtgaatggtttgttaaggaagaaacgagaagatcaagggaccctttgactttcccgagttctcgttcggtgagatcgag

SEQ ID NO: 50576 - protein, 149 aa, Zea mays
  misc_feature: Ceres CLONE 1463541-F
MEETAAAAPAEKASSYRYWVREATGDAAPLPVPRKLDPAANGNGNPPPLGSVWNQAGTWEEKNLNSWANSRIKDLLGSLGSLKFPTGNASVDEVSKWSGNAFQVTVRNKKRVGYNYKLSLEFKGEWFVKEETRRSRDPLTFPSSRSVRS

SEQ ID NO: 50577 - DNA, 674 bp, Zea mays
  misc_feature: Ceres CLONE 1463545-F
  misc_feature: Encodes the peptide sequence at SEQ ID NO. 50578
  misc_feature (674)..(674): n is a, c, t, g, unknown, or other
ggagctccccgcggtggcggccgctctagaactagtggatcccccgggctgcaggaattcgcacgagaccattacctagaacatcctaatcgaaaagcaactactcatcctttccatcaaaactgagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgccaccggcaagacgaatcccgcagattgcattcattcgaggggcgattaaaatcaaggggagcatcagggcggcgcagaagttcacccctgaaatcttccccaagcctgctaaactgtaaaaggttagattgggtattactttggccaaggggaataataatgtttgcaagcttcaattaccaggtacgagaatn

SEQ ID NO: 50578 - protein, 99 aa, Zea mays
  misc_feature: Ceres CLONE 1463545-F
  misc_feature: SWISSPROT Homolog: EC 2.3.1.176 Propanoyl-CoA C-acyltransferase
MDSSSLKSAQLLELMRQHLATDAGKEVTKKVGLVYQLNIAPKKIGVDEEIFVVDLKKGEVTKGPYQGKPDATFSFTDNDFLGIATGKTNPADCIHSRGD

SEQ ID NO: 50579 - DNA, 693 bp, Zea mays
  misc_feature: Ceres CLONE 1463546-F
  misc_feature: Encodes the peptide sequence at SEQ ID NO. 50580
ggagctccccgcggtggcggccgctctagaactagtggatcccccgggctgcaggaattcgcacgagaccattaccagaacatcctaatcgaaaagtcaatgcatgataagtacctttgcttatctcttcgctcgcaaaaagcgccacaagagttccttttttgcatattttatgtgccttgaagtacaggcacttgttccagctggttctcctaatgctaataagagtaaatccagaggaaatgacccggatgatgatctgtgtcttatggatccagatggcaacaatctgaaacctgccccgtcgccatggcgtcctggctgacgtcgtggatgccaagcccatgcctgcgttgaaagagagggagaccagacacacccggtggccctggcggtagtagtgccaaggttctattcactgtgagtccgcgacgcgccatggatcgcgtgcagccgacgattcctccgctgccatctgcccacaaacagacgactctggcggcgaattggagcacttcgagagcggcgacgcgttcaatgttccggttagatgggatcattggcgatcgaagcttgctagcaactatcacggatgtagcttccatacgaagacatggcacctcttcaggcagcaaatggccgttggtcaaagagatgctggaagaaagatcctgctctaagaccaagctttgc

SEQ ID NO: 50580 - protein, 73 aa, Zea mays
  misc_feature: Ceres CLONE 1463546-F
MISTFAYLFARKKRHKSSFFAYFMCLEVQALVPAGSPNANKSKSRGNDPDDDLCLMDPDGNNLKPAPSPWRPG

SEQ ID NO: 50581 - DNA, 682 bp, Zea mays
  misc_feature: Ceres CLONE 1463548-F
  misc_feature: Encodes the peptide sequence at SEQ ID NO. 50582
  misc_feature (441)..(441): n is a, c, t, g, unknown, or other
ggagctccccgcggtggcggccgctctagaactagtggatcccccgggctgcaggaattcgcacgagaccattacctagaacatcctaatcgaaaaaaagttccctaaccggctaaccctaatttcacggccgcccacccgccagcgccctgcgcccagccggcaccctaagttcccacttcccagttcccacccgccagccgccaaccgcccagcccgctgccccgctcccgccccgagctgcgcggctgcgcccccaagctgcgcgcctgcgccgtccccgaggcccgagctgtgcctgcgtcgtccgtcgtggcccgagctgcgcctgcgccgtccccgaggcccgagctgcgcggctgcgcccccgagctgcgccgtccgtcggcccccactcgtcgttcctcccgtcgcgcggcgcagcgctcacgcaaggccctncgaccagcagatcgacgggcttcaccgcggatcgaccagcagatcaacgccgcccttcagaccctcagggatcacctgtatcagctcaagatcaatatttttttaaaatgagtaagctggcaaatatgttctcggctctttggctggatgctgaaagcaatgaagatgttggccgagctgaagtaccacaggcgtcttccaacacagacaaaactgctgcaagcaaacctgataaaaatga

SEQ ID NO: 50582 - protein, 44 aa, Zea mays
  misc_feature: Ceres CLONE 1463548-F
MSKLANMFSALWLDAESNEDVGRAEVPQASSNTDKTAASKPDKN

SEQ ID NO: 50583 - DNA, 701 bp, Zea mays
  misc_feature: Ceres CLONE 1463549-F
  misc_feature: Encodes the peptide sequence at SEQ ID NO. 50584
  misc_feature (373)..(373): n is a, c, t, g, unknown, or other
  misc_feature (404)..(404): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaccattacctggaacatcctaatcgaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggttcctcttcaaccgcgccgccgcctacgcctccttggccgcggcccaggcggcgcccgccacccggccgttagncacctggaagaccggcggcggcaatattacngacaaccccaccggtgccggcgccatcggccaggtgttccaggtgatcggcgccgtcgtcgacgtgcgctacgatgcaggcctcccgcccatcctcacggcgttcgaggtgctctacaacgacatccgcctcgtgctcgaggtggcgcatcaccttggcgagaacatggngcccaccatccctatggaacggacggaggggctcgttcgggccctgtgcgttctcaaaagtggcctcccccatcaccgtggctggttggcaggcttacccttggaacgtgtaattaagggtgtcggt

SEQ ID NO: 50584 - protein, 172 aa, Zea mays
  misc_feature: Ceres CLONE 1463549-F
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (63)..(63): Xaa is any aa, unknown, or other
  misc_feature (130)..(130): Xaa is any aa, unknown, or other
MASRRVVSSLLRSASRLRAASPAAPRPRGAPHRPSPAGFLFNRAAAYASLAAAQAAPATRPLXTWKTGGGNITDNPTGAGAIGQVFQVIGAVVDVRYDAGLPPILTAFEVLYNDIRLVLEVAHHLGENMXPTIPMERTEGLVRALCVLKSGLPHHRGWLAGLPLERVIKGVG

SEQ ID NO: 50585 - DNA, 685 bp, Zea mays
  misc_feature: Ceres CLONE 1463551-F
  misc_feature: Encodes the peptide sequence at SEQ ID NO. 50586
  misc_feature (429)..(429): n is a, c, t, g, unknown, or other
aagctggagctccccgcggtggcggccgctctagaactagtggatcccccgggctgcaggaattcgcacgagaccattacctagaacatcctaatcgaaaaactcggtccctgtccatccgtagcgttccattccattccatcccatccccggaaagtgcaaggacggggagggagagcggccggcgcgtcacaaataccaccagcccaggggccatggccgccgcgatgaccagcttcgtcgccaagaacccgctgctcgcggccgcggcgcggcgcagggcgcctcccctcgcggggcgcgccctgccgttctctccgctcaggctgaggaccgtcacgtgcttcgtgccgcaggacacggcggccccggccgctcccgtgccggcgctggacgaggaggccagggccgcggcggcgcggcgcgtcncggagaaggaggcgcggaagcggtccgagcggcggacgtacctggtggccgccgtgatgtctagccctcgagtcacgtccatggccgtcgcccgcgtgtactatcgcttcagctggcaaatggagggcggcaaggtgccggtgatcaagacgctgggcacgttcgcgctctccgtcgggggcggcggtcgggatggagttctggggcgcggtgggcccaccgggcgctgtgccacgcctccctgtgcacatgcaca

SEQ ID NO: 50586 - protein, 156 aa, Zea mays
  misc_feature: Ceres CLONE 1463551-F
  misc_feature (72)..(72): Xaa is any aa, unknown, or other
MAAAMTSFVAKNPLLAAAARRRAPPLAGRALPFSPLRLRTVTCFVPQDTAAPAAPVPALDEEARAAAARRVXEKEARKRSERRTYLVAAVMSSPRVTSMAVARVYYRFSWQMEGGKVPVIKTLGTFALSVGGGGRDGVLGRGGPTGRCATPPCAHA

SEQ ID NO: 50587 - DNA, 661 bp, Zea mays
  misc_feature: Ceres CLONE 1463559-F
  misc_feature: Encodes the peptide sequence at SEQ ID NO. 50588
  misc_feature (216)..(216): n is a, c, t, g, unknown, or other
aagctggagctccccgcggtggcggccgctctagaactagtggatcccccgggctgcaggaattcgcacgagaccattacctagaacatcctaatcgaaaaagaacacttgagcagactagcaaggccttcagaccgggagggctccctgtcctgtcccccgcgccgccgcggatggccggagcccacacgccggcatcaggcgccctcgtcaggntctgcctgccttcgctccttctctttctgtccggggcctgcaaatgtaaggctgttaaaatggaaaaaacctttgcaagatccaccccgaaggttgtccggggatttcccaaaaccatccggggggccccctgggatttggatttttatcccccaaaaaaccgggccccctttgttgtaaagggcccttttttttttgggggatttccccaaaagtttttttcgccccttaaaaaaaaaaaagggggcccttttttttttttttttaaaaaaacaccccccctccggggggttttttttttgccccctgtgaaaaaaaaccccccccctcccccaaccaaaaaaagggggtggggggccaaaaaaaaaaaagggggtggtgttttcccccccccgggagaaaaatttttttttttttttaaaaaaaaccctcccgggggaggaaa

SEQ ID NO: 50588 - protein, 162 aa, Zea mays
  misc_feature: Ceres CLONE 1463559-F
  misc_feature (15)..(15): Xaa is any aa, unknown, or other
MAGAHTPASGALVRXCLPSLLLFLSGACKCKAVKMEKTFARSTPKVVRGFPKTIRGAPWDLDFYPPKNRAPFVVKGPFFFGGFPQKFFSPLKKKKGGPFFFFFKKTPPLRGVFFLPPVKKNPPPPPTKKRGWGAKKKKGGGVFPPPGEKFFFFFKKNPPGGG

SEQ ID NO: 50589 - DNA, 708 bp, Zea mays
  misc_feature: Ceres CLONE 1463565-F
  misc_feature: Encodes the peptide sequence at SEQ ID NO. 50590
  misc_feature (448)..(448): n is a, c, t, g, unknown, or other
  misc_feature (450)..(450): n is a, c, t, g, unknown, or other
  misc_feature (457)..(457): n is a, c, t, g, unknown, or other
  misc_feature (460)..(460): n is a, c, t, g, unknown, or other
  misc_feature (471)..(471): n is a, c, t, g, unknown, or other
  misc_feature (474)..(474): n is a, c, t, g, unknown, or other
aaagctggagctccccgcggtggcggccgctctagaactagtggatcccccgggctgcaggaattcgcacgagaccattacctagaacatcctaatcgaaaaatcgatgggcaactgccaggcggcggagacggcgacggtgctgatccagcacccgggcggcggccgcacggagcgcgcctactgggcgctctcggcgggggccgtcatggcggcgaacccgggccactacgtcgcggccgtcatcaccgtctcgcagccgggcggcgcgggagacgacggagctgcctctgcctctgccgccgcgcccgtgaagcacctcaagctgctccgccccgacgacacgctcctgctcggccgcgtctaccgcctcgtcagcttcgaagaggtgctgcgggagttcgcgtcgaagcggcacgtgaagctgagccgcgtgacggtccggccnangacgaangcnaggacttgaanccngccccccagcatcgccgtcgtcgcgccagcgggggggagagcgtaaggaatcggagcggtcctccccaaggttcatgggcaaacggaagaaccacttggtgccaaaggaagggcccgggcttcgggccccgcccccaagtttctccaagaaaggggaaccccaaaacgcccgggcgggccttaaaaccaacttggagggccctccctgcaccccaccgggggtttttccccccc

SEQ ID NO: 50590 - protein, 120 aa, Zea mays
  misc_feature: Ceres CLONE 1463565-F
  misc_feature (115)..(115): Xaa is any aa, unknown, or other
  misc_feature (117)..(117): Xaa is any aa, unknown, or other
MGNCQAAETATVLIQHPGGGRTERAYWALSAGAVMAANPGHYVAAVITVSQPGGAGDDGAASASAAAPVKHLKLLRPDDTLLLGRVYRLVSFEEVLREFASKRHVKLSRVTVRPXTXART

SEQ ID NO: 50591 - DNA, 706 bp, Zea mays
  misc_feature: Ceres CLONE 1463568-F
  misc_feature: Encodes the peptide sequence at SEQ ID NO. 50592
aaagctggagctccccgcggtggcggccgctctagaactagtggatcccccgggctgcaggaattcgcacgagaccattacctagaacatcctaatcgaaaaacgtattcagtttttcacacaacggcggcgatgtcgtcggcctcctcctccgccgccgccgccaacgccggtgaaggaagcgggggtgcggaggagggcgtggagatcacttacgtgagctatggcggggagcagcatctgccgctggtgatgtcgctggtggacgaggagctcagcgagccctattccatcttcacctaccgctacttcgtctacctctggccgcagctcaccttcctggcgttcgatgccagggatggcaagtgcgtggggacagtcgtgtgcaagatgggggagcataggggtgcattcaggggctacatcgccatgctcgtcgtcctcaagccctaccgagggaggggaatagcaactgagctagttactagatcaattcgggcaatgatggaatctggctgtgaggagcttgtatcttctgatcaggtgacacttgaagcagaagttactaataagggtgcccttgctctgtatggtcgccttgggtttatccgagcaaagagattgtacagatactatctaaatggtgtagacgcatttcggctgagactactgtttccgcgcccctgatatgacccacaaatatttg

SEQ ID NO: 50592 - protein, 184 aa, Zea mays
  misc_feature: Ceres CLONE 1463568-F
  misc_feature (71)..(159): Pfam Name: Acetyltransf_1 Pfam Description: Acetyltransferase (GNAT) family
  misc_feature: SWISSPROT Homolog: EC 2.3.1.88 Peptide alpha-N-acetyltransferase
MSSASSSAAAANAGEGSGGAEEGVEITYVSYGGEQHLPLVMSLVDEELSEPYSIFTYRYFVYLWPQLTFLAFDARDGKCVGTVVCKMGEHRGAFRGYIAMLVVLKPYRGRGIATELVTRSIRAMMESGCEELVSSDQVTLEAEVTNKGALALYGRLGFIRAKRLYRYYLNGVDAFRLRLLFPRP

SEQ ID NO: 50593 - DNA, 708 bp, Zea mays
  misc_feature: Ceres CLONE 1463571-F
  misc_feature: Encodes the peptide sequence at SEQ ID NO. 50594
  misc_feature (511)..(511): n is a, c, t, g, unknown, or other
tggagctccccgcggtggcggccgctctagaactagtggatcccccgggctgcaggaattcgcacgagaccattacctagaacatcctaatcgaaaaacgtttctctgcgactcgcacggcccgcgcccaccaccgaccaccccacctggttcggtcggcactcggcaccccgccccgcatacatgccgccgcccagcctcaccgtggcgcgcgacccggccgccgccgccaccacgcggcaccgcaaggtccacccgacgccgggcggaggcgcagggacgactaaggagatgggcgcggcggaggggtgggcgcggcccgagtggtgctcggtggcgggcgccgcggccgtgctgcggcggcacccggcgcccgcgctcctcgggtgcggcctcctgctcttcatgcccccccagtacaccatccttatggtcaggccggacgcgccgccgctcgacctgggcttcgtcgccaccaggggcttgcacgccgccgtcgccgcgagggccntggttcaactcgttcctcgccgcgctcaacacggtcttcgtcgcgatgcaggcggcgaacatcctgtgggccatcctcggcaagcaggggccgcgcgccgccgtccccacgctcatgatgttcacctgccggggcgcgctgggttgcgccacccatcttcccgttgccgaagaatttcctggggttccggaaggacc

SEQ ID NO: 50594 - protein, 175 aa, Zea mays
  misc_feature: Ceres CLONE 1463571-F
  misc_feature (110)..(110): Xaa is any aa, unknown, or other
MPPPSLTVARDPAAAATTRHRKVHPTPGGGAGTTKEMGAAEGWARPEWCSVAGAAAVLRRHPAPALLGCGLLLFMPPQYTILMVRPDAPPLDLGFVATRGLHAAVAARAXVQLVPRRAQHGLRRDAGGEHPVGHPRQAGAARRRPHAHDVHLPGRAGLRHPSSRCRRISWGSGRT

SEQ ID NO: 50595 - DNA, 677 bp, Zea mays
  misc_feature: Ceres CLONE 1463572-F
  misc_feature: Encodes the peptide sequence at SEQ ID NO. 50596
aagctggagctccccgcggtggcggccgctctagaactagtggatcccccgggctgcaggaattcgcacgagaccattacctagaacatcctaatcgaaaactcccggctcagacttctgctgcagcgcctccgccgccgccgccgcatctaacgcagttccctccgccgcagcccgaggcaagatggttctccagatcgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctgggtttggtttgaattgggagagactaatggctccttggaatttatattaaggatggttgacgataaaaaaaaaaaaaaaaaaccttatcggataccgcgca

SEQ ID NO: 50596 - protein, 86 aa, Zea mays
  misc_feature: Ceres CLONE 1463572-F
  misc_feature (30)..(84): Pfam Name: Ribosomal_S27e Pfam Description: Ribosomal protein S27
MVLQIDIDLLNPPAELEKLKHKKKRLVQSPNSFFMDVKCQGCFSITTVFSHSQTVVVCPGCQTVLCQPTGGKARLTEGCSFRRKGD

SEQ ID NO: 50597 - DNA, 687 bp, Zea mays
  misc_feature: Ceres CLONE 1463573-F
ggagctccccgcggtggcggccgctctagaactagtggatcccccgggctgcaggaattcgcacgagaccattacctagaacatcctaatcgaaaaatctccttcacgccttctcgctagctgttctttcctcctctctcaaccctaaccctagatctctgctaccttcctcctcccctccagctagcacaagtctgttcatcttgctgtctttgttgctcatcgtgctccagttctgttcctagctcgctacatatagcgttatactgcatgcccaaaacggaacacatgtttgtgctctcctggccggccagtctcttcattccttgcacagttgcaaatacagttgtgtgacagagataaacagagagtcaaatacgtacataaagaggtttgatcaaattcaaatttgtgtgcgtgcctggctccctgtatgccacacatgtagcgcccaacccagatgctaaggttgcctgctgtgggtggcgtgcaaggggccaagcatgcatccatgcatgcatgcacttttgttcgattcattcttcatgccactttttgatggctagtaccatgtgtgtgtttccatatgttcatgtttcgatatgatgtaatttcatgtttggtatatatgcatgcatatatatacatcaaaaaaaaaaaaaaaaaagcttatcgataccgtcgacc

SEQ ID NO: 50598 - DNA, 711 bp, Zea mays
  misc_feature: Ceres CLONE 1463575-F
  misc_feature: Encodes the peptide sequence at SEQ ID NO. 50599
tcaccgcggtggcggccgctctataatagtggatcccccgggctgcaggaattcgcacgagaccattacctagaacatcctaatcgaaaaaaaacaataccttcttctttgcctctccccctgcagaaagacaaaaccttctctctctgtttatcggtaatggtgtctcgttatgacctagtgctctctcagcagtccaaagttcatccatactttttctcatcgcggggatctctttctatgcgaaaaacccccttaccactgccaatcacaggctcaaacccctcgggaacgagaatgacaaccatcgcgtggggaagctacccgatggatctcgcggactgccagaagaggaaggatactctctaattgacgagggtaaacgacgacatcctcaagaccccctcctccaatccccacgtgctcaacttcttccctaatcaaaccgtccaggtcgagaagaatcgcttcgagatctaccagatcgtgaaatcgtcttctctccagagccacacctccaatttcctcaacatccaggtcgagccgaatctgatcaacatattgaccgacctcgagaaggagttcgagattgtgtacaacaagataacgtacacgcagttggccgagggtacatcgatgatgaagctggagcccctcccacttgctcatatcgccaaacatgtccaaaaccttgaccggtgcgaaaaaaat

SEQ ID NO: 50599 - protein, 69 aa, Zea mays
  misc_feature: Ceres CLONE 1463575-F
MVSRYDLVLSQQSKVHPYFFSSRGSLSMRKTPLPLPITGSNPSGTRMTTIAWGSYPMDLADCQKRKDTL

SEQ ID NO: 50600 - DNA, 741 bp, Zea mays
  misc_feature: Ceres CLONE 1463576-F
  misc_feature: Translation starting site: 149
  misc_feature (335)..(335): n is a, c, t, g, unknown, or other
  misc_feature (401)..(401): n is a, c, t, g, unknown, or other
  misc_feature (448)..(448): n is a, c, t, g, unknown, or other
  misc_feature (454)..(454): n is a, c, t, g, unknown, or other
  misc_feature (471)..(471): n is a, c, t, g, unknown, or other
  misc_feature (476)..(476): n is a, c, t, g, unknown, or other
aaaagctggagctccccgcggtggcggccgctctagaactagtggatcccccgggctgcaggaattcgcacgagaccattacctagaacatcctaatcgaaaaaccctatcgcccctcctctgtctcctctcttgcccacccgccccaatgtcgccgcccctcgagccccacgactacatcggcctctccgccgtggccgcggccgcgccgccgaccccgaccccgacctcctcctcctcttcgtcctcctcgccggccccccgtctcacccttcgcctcggcctgccgggctccgagtcccccgaccgcgaccgggactgctgcgaggacgtcnccgctacgctcttcctcggctcgctgccggcggcccgctgccgtctccgccaagcgcgccttcccnggacccgcctagcgcccccggcgctttcaaggctagcgacgccaagnagaggntttccccggcggggcgncgggncgcaaagcgcaaggtggtggaatgcccccccgtgcccactaccgggagaatacccttcgcggccggaactgcttcagaaccaagggccccggggaaagaagccccttccggaactggccccttgttcttgaaggggaactgggatgggcccccctaactcccggaagggggaaataaaaatgatttccggctaaaagaacccttcccctgggcctaaaaaaaattttccccctttttttccggggggaaaagggggtcggaaaaa

SEQ ID NO: 50601 - DNA, 762 bp, Zea mays
  misc_feature: Ceres CLONE 1463580-F
  misc_feature: Encodes the peptide sequence at SEQ ID NO. 50602
  misc_feature (327)..(327): n is a, c, t, g, unknown, or other
aaagctggagctccccgcggtggcggccgctctatactagtggatcccccgggctgcaggaattcgcacgagaccattacctagaacatcctaatcgaaaaacgaaaaaagcgaaccgagggagaggaaggatcggcgcgttccggccggagatgaggggcggatccagaccggccccggtcgtcctgtttctcctcgctgcgtccgggatctgcgcccagttcaccgcagtgctagctggtgatccccaaacatccaacgatgataagaaggctgaagctcagccaaagggccataccggcaaaacagttttgttcgtcctcctangagtgggggctgtcattctgttgccatttgttatttccaagtatggacaaaaaaaaaaaaggtcggaaccccttgcccgtccgcccaccctatttttaaaaggattgaccaattttgaggttgaacttgggccttcgaaaattgaaaaccttcctttggaacccccaaaggttatctgggcggaacagggttttggttggtttgcccctcaaaacatattttttttgttaagggaaaaaatttttttttttttttaaccttggaagggctcccccacaaaaagggggggggggggattttcccttttatataaaaagagaaaacctcttgtggggggcggggtggttttaatatttttttgggggaaagattcctgggggtgggaaaaacctttttttgtgtgttggaggttcctaaaaaaatatggggggggcc

SEQ ID NO: 50602 - protein, 143 aa, Zea mays
  misc_feature: Ceres CLONE 1463580-F
  misc_feature (59)..(59): Xaa is any aa, unknown, or other
MRGGSRPAPVVLFLLAASGICAQFTAVLAGDPQTSNDDKKAEAQPKGHTGKTVLFVLLXVGAVILLPFVISKYGQKKKRSEPLARPPTLFLKGLTNFEVELGPSKIENLPLEPPKVIWAEQGFGWFAPQNIFFLLREKIFFFF

SEQ ID NO: 50603 - DNA, 717 bp, Zea mays
  misc_feature: Ceres CLONE 1463582-F
  misc_feature: Encodes the peptide sequence at SEQ ID NO. 50604
  misc_feature (461)..(461): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
agagctggagctccccgcggtggcggccgctctagaactagtggatcccccgggctgcaggaattcgcacgagaccattacctagaacatcctaatcgaaaaacaccaggcacgccagcctcactcactccccagaccacctcacacgcacgaagcagcagcagtggactggactagctctaggtgggcaacatgaagcttcaggccaccgccagagttgctggcctcctcttcttcctcgtcctcctcctggcgctgccttccctccgcgtctccatggctggatcagggttctgcgacggcaagtgcgcggtgaggtgctcccaggcgagccggcacgacgactgccctcagtactgcggaatctgctgcgccacctgcaactgcgtgccgtccgggacagcgggcaacaaggacgagtgcccatgctaccgcgacatgaccacgggaaaggcaaccgnaccagggcccagggcccctgaagaattcatacgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50604 - protein, 101 aa, Zea mays
  misc_feature: Ceres CLONE 1463582-F
  misc_feature (6)..(93): Pfam Name: GASA Pfam Description: Gibberellin regulated protein
  misc_feature (90)..(90): Xaa is any aa, unknown, or other
MKLQATARVAGLLFFLVLLLALPSLRVSMAGSGFCDGKCAVRCSQASRHDDCPQYCGICCATCNCVPSGTAGNKDECPCYRDMTTGKATXPGPRAPEEFIR

SEQ ID NO: 50605 - DNA, 737 bp, Zea mays
  misc_feature: Ceres CLONE 1463590-F
  misc_feature: Encodes the peptide sequence at SEQ ID NO. 50606
  misc_feature (639)..(639): n is a, c, t, g, unknown, or other
  misc_feature (641)..(641): n is a, c, t, g, unknown, or other
  misc_feature (677)..(677): n is a, c, t, g, unknown, or other
  misc_feature (699)..(699): n is a, c, t, g, unknown, or other
  misc_feature (700)..(700): n is a, c, t, g, unknown, or other
ggagctccccgcggtggcggccgctctagaactagtggatcccccgggctgcaggaattcgcacgagaccattacctagaacatcctaatcgaaaaatccaaacaaaccgcgtgatccgtctgaccgctcgctcgctctcgccgggggtccggagctccccacctccagcgacccagtccatccgcgcgtgcagcgccgcggcgccgatggagtacgacttccgcggcggccgctcgagctcgggcccgggcccctacggcgcgcctccggggggcgcgcccgggggaggctcctcgctctacccgcgcgtcgggcagccctcccacggcgggggcggggcctccacggcgtctccgcgggccgcgccgtaccaccacggctccgggtccggatccggctccgggtcctcggctcccgtcgtaacgccgttggctccaacctccttctcctcgtcctcgtcctcgtcctcgaaagtgggcatacaaggtgcgataaaggctgaatttcgcaatacccccccttcctcaattggcaccccagagagggtaagattcctcgccggcccccccccctcctttttttttttaaataaagaaaagagaattctttttggggggggaaagaagaaccaccatgtncncggaatattttttttggaaaaagaaaaaaaaggggncgcgctttttgggaccacaagnnaaaaaataccacccccctgttgtagggggggggggat

SEQ ID NO: 50606 - protein, 176 aa, Zea mays
  misc_feature: Ceres CLONE 1463590-F
  misc_feature (145)..(145): Xaa is any aa, unknown, or other
  misc_feature (157)..(157): Xaa is any aa, unknown, or other
  misc_feature (164)..(164): Xaa is any aa, unknown, or other
  misc_feature (165)..(165): Xaa is any aa, unknown, or other
MEYDFRGGRSSSGPGPYGAPPGGAPGGGSSLYPRVGQPSHGGGGASTASPRAAPYHHGSGSGSGSGSSAPVVTPLAPTSFSSSSSSSSKVGIQGAIKAEFRNTPPSSIGTPERVRFLAGPPPSFFFLNKEKRILFGGGKKNHHVXGIFFLEKEKKGXALFGTTXXKIPPPCCRGGG

SEQ ID NO: 50607 - DNA, 706 bp, Zea mays
  misc_feature: Ceres CLONE 1463596-F
  misc_feature: Encodes the peptide sequence at SEQ ID NO. 50608
aagctggagctccccgcggtggcggccgctctagaactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctccaaaatatgattcgtctggtctggcgcgcgtgagtccagctcgtgtgtcgtgcgtgtctctgtgtgaggtgtcggcgggcgtgtgtgtatgtatggagtcggccgcggcggcggcggaggaggaggtgtgcgcgtggtgggtggtacgtgcttcgacgcgccactgtttgtcgcggcgatcatgtactaccctgctgcgttttctgggtatcaatgagatgatttatttgattcttttcaaaaaaaaaaaaaaaaagcttatcgataccgtcgacctccgaggggg

SEQ ID NO: 50608 - protein, 57 aa, Zea mays; identical to SEQ ID NO: 43282
  misc_feature: Ceres CLONE 1463596-F

SEQ ID NO: 50609 - DNA, 682 bp, Zea mays
  misc_feature: Ceres CLONE 1463601-F
  misc_feature: Encodes the peptide sequence at SEQ ID NO. 50610
  misc_feature (596)..(596): n is a, c, t, g, unknown, or other
  misc_feature (608)..(608): n is a, c, t, g, unknown, or other
  misc_feature (651)..(651): n is a, c, t, g, unknown, or other
  misc_feature (654)..(654): n is a, c, t, g, unknown, or other
ctccccgcggtggcggccgctctagaactagtggatcccccgggctgcaggaattcgcacgagaccattacctagaacatcctaatcgaaaaacacccagattctttcgattctttcacggttccacccctcccctccctctcgtgctcgatccatcgccgctgcctactccccatggcctcagcgaacaacgacgaccgcgaggcggcgggcatcctgcggctgctgatggggatggcagcggcggcggcgcccgcctcggcattgcctcggggcggcggcggcggcctgatgatggtgcagcacgtcatcctcgacgtcaacggggaactgttctcgggcggggtcggcggcggcggcgtgccgccggcgtcaaaggccgcgatcgccgcgctgaaggaggtgaaggccggggagggcgaggacgcgcttggcgagtgcgccatctgcctggacgcggtggagggcaccggcaaggagatgccgtgcgggcactgcttccacgggcgctgcctggagcggtggctcggcgtgcacggcaactgccccgtctgccgccgcgagctgcagcgccggccaaggagggagaggaggangacagctcggcntccgcggagggctgcaagaaggagaggcggaggcctaggcccncgntcgtcgtcagctacctcgtggtcggagc

SEQ ID NO: 50610 - protein, 169 aa, Zea mays
  misc_feature: Ceres CLONE 1463601-F
  misc_feature (89)..(127): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature (141)..(141): Xaa is any aa, unknown, or other
  misc_feature (145)..(145): Xaa is any aa, unknown, or other
MASANNDDREAAGILRLLMGMAAAAAPASALPRGGGGGLMMVQHVILDVNGELFSGGVGGGGVPPASKAAIAALKEVKAGEGEDALGECAICLDAVEGTGKEMPCGHCFHGRCLERWLGVHGNCPVCRRELQRRPRRERRXTARXPRRAARRRGGGLGPRSSSATSWSE

SEQ ID NO: 50611 - DNA, 645 bp, Zea mays
  misc_feature: Ceres CLONE 1463602-F
  misc_feature: Encodes the peptide sequence at SEQ ID NO. 50612
  misc_feature (409)..(409): n is a, c, t, g, unknown, or other
ggagctccccgcggtggcggccgctctagaactagtggatcccccgggctgcaggaattcgcacgagaccattacctagaacatcctaatcgaaaaaaggtctgaaaaaatcacagaactcactcgaacgacggtgccgccgcttgcctcgccggaccatggccgctgtgccgtcggggttcctcctcatcactggcccgccgggcgtggggaagacgacgctggtcatgcgggtgtttgaaaccctcagaggctcccacccgaacctcaacattcgcggattctatacccgagaggtgagagagggcggagaaagatagggttcgaggttgtcacgctcgacggtagaactggaccacttttcctcatgcaaggtttccagcccggagtctgtttagatggcctaccntcgggaataccaagtagacgtagcatccttggaatcattaccagtacctgaactgcaggttagggaagaaacagatctcttcatcattaacaaatggggaaaaatggaacttgttcattccaccttttttccccgggggaaaatggaagttttttgaacccccatatacccggtggttggcccaccaaaaccccttttcccaagggggggggcccgggggaattttccccgggggt

SEQ ID NO: 50612 - protein, 53 aa, Zea mays
  misc_feature: Ceres CLONE 1463602-F
  misc_feature: SWISSPROT Homolog: EC 2.7.4.8 Guanylate kinase
MAAVPSGFLLITGPPGVGKTTLVMRVFETLRGSHPNLNIRGFYTREVREGGER

SEQ ID NO: 50613 - DNA, 685 bp, Zea mays
  misc_feature: Ceres CLONE 1463612-F
  misc_feature: Encodes the peptide sequence at SEQ ID NO. 50614
  misc_feature (375)..(375): n is a, c, t, g, unknown, or other
  misc_feature (518)..(518): n is a, c, t, g, unknown, or other
tcaccgcggtggcggccgctctagaactagtggatcccccgggctgcaggaattcgcacgagaccattacctagaacatcctaatcgaaaaacggaagtcatttctccctatctaaggccacctttcactccgccgttctctgtcacgaccgggaaaaacctcgccgccgccggcctcctctctcttgccttccatcccccgttgcgtcgaaccgtccctctcggtaaacccgcatcgccttgaacccttaacctccaggcggaggatccgccgaaaggctggaccagttacccccatcctgcacggcgcaggggagtagagagaggatgatggagtcggaggtggtgaggatggagatggtgctggcgccaacnctgccgttcaagaaggtgcagacgccccacaagtatcccaagggccagtcccggggccgccagtggaagcacctgcgccacctgctccagtccgctgatgcatcctccatgcccccggaccgccccaattatatgaatatccnatcgcccccctccatttacccaccaaagagatactgtgacttaacaggttttgaggcacggtacgtggatccgaaggacaaagttgcgctactctgatccagaaggtgttcaaccagatcaggatgctttcctgatgaatacgtccaagggtacttgggcttgagaa

SEQ ID NO: 50614 - protein, 94 aa, Zea mays
  misc_feature: Ceres CLONE 1463612-F
  misc_feature (63)..(63): Xaa is any aa, unknown, or other
MESEVVRMEMVLAPTLPFKKVQTPHKYPKGQSRGRQWKHLRHLLQSADASSMPPDRPNYMNIXSPPSIYPPKRYCDLTGFEARYVDPKDKVALL

SEQ ID NO: 50615 - DNA, 697 bp, Zea mays
  misc_feature: Ceres CLONE 1463630-F
  misc_feature: Encodes the peptide sequence at SEQ ID NO. 50616
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
aaagctggagctccccgcggtggcggnngntctatcaataaaggatcccccgggctgcaggtatccccacgagaccattacctagaacatcctaatcgaaaatcctgttcgcgtgtttattctgcgccgagactgaaaacggcatcagtagcagacgcaggcgaccacgaggagtgacggcatcagctgcggcagcgacgcccaacaacggcacctcatgggcgccgacaacgacgacgctgccgctgtggcggcacgagagagggaggcggagatccagcaggacatgcgcgcccgcgtctcacacttcaagaagcaggccgactccttgacccttgaaggcgttagaagagcactgaaaaaggacctgggtttggagacatattcacttgatgcacataaaaacttcataaatcaatgtgtagacaaggtttttgctgaatcccatgatgaaaatgcaaatgataatgcttcagaggatcctgaagccaaagattatttatccaaagaagagaaagatgttggtaaacaaatgcctgtttgaaacaaaacgtccttcaatgctgatgtcgaaacatgtggcaagatagaaaaggatcctgaaggaggaagggatcaaacttccagcagtgatattagtgaagacgtgataaaagaagccattgaacacaggtcgtcttatcttagaaagaactcg

SEQ ID NO: 50616 - protein, 108 aa, Zea mays
  misc_feature: Ceres CLONE 1463630-F
MGADNDDAAAVAAREREAEIQQDMRARVSHFKKQADSLTLEGVRRALKKDLGLETYSLDAHKNFINQCVDKVFAESHDENANDNASEDPEAKDYLSKEEKDVGKQMPV

SEQ ID NO: 50617 - DNA, 683 bp, Zea mays
  misc_feature: Ceres CLONE 1463635-F
  misc_feature: Encodes the peptide sequence at SEQ ID NO. 50618
aagctggagctccccgcggtggcggccgctctagaactagtggatcccccgggctgcaggaattcgcacgagaccattacctagaacatcctaatcgaaaagccagtccgacagatacgtacgcgtcatccggtcaggtgcatggtccacgccggtgcccctgctcaacgattagccgccgccgccgccgtcgtcatcgagttcggtggatccgggcgctctactccaacttcagcgagttcacggcggaccaggagcgcctcatctccctcggcagcggcggcggcggcggacgccggttcgactacgtggagggcttcgtcgtcgccgccgagggcctcatcaacaactggaggtcctccttcttctcgccgcagaaccccgtgaagctcacctcgctcaagcaccattccggcgtcctctactgcctcgaggtcaccaagaactacgacgacgaaaccgcagggtcggtggaccaggacgtggatacgctactgggcgagctgaacttcctccctggcacggtgttcactacggacctgccgtacgtggacttcctggaccgcgtgcacaaggcggagctgaagctgcgcgccaaggggatgtgggaggtgccgcacccgtggctcaacctcttcgtgccggcgtccggcatcgccgacttcgaccgcggcgtcttccgg

SEQ ID NO: 50618 - protein, 227 aa, Zea mays
  misc_feature: Ceres CLONE 1463635-F
  misc_feature (65)..(227): Pfam Name: Cytokin-bind Pfam Description: Cytokinin dehydrogenase 1, FAD and cytokinin binding
  misc_feature: SWISSPROT Homolog: EC 1.5.99.12 Cytokinin dehydrogenase
AGAPRGGGRSRTSGSPGLQEFARDHYLEHPNRKASPTDTYASSGQVHGPRRCPCSTISRRRRRRHRVRWIRALYSNFSEFTADQERLISLGSGGGGGRRFDYVEGFVVAAEGLINNWRSSFFSPQNPVKLTSLKHHSGVLYCLEVTKNYDDETAGSVDQDVDTLLGELNFLPGTVFTTDLPYVDFLDRVHKAELKLRAKGMWEVPHPWLNLFVPASGIADFDRGVFR

SEQ ID NO: 50619 - DNA, 723 bp, Zea mays
  misc_feature: Ceres CLONE 1463639-F
  misc_feature: Encodes the peptide sequence at SEQ ID NO. 50620
aagctggagctccccgcggtggcggccgctctagaactagtggatcccccgggctgcaggaattcgcacgagaccattacctagaacatcctaatcgaaaaaagcctcagtccaatccgcggcccaaaaactccccccgacaaccgaacaggagcggcggcggcggcggcactaccctctccagcaatcggcatgggcacgcgggaggtgtacgaggagaagctccgcagcggtgcgcacctccaccgcgatcccaccatcaacccaggcctcggctcgccccggtgcccgcgatgcctctccctcctcaaccccaccgcgggaaagagggactgggccatcacctccgtcctgcacgacgccactgccgtggctgggtccggtgccggcgctttgctcagtgctgtgcaccggtttaacacagggatccttttttgtcaaaaacatgtcaaggggccaaatggctgcatttgcccgtggggggccccccctgctaaatttcccgggggccagggctggaattggggcaaaagcccttcccaagttttgttccgttgaaaggggaccttttaaaaccgggaataaatgggttccgaaattggtgttttccaattcccccggggaaaaaaaaaaagtttttttttcaaaaacccccccgaaaaacgggggagggggggggggacacccccttcctctattgggggggaaaaaaacaaaaaaaaa

SEQ ID NO: 50620 - protein, 121 aa, Zea mays
  misc_feature: Ceres CLONE 1463639-F
MGTREVYEEKLRSGAHLHRDPTINPGLGSPRCPRCLSLLNPTAGKRDWAITSVLHDATAVAGSGAGALLSAVHRFNTGILFCQKHVKGPNGCICPWGAPPAKFPGGQGWNWGKSPSQVLFR

SEQ ID NO: 50621 - DNA, 667 bp, Zea mays
  misc_feature: Ceres CLONE 1463653-F
  misc_feature: Translation starting site: 298
  misc_feature: SWISSPROT Homolog: EC 2.7.11.2 [Pyruvate dehydrogenase (acetyl-transferring)] kinase
  misc_feature: SWISSPROT Homolog: EC 2.7.11.4 [3-methyl-2-oxobutanoate dehydrogenase (acetyl-transferring)] kinase
ccgctcttttctagtggatcccccgggctgcaggaattcgcacgagaccattacctagaacatcctaatcgaaaaacccatattccattttggttatcctcttgcgtcacacctcctccctcctggcctcctcctgcggcccacttatatataccaccacgtcgatgcgctgctccgccggcatctccatcgccgtcgcgccgccgtagatggcctgacatttttcacttcatttgtcatcccaattccacaaacctcgcgcgcggcggcggagggaaacaaaaaaaaaaaggaaggatggcgttggagccggtggcgcgggcggtggcggaggaggtggcgcgctggggcgcgatgcgccagaccggggtcagcttgcgctacatgatccacttcggggtgcgccccacggagcggaccctcctgctcgccgcacagttcctgcacaaggagctccccatccgcatcgcgcgacgggcgctcgacctcgactcgctccccttcggcctctccaccaagcccgccatcctcaagatatgttacaccacatctacatctcatgatttttgagctggtgaagaactcccttcgcgcagtacaggaacggtatatggattctgataagcttgcacctccggttcgaatcatagttgctgatggagcagag

SEQ ID NO: 50622 - DNA, 723 bp, Zea mays
  misc_feature: Ceres CLONE 1463655-F
  misc_feature: Encodes the peptide sequence at SEQ ID NO. 50623
ggcggccgctctagaactagtggatcccccgggctgcaggaattcgcacgagaccattacctagaacatcctaatcgaaaaacacgcaaaattccccatcccacaaggaagccacgccctcgcgcaccagcgcgaccggaccagaccgcccgtctgaccgacgcaacccagccgtccagacgcgccgccgaccgtccttccaccaccacgcccgcgccgtcgcacgctccctagggttccgcagggccggggatcgccggagatggactggagcgcggtgacggcggaggacttggtggacgcgctgccggaggtggactggatcatgccgccggggcctgtctcggaggtctacacccgcttcaccgtctcaccctattaataaaacccccccgggggggcttaggggcgacctcttattagtacaggaccacccatttgcacctgatcatgtcccgcccgaggaatgagctcccttttggatgcccgctcggccatatggctggcctccctaaacggggctttataattcgcattctccccatggccgattttttccgtttttctcttccaatgacgatagttcgcccgggccggggagaatcaattttttccaccctccgccccgaaaaagctagagggcccgcctatcagctcggaggtttttccgtgggtggaaccaagggttgtaaaaagagcgaatgccgctttgtggggggcgca

SEQ ID NO: 50623 - protein, 39 aa, Zea mays
  misc_feature: Ceres CLONE 1463655-F
MDWSAVTAEDLVDALPEVDWIMPPGPVSEVYTRFTVSPY

SEQ ID NO: 50624 - DNA, 696 bp, Zea mays
  misc_feature: Ceres CLONE 1463656-F
  misc_feature: Encodes the peptide sequence at SEQ ID NO. 50625
aagctggagctccccgcggtggcggccgctctagaactagtggatcccccgggctgcaggaattcgcacgagaccattacctagaacatcctaatcgaaaacatgggtggggagatgtacatgtcacctctgaagaaaccatttcctcttgtaccagtggttgcttctcaaggaattaaaatcggttcaatcaagggatatatggaagcaggggcatctgcagtggtcttatctgatgctatttttgacagtcaattgatgacggatgggaaattcaatgaaatttcggaacttgcaaatctagcaactttagaggcattgcagttcacgaaatgagacaaatctacaatcataacagatttgcgtctagaatatgtggccttctgttctgtggaaagattcaattcacgcccccccaactacttgctatttctgtgcaaagagtcagttcacctcctaaataaagctgtacgagctctggtgttctatgcacctgcaagaggctgagactgcaacaaatttgtgtgctccgaagtctgaacaggaacctgatcattgaggatgcctggatgcttaaaagcccaccatacatttaggtcgccttgtaatggactccccaccactcccaagaaaaccagaggggaactggaagagagattgctgggtttgctttgagctttgactaacctaaaatta

SEQ ID NO: 50625 - protein, 77 aa, Zea mays
  misc_feature: Ceres CLONE 1463656-F
MGGEMYMSPLKKPFPLVPVVASQGIKIGSIKGYMEAGASAVVLSDAIFDSQLMTDGKFNEISELANLATLEALQFTK

SEQ ID NO: 50626 - DNA, 707 bp, Zea mays
  misc_feature: Ceres CLONE 1463711-F
  misc_feature: Encodes the peptide sequence at SEQ ID NO. 50627
ggagctccccgcggtggcggccgctctagaactagtggatcccccgggctgcaggaattcgcacgagaccattacctagaacatcctaatcgaaaagagacaggcggaccaaacccacacccatacaaggccaaggggcaggcaaccctcctcaagcctcaagcaaccaacgcggcgccaaggaagaacccctcccttcttccacccaccgatccttccctccgttcctcgtcctcgccggcgacgacctgcagccatggcaatggcttacaagatggcgacggaggggatgaacatcaaggaggagtgcaagcggtggttcacggagatgaagtggaagaaggtgcaccgcttcgtggtgtacaagatcgacgagcggacgcgcgccgtgctggtggacaaggtgggcggccccggggaggggtacgacgagctcgtcgccgcgctgcccggcgacgactgccgctacgccgtcttcgacttcgacttcgtctccgtcgacaactgccagaagagcaagatcttcttcatcgcatggtcgccggcggcgtcgaggataagggccaagatcctgtacgcgacgtcgaagcaaggcctgcggcgggtgctggagggggtccactacgaggtgcaggccaccgagcgctccgagatgggcttcgacgtcatcagagagcgcgcgcaatgagcgagccgccgcccagagc

SEQ ID NO: 50627 - protein, 143 aa, Zea mays
  misc_feature: Ceres CLONE 1463711-F
  misc_feature (16)..(143): Pfam Name: Cofilin_ADF Pfam Description: Cofilin/tropomyosin-type actin-binding protein
MAMAYKMATEGMNIKEECKRWFTEMKWKKVHRFVVYKIDERTRAVLVDKVGGPGEGYDELVAALPGDDCRYAVFDFDFVSVDNCQKSKIFFIAWSPAASRIRAKILYATSKQGLRRVLEGVHYEVQATERSEMGFDVIRERAQ

SEQ ID NO: 50628 - DNA, 716 bp, Zea mays
  misc_feature: Ceres CLONE 1463713-F
  misc_feature: Encodes the peptide sequence at SEQ ID NO. 50629
  misc_feature (526)..(526): n is a, c, t, g, unknown, or other
  misc_feature (541)..(541): n is a, c, t, g, unknown, or other
  misc_feature (542)..(542): n is a, c, t, g, unknown, or other
aagctggagctccccgcggtggcggccgctctagaactagtggatcccccgggctgcaggaattcgcacgagatcattacctagaacatcctaatcgaaaactatagcccaaatggcagctctcctgaaccctacggctcggcgcctcaccctcgctgcctgccgccgcctctctacggcgccggcggtggagcccctcgtggctcactggagcacccaagcaagatacaattccagtctggtggaggttaatggcggatttggggagatggttgccgacacaaagaggtactacgtgcttggaggcaaaggtggtgttgggacaacaagcatggcagcatcgcttgctatgaagtttgccaaccatggtgaaccgacgctcatagtttctatgcacccagcacattcactgggtgatacatttgaacaagacctgagtggcggtaatattgtacctgtcaatggagtcgactctctttttgctagcgagatggccatgttaatacaaagaagaatcttcctatantggatcttttatgcnntaataactggacaagataggcttggaattccctgcgatccgctggaaacaaataactgcctggaatgctaaggaaacccccggatttggaaaacccgtgcaattccaacctgatcaaaatccccaacgccaaaaaccaaaatttggccctaattttggatcccgggcacgggct

SEQ ID NO: 50629 - protein, 166 aa, Zea mays
  misc_feature: Ceres CLONE 1463713-F
  misc_feature: SWISSPROT Homolog: EC 3.6.3.16 Arsenite-transporting ATPase
  misc_feature (138)..(138): Xaa is any aa, unknown, or other
  misc_feature (144)..(144): Xaa is any aa, unknown, or other
MAALLNPTARRLTLAACRRLSTAPAVEPLVAHWSTQARYNSSLVEVNGGFGEMVADTKRYYVLGGKGGVGTTSMAASLAMKFANHGEPTLIVSMHPAHSLGDTFEQDLSGGNIVPVNGVDSLFASEMAMLIQRRIFLXWIFYAXITGQDRLGIPCDPLETNNCLEC

SEQ ID NO: 50630 - DNA, 551 bp, Zea mays
  misc_feature: Ceres CLONE 1463731-F
  misc_feature: Encodes the peptide sequence at SEQ ID NO. 50631
  misc_feature (299)..(299): n is a, c, t, g, unknown, or other
  misc_feature (313)..(313): n is a, c, t, g, unknown, or other
aagctggagctccccgcggtggcggccgctctagaactagtggatcccccgggctgcaggaattcgcacgagaccattacctagaacatcctaatcgaaaaattccgcctccacccccgaacttcaaaccctagcagtagcgccgccgccgccaggtaagaggcgagatggtgtccggctccggcgtgtgcgccaagcgcgtggtggtggacgcccgccaccacatgctcgggccgcctggccctcgatcgtcgccaaagaagctgctccaccgggcacgcgtggtggtgtcccctgcnagaaatctgatgtncggggggctcttcgccaaaaaatgaataccctcctttctccgaaagggattaaaaacaaggccttccccggcccctttcatttcggggccgggaaaaaactttgggcccctctcggggtttgttccccaaaaacccccgggggggggggcccccctccccggtttaaggggattagggggccccccccccccttaaaaaaagaaaaagttttgttgttccccccccccccctctggtt

SEQ ID NO: 50631 - protein, 56 aa, Zea mays
  misc_feature: Ceres CLONE 1463731-F
  misc_feature (49)..(49): Xaa is any aa, unknown, or other
MVSGSGVCAKRVVVDARHHMLGPPGPRSSPKKLLHRARVVVSPARNLMXGGLFAKK

SEQ ID NO: 50632 - DNA, 689 bp, Zea mays
  misc_feature: Ceres CLONE 1463737-F
  misc_feature: Encodes the peptide sequence at SEQ ID NO. 50633
  misc_feature (682)..(682): n is a, c, t, g, unknown, or other
ggagctccccgcggtggcggccgctctagaactagtggatcccccgggctgcaggaattcgcacgagaccattacctagaacatcctaatcgaaaaccttaaagtggtgtggactgtttgttatccccttccctctccggccggccctcgcggcggagaacccaaccaaacacaccagccgccgccccgacgacatgccgccgtccctcctactccccgcctccgcctccgcctccgcctccgcctcctcctcctctggtattagtatggggaggatgtcacctccgcagccacccactcccctgctcgtctgcttccccgcgcgccgcagccgcaaccgcctccatgcggatgtggggctccgccatcagcacgccgacggacccgacgatgtcaacggcgccgcctctcctggtccagaggacggcagctcctacaacctgcccaaaaaccggaaggatattctcccggaatacgcacaaggcgcccagccagatcttatggagcttttcgtgaatagaacccctacacgcgtcgtcgatgccatgctccatactcactctaatatgattggcactctgccacctcaggttattgctgtaacagtcagaagtgctgctgcacatactgtacagctgatgcacagcgctttgatgactggatacatggtcatgcatgcgcncctctcc

SEQ ID NO: 50633 - protein, 141 aa, Zea mays
  misc_feature: Ceres CLONE 1463737-F
  misc_feature (139)..(139): Xaa is any aa, unknown, or other
MGRMSPPQPPTPLLVCFPARRSRNRLHADVGLRHQHADGPDDVNGAASPGPEDGSSYNLPKNRKDILPEYAQGAQPDLMELFVNRTPTRVVDAMLHTHSNMIGTLPPQVIAVTVRSAAAHTVQLMHSALMTGYMVMHAXLS

SEQ ID NO: 50634 - DNA, 698 bp, Zea mays
  misc_feature: Ceres CLONE 1463797-F
  misc_feature: Encodes the peptide sequence at SEQ ID NO. 50635
tccccgcggtggcggccgctctagaactagtggatcccccgggctgcaggaattcgcacgagaccattacctagaacatcctaatcgaaaatcaaagcgccgacggggttccacggcgcccgtaatttcaaccgtccccaccgccgcgggctcctcctgacggaccccgaaggtcgccgtgactcccgcccctcgccggcgacgtccggcatgccgtcctcccgcctcgtccacctcatcctcctcgcgacgctctcgctcctcctcgcccaaaccctagcctcctctgcccccgtgcccgccgccgcgtcggcgtcgacggagtccggcgacccctgcgcggccgccgtagctgacggggaagctgacgttccgctgtgccccgtgcggtgcttccgccctgacccggtctgcggcgccaacggggtcacgtactggtgcggctgccccgaggcgacctgcgcgggcgcccgcgtggcgcgacgcggctactgcgaggtcggcgccagctccggctccgcgcccgtctccggccaggcgctgctgctcgtccacatcgtctggctcttcgtgctcggcgccgccgtcctcctcggtttcctctgatgcgcctctcccgttcccgcagttatatttccctcccccattattctttgtcccgattctgggtgggttggttgccttcttggtgggacgga

SEQ ID NO: 50635 - protein, 131 aa, Zea mays
  misc_feature: Ceres CLONE 1463797-F
MPSSRLVHLILLATLSLLLAQTLASSAPVPAAASASTESGDPCAAAVADGEADVPLCPVRCFRPDPVCGANGVTYWCGCPEATCAGARVARRGYCEVGASSGSAPVSGQALLLVHIVWLFVLGAAVLLGFL

SEQ ID NO: 50636 - DNA, 668 bp, Zea mays
  misc_feature: Ceres CLONE 1463798-F
  misc_feature: Translation starting site: 203
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (440)..(440): n is a, c, t, g, unknown, or other
  misc_feature (441)..(441): n is a, c, t, g, unknown, or other
  misc_feature (444)..(444): n is a, c, t, g, unknown, or other
  misc_feature (445)..(445): n is a, c, t, g, unknown, or other
  misc_feature (448)..(448): n is a, c, t, g, unknown, or other
  misc_feature (467)..(467): n is a, c, t, g, unknown, or other
  misc_feature (476)..(476): n is a, c, t, g, unknown, or other
  misc_feature (482)..(482): n is a, c, t, g, unknown, or other
  misc_feature (483)..(483): n is a, c, t, g, unknown, or other
  misc_feature (489)..(489): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (540)..(540): n is a, c, t, g, unknown, or other
  misc_feature (541)..(541): n is a, c, t, g, unknown, or other
  misc_feature (564)..(564): n is a, c, t, g, unknown, or other
  misc_feature (569)..(569): n is a, c, t, g, unknown, or other
  misc_feature (578)..(578): n is a, c, t, g, unknown, or other
  misc_feature (580)..(580): n is a, c, t, g, unknown, or other
  misc_feature (581)..(581): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (594)..(594): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (614)..(614): n is a, c, t, g, unknown, or other
  misc_feature (615)..(615): n is a, c, t, g, unknown, or other
  misc_feature (634)..(634): n is a, c, t, g, unknown, or other
  misc_feature (642)..(642): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (658)..(658): n is a, c, t, g, unknown, or other
  misc_feature (666)..(666): n is a, c, t, g, unknown, or other
ggagctccccgcggtggcggccgctctagaactagtggatcccccgggctgcaggaattcgcacgagaccattacctagaacatcctaatcgaaaaatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccgggcatacggcagccgaagcggcaagtacccgcggggaggaaaggtggggggcccaaggaacgggaaggtttgccccggggaaaaaacccttgtggagagaaaagggggggggcgcccccccaaaaaaaannnncnnccnntcnctttctccctcgggcgggntttgggggnggggtnnccggcnccccccgggagataaaaaaaaaaaagaggaaggggggggggggnnnngagnnaggtgggtggggggttttggggnatgtntcgtgggananngcgnnncccggcncacggacgcgccgannnntnncgctcccgggcggagcggncggggggnagnnnnnagaggaggntaggaagnag

SEQ ID NO: 50637 - DNA, 700 bp, Zea mays
  misc_feature: Ceres CLONE 1463799-F
  misc_feature: Encodes the peptide sequence at SEQ ID NO. 50638
  misc_feature (589)..(589): n is a, c, t, g, unknown, or other
ggagctccccgcggtggcggccgctctagaactagtggatcccccgggctgcaggaattcgcacgagaccattacctagaacatcctaatcgaaaaacacgcacttctcgttctcgccgatccagtgccactacactacaatactactgcgcggtagcgctcgcactcgcaccacaccacgccaccgctgctgcctgctcctcacagtcctccccgcgctcgcattgcgattcgcgacctagcgcgagggtacggggggtggtgcgcgcgcgtgctcggtgatccgggaagcgccgcgagatggccgggggcggaggcggcggtgccgcgccgaagcacgacgacttcacgccgcaccccgtcaaggaccagctccctggggtctcctactgcatcaccagccctcccccgtggcctgaagacgttcttcttgggttccaacattatctggtcatgcttggtaccgctgtgatcataccaactgcacttgttccacaaatgggaggaaacaatgaggacaaagcagtggttatccaaacattgatgttcgttgccggtatcaaccccctcctgcagagttttctttggnaccatgttgcctgcagtgatcggcgggccatacacactttgtcctgcctaccatttcagatcacccttgcctggacgttatgctaatgaaacctaacccccataattaaag

SEQ ID NO: 50638 - protein, 124 aa, Zea mays
  misc_feature: Ceres CLONE 1463799-F
  misc_feature (97)..(97): Xaa is any aa, unknown, or other
MAGGGGGGAAPKHDDFTPHPVKDQLPGVSYCITSPPPWPEDVLLGFQHYLVMLGTAVIIPTALVPQMGGNNEDKAVVIQTLMFVAGINPLLQSFLWXHVACSDRRAIHTLSCLPFQITLAWTLC

SEQ ID NO: 50639 - DNA, 657 bp, Zea mays
  misc_feature: Ceres CLONE 1463802-F
  misc_feature: Translation starting site: 167
  misc_feature (339)..(339): n is a, c, t, g, unknown, or other
  misc_feature (341)..(341): n is a, c, t, g, unknown, or other
  misc_feature (458)..(458): n is a, c, t, g, unknown, or other
  misc_feature (498)..(498): n is a, c, t, g, unknown, or other
ggatcccccgggctgcaggaattcgcacgagaccattacctagaacatcctaatcgaaaaatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtaccgcgggaggaaggtgggggccaggacggaggtgcgggactttgnanggcgacggcgaggtgcacgagctcggccgcctcccccccgccgagtacaaccggcagctccgagaaggtggcggcggcggcggcaggctcgagttcggcagggtggtggcggcgcancggcaggtggtgtcggggctcaagtactacctccgcgtcntgtccttggaggagggcggcgcgggggaaaggatgagagcgcggtgttcgacgccgtcgtcgtcttctagccctggcttgatttgggcaccctgttcacgttctcgccggcggccgccatgtaagcgcggccctccccccggtgtaaacgtcataaaga

SEQ ID NO: 50640 - DNA, 660 bp, Zea mays
  misc_feature: Ceres CLONE 1463814-F
  misc_feature: Encodes the peptide sequence at SEQ ID NO. 50641
  misc_feature (480)..(480): n is a, c, t, g, unknown, or other
aagctggagctccccgcggtggcggccgctctagaactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctccaaaatatgattcgtctggtctggcgcgcgtgagtccagctcgtgtgtcgtgcgtgtctnctgtgtgaagtgtccggcgggcgtgtgttgtatgttatgggatccggccccccccggccccgaaaaaaaaaaaaggttccccccgggggggggggaaaaatggtttttaaaacccccccccttgtttttttttgggcggcgaaaaaaaaaaaaaaacacccccccgcccgcggtgttttt

SEQ ID NO: 50641 - protein, 57 aa, Zea mays; identical to SEQ ID NO: 43282
  misc_feature: Ceres CLONE 1463814-F

SEQ ID NO: 50642 - DNA, 707 bp, Zea mays
  misc_feature: Ceres CLONE 1463824-F
  misc_feature: Encodes the peptide sequence at SEQ ID NO. 50643
  misc_feature (693)..(693): n is a, c, t, g, unknown, or other
aagctggagctccccgcggtggcggccgctctagaactagtggatcccccgggctgcaggaattcgcacgagaccattacctagaacatcctaatcgaaaagattcactcacccatgtcgccgtatgttgcgcctgaggacggaccaatcttgcggacctccgaccagctactcctccaggtcctcctcatggcctgtgcctcggtctctgccctcagcggatgcgtgaagagaatgcgatatggaattgtcctccggcatcccctcctattctcctcgtgtggtccccagctccgcggccgtcaacctgatcaacgcactcaacctccaccacggcgacgaaacaacatccctctctccactcggctgcgtagagggtgccctcacaccccccgggacactctgcgagaggacgatccacttcgcgtctttcacgaacggcaagccctccgcgctgatggaatgactcggcctgcggcttggtgatttcgcctcaggcgaccgcacgacaccagaatgctctacttcggtctgcactcgagagggctcgaagatgaccccgtgatgatcagtctcaccgactgcccggatgctccatttagttcgcgctctgctatcagaacgctccttactcattggaatagattgtcgctcgccaggaagtgtttagctgggacaatcatctaatcttantatgtcgaacagca

SEQ ID NO: 50643 - protein, 56 aa, Zea mays
  misc_feature: Ceres CLONE 1463824-F
MLYFGLHSRGLEDDPVMISLTDCPDAPFSSRSAIRTLLTHWNRLSLARKCLAGTII

SEQ ID NO: 50644 - DNA, 704 bp, Zea mays
  misc_feature: Ceres CLONE 1463827-F
  misc_feature: Encodes the peptide sequence at SEQ ID NO. 50645
aagctggagctccccgcggtggcggccgctctagaactagtggatcccccgggctgcaggaattcgcacgagaccattacctagaacatcctaatcgaaaactgtccagtcctctgtcctcaccttatccccaaaaccctatcagcccaaaaccgaacccacacctctgcggctctgcccttcccatggcggccacgctattctccacctccctcttgccccagttcctctccctctccgctaagcccgccgccgccgccccgtccgccgccgccttcccatcggggctgccgcagctccacgcgctgtccgccgcggcggtgggctttaggccgctcgagcccgtgcgagcggccgcgaccgcggccgtgacggaagagctcgaggcggaggggcgttcgggcggggacgagttttcagatgatctcagggtcttcgtcggtaaccttccgttcagcgtcgacagcgcccagctcgcgggacttttcgagcaggccggctccgtcgagatggtcgaggttatctatgacatattgacgggtagaagccgtggattcgggtttgtgaccatgtcttcggtcgaagaggttgaggtggctgttgaccaacttaatggctatgtgcttgatgtaagaagtttgagggtgaactctgtgccagcaccacccagagatcggtcatcaccgtcaccgcaaagacccatg

SEQ ID NO: 50645 - protein, 173 aa, Zea mays
  misc_feature: Ceres CLONE 1463827-F
  misc_feature (83)..(154): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAATLFSTSLLPQFLSLSAKPAAAAPSAAAFPSGLPQLHALSAAAVGFRPLEPVRAAATAAVTEELEAEGRSGGDEFSDDLRVFVGNLPFSVDSAQLAGLFEQAGSVEMVEVIYDILTGRSRGFGFVTMSSVEEVEVAVDQLNGYVLDVRSLRVNSVPAPPRDRSSPSPQRPM

SEQ ID NO: 50646 - DNA, 736 bp, Zea mays
  misc_feature: Ceres CLONE 1463832-F
  misc_feature (328)..(328): n is a, c, t, g, unknown, or other
  misc_feature (334)..(334): n is a, c, t, g, unknown, or other
  misc_feature (348)..(348): n is a, c, t, g, unknown, or other
  misc_feature (349)..(349): n is a, c, t, g, unknown, or other
  misc_feature (358)..(358): n is a, c, t, g, unknown, or other
  misc_feature (361)..(361): n is a, c, t, g, unknown, or other
  misc_feature (368)..(368): n is a, c, t, g, unknown, or other
  misc_feature (408)..(408): n is a, c, t, g, unknown, or other
ggagctccccgcggtggcggccgctctagaactagtggatcccccgggctgcaggaattcgcacgagaccattacctagaacatcctaatcaaaaatttttttggtgtacggttctgccatctaccgtcgcatcgccggctacaccacgcccccgctccatccctgcagcgcgtccgcggccctccgccctcgccctcccccctccccacaaatctcgcctcctcacccaacgccatcagcgctgccctccgctccatccctgtagcgcagaccttcgccaccgtccctgcccttccctcacgcgcaatcaccgcccttcccgacgtngctcgnccgccatccacggnnatcacttcnttncccaagngcgcgccccctcctctgtgcgtgccccgcccccgtctttngctcacccgatgccccgccacctccgcccggaaaagctccccccaagagtgcccccgggaggctttcattcccctccccccctatttccccccgtttcaacaatttgcccccaaggcctcccgcggataggaaacacccactgaaccggggctcccaccctggttaaaaaaaatctggggaaaaaccccggggggggcccaaaatttcctttggggggggccgggggttttaaagggcctccaaaaggttacccccccgggccattttattttgggcacaccctattgggggcccccccccccgtggggaaaaagacaacataaaaac

SEQ ID NO: 50647 - DNA, 693 bp, Zea mays
  misc_feature: Ceres CLONE 1463836-F
  misc_feature: Encodes the peptide sequence at SEQ ID NO. 50648
  misc_feature (647)..(647): n is a, c, t, g, unknown, or other
ctggagctccccgcggtggcggccgctctagaactagtggatcccccgggctgcaggaattcgcacgagaccattacctagaacatcctaatcgaaaaacatccaaaattcccagtccgcgatacaagaccaatccaatcccagcggaagtggaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattattggctccatttttctcaggggtttcagcctactgcccgccatggccgcccacccactagcctgcgcttgaggcagctagtagtagatactgtaggttgaccagtgatccacggtgtgtttctcgctttccttttgtctgttgatttctattggctatactacacggtgctgtaaaggatcaattagttctgcctttgaggccctcatttggtgtaaatatttttgataacatggaccatggaaaaaactttcctttngaaaaaaaaaaaaaaaagcttatcgataccgtcgacctcgaggggg

SEQ ID NO: 50648 - protein, 65 aa, Zea mays; identical to SEQ ID NO: 44442
  misc_feature: Ceres CLONE 1463836-F

SEQ ID NO: 50649 - DNA, 705 bp, Zea mays
  misc_feature: Ceres CLONE 1463840-F
  misc_feature: Encodes the peptide sequence at SEQ ID NO. 50650
aagctggagctccccgcggtggcggccgctctagaactagtggatcccccgggctgcaggaattcgcacgagaccattacctagaacatcctaatcgaaaactgttccacaagggcgagctcctcctcagctcaaaccccgtgcacaagaaggtgcccgtgctcatccaccacggcaagcccatctgcgagtccctcgccgtcgtggagtacgtcgatgaggtctggcccggcgccgccgccaccatcctccccgccgacccccacggtcgcgccaccgctcgcttctgggccgcctacatcgacggcaagctgtttccggcgtggacagggatcatgaaggcggcgacggaggaagcgagggcgcataagctgagggagacgcacgccgcggtcctcaacctggagaaggccttcgccgagatcagctctagctccagcaacgacggcgcggccttcttcggcggcgactccgtcgggtacctggacctcgcgctcgggtgctccctgccgtggttcggggcgctgcgcgccatgctcggcgtcgagatcatcgacgccgccccagctccgctcctggtggcgtgggccgagcggatttggggagacccccgtggccaaggaggtgctgccccaacccggacgaagcctgtggcccaccccaaaaaaaattcaggccctcctgggcttcttggtaaaaaatgag

SEQ ID NO: 50650 - protein, 233 aa, Zea mays
  misc_feature: Ceres CLONE 1463840-F
  misc_feature: SWISSPROT Homolog: EC 4.4.1.5 Lactoylglutathione lyase
AGAPRGGGRSRTSGSPGLQEFARDHYLEHPNRKLFHKGELLLSSNPVHKKVPVLIHHGKPICESLAVVEYVDEVWPGAAATILPADPHGRATARFWAAYIDGKLFPAWTGIMKAATEEARAHKLRETHAAVLNLEKAFAEISSSSSNDGAAFFGGDSVGYLDLALGCSLPWFGALRAMLGVEIIDAAPAPLLVAWAERIWGDPRGQGGAAPTRTKPVAHPKKNSGPPGLLGKK

SEQ ID NO: 50651 - DNA, 709 bp, Zea mays
  misc_feature: Ceres CLONE 1463845-F
  misc_feature: Encodes the peptide sequence at SEQ ID NO. 50652
  misc_feature (399)..(399): n is a, c, t, g, unknown, or other
aagctggagctccccgcggtggcggccgctctagaactagtggatcccccgggctgcaggaattcgcacgagaccattacctagaacatcctaatcgaaaagtttctgctccattcctcctcctgcaagccgcaaaggaatcaggcggagtggcgcgatgggagagcaggtcgtgacggagcagatccagcggaagctggaggaggtcaacgctaccgtccaacagcacctcgcgggtgtccaggaccacatcaacttcaccatgcagcaagcatacttcaagtgcgcatatggttgctttgatcggcgccatactcaggaagcgatcagcaactgtgtggagaattgtagtgtgcctgtccttgctgccacaatatttttgagagtgagatggccaantttcagggaatgttgaaccggtcattgagggtctgtcaagataagtttgaagctgcccatctccagaagttgaaatcagatgccactcgggaactggaatcctgtgtcaacagatctattgatgacagcctcagggtcccttccgcatgtggtggatcagatcaagtccaccctcaaaatcaattagaggcactattacttttagcaaaatgaccagatataggtgagaaatgtttcatattcaccttcgttgcataactccccttttccggagctcttaccgatttggaagaacatgatccccctttcc

SEQ ID NO: 50652 - protein, 85 aa, Zea mays
  misc_feature: Ceres CLONE 1463845-F
  misc_feature (10)..(86): Pfam Name: DUF842 Pfam Description: Eukaryotic protein of unknown function (DUF842)
  misc_feature (81)..(81): Xaa is any aa, unknown, or other
MGEQVVTEQIQRKLEEVNATVQQHLAGVQDHINFTMQQAYFKCAYGCFDRRHTQEAISNCVENCSVPVLAATIFLRVRWPXFREC

SEQ ID NO: 50653 - DNA, 709 bp, Zea mays
  misc_feature: Ceres CLONE 1463848-F
  misc_feature: Encodes the peptide sequence at SEQ ID NO. 50654
  misc_feature (367)..(367): n is a, c, t, g, unknown, or other
  misc_feature (368)..(368): n is a, c, t, g, unknown, or other
  misc_feature (371)..(371): n is a, c, t, g, unknown, or other
  misc_feature (372)..(372): n is a, c, t, g, unknown, or other
ctggagctccccgcggtggcggccgctctagaactagtggatcccccgggctgcaggaattcgcacgagaccattacctagaacatcctaatcgaaaagcccgatagcaaaacgcagcgacctcgcccgccctgccccgctcctccccttttcccggtagcagagacagagcaccgcagcccaccagaaaggaagacgaaacgcgccgcgtactagtgaaagggcgcagcggaaggccgccggcgcgctgctatttagacaggaagcggggcgatcgaatcgcgtctctcaaccaatcgatcaatctgccggtaggtcgatcaaggagagcgcgctccacgtctcgttttccgttgcggggaagagnnaannggatagagagagagagagaggagcgatggcgtccgggtaccgcgcggaggaggagtacgactacctattcaaggtggtgctgatcggggacagcggcgtggggaagtcgaacctgctgtcgcggttcgccagggacgagttcagcctcgagaccaggtccaccatcggcgtcgagttcgccaccaagaccgtccaggtcgacgacaagctcgtcaaggcacagatctgggacaccgccgggcaggagaggtaccgcgccatcacgagcgcatactaccgcggcgcggtgggcgcgctggtggtgtacgacgtgagccgccgcaccaccttcgacaac

SEQ ID NO: 50654 - protein, 104 aa, Zea mays
  misc_feature: Ceres CLONE 1463848-F
  misc_feature (16)..(104): Pfam Name: Ras Pfam Description: Ras family
  misc_feature: SWISSPROT Homolog: EC 2.7.11.1 Non-specific serine/threonine protein kinase
MASGYRAEEEYDYLFKVVLIGDSGVGKSNLLSRFARDEFSLETRSTIGVEFATKTVQVDDKLVKAQIWDTAGQERYRAITSAYYRGAVGALVVYDVSRRTTFDN

SEQ ID NO: 50655 - DNA, 769 bp, Zea mays
  misc_feature: Ceres CLONE 1463855-F
  misc_feature: Encodes the peptide sequence at SEQ ID NO. 50656
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (468)..(468): n is a, c, t, g, unknown, or other
ggttgttttggcggtcctccccgcctcagacgnnnnaataatatcccctcaaactggaactccccgcggtggcggccgctctagaatagtggatcccccgggctgcaggaattcgcacgagaccattacctagaacatcctaatcgaaaaaggttttctctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggaaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatggtctcagttgaaggtgagagagattctagggcacancgcacgtttcgatccaattaggtctgtttctggagaatttggtgtagcggtgattgcaaatgattgacctagatcggctacttggacctggacgtttagtattaattgcaacagttaaagagtgtggttcgtgtaatttgaaccaagataatctggctcttgtaaagagtttgtagcaagtccccgtttccaaagaaaaggttaacacctctaagggataaaccggaaagggagtggaaggctacatttccattcagtgttttggcctccttggaaaagatcgcaagaacttttggacccc

SEQ ID NO: 50656 - protein, 92 aa, Zea mays
  misc_feature: Ceres CLONE 1463855-F
  misc_feature (86)..(86): Xaa is any aa, unknown, or other
MAKYNVVQKNKRQCNQDRKRAAHGEPGTGKLKQRTAPVSMSGKRKKKLERRLNRKQKEAAMIKALENNMGDVDMVSVEGERDSRAXRTFRSN

SEQ ID NO: 50657 - DNA, 727 bp, Zea mays
  misc_feature: Ceres CLONE 1463859-F
  misc_feature: Encodes the peptide sequence at SEQ ID NO. 50658
  misc_feature (383)..(383): n is a, c, t, g, unknown, or other
aaagctggagctccccgcggtggcggccgctctagaactagtggatcccccgggctgcaggaattcgcacgagaccattacctagaacatcctaatcgaaaagaaggaagaggcagccttctcaccgtcgcacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatantggtgggggaattaccgccaatgcggaccatgtgagtgctgcttcggctctacacaagcttgtcatcaattgcggttgcattctctgtgacgtgcattatcccgtcagagttgttcttaaaggttatgaagcaaaacacagaggccatcacaagctacgaaatgcttgatgcggttcgtgttgctcttgatatcctgctgccaatgggggttatagctaccactaccaaactcctgcagaatatgtctcctcccaagaaaagcttcctgaattgctatggaaattttagcctttggattcaagtagtaaggggatccaaaacttccaagtttaaaaaatattgg

SEQ ID NO: 50658 - protein, 92 aa, Zea mays
  misc_feature: Ceres CLONE 1463859-F
  misc_feature (82)..(82): Xaa is any aa, unknown, or other
MQRHVASGRPSGTDGSDFSYRMVVESRYQRVAEGRSRLARLILVQALHLVAGGLLLLLSLSKGAAVNKFAVLSMAAGFLAIXVGELPPMRTM

SEQ ID NO: 50659 - DNA, 724 bp, Zea mays
  misc_feature: Ceres CLONE 1463860-F
  misc_feature: Translation starting site: 202
  misc_feature: Pfam Name: SNARE Pfam Description: SNARE domain
ctggagctccccgcggtggcggccgctctagaactagtggatcccccgggctgcaggaattcgcacgagaccattacctagaacatcctaatcgaaaaatcaagctttcatcagatctcgccgcccacccacaccggcaggcaggctccgtcggcttctccgcacccgtgagaactcttcggccagtgaaggtcgcgtccgatgaactcgagaagggacttccgtagccatagagctgctttatttgatggcattgaagaaggtggggtgagagctccagcttattcttctcgtgaaatcatgagcatgagaatgatcaagctctggacagtttgcatgatagggtcagcgttctcaaaagactgactggcgatatcatgaagaagtgaagacccataacggatgctggacaaatgggttatgacatgaatgctttcaaaggatttcttcagggacgggggaaaaattcaaaaggggttcaaaaaaaatccaaccggaaaagggcacccgggggggaccctccatggggggcctttggccaaaaaccccctaaaaaagaacccccccggttttggtataaaggttccccacccccccccttttgtggcccccggggaaaaaattaattggggggcccccccccccccttaagaaaaaagagggttttctttaaaaaaaaaaaaatggtggggttgggggggcacaacacccaagggttttttaa

SEQ ID NO: 50660 - DNA, 876 bp, Zea mays
  misc_feature: Ceres CLONE 1463866-F
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (429)..(429): n is a, c, t, g, unknown, or other
  misc_feature (505)..(505): n is a, c, t, g, unknown, or other
  misc_feature (595)..(595): n is a, c, t, g, unknown, or other
  misc_feature (616)..(616): n is a, c, t, g, unknown, or other
  misc_feature (659)..(659): n is a, c, t, g, unknown, or other
  misc_feature (693)..(693): n is a, c, t, g, unknown, or other
  misc_feature (712)..(712): n is a, c, t, g, unknown, or other
  misc_feature (796)..(796): n is a, c, t, g, unknown, or other
aggggtggtagggggagagggggggggcactaataaanagagggnnnttcaaactgggactccccgcggtggcggccgctctagaactagtggatcccccgggctgcaggaattcgcacgagaccattacctagaacatcctaatcgaaaaaaacgagccagccggccagccagcacgtcgcttgggcgccatctctctagagcttggtaccctcgaacagagatccggcgcgggccaataaatacccggctcactacagactcaggaaaggacggcctgacgatgaagtctgtcgccgtcggcggtcatggccgccgcgctcgtggcgccccccgctgccggggaggcccccgccccggctcccgcttcagacgcaccggccgccgtacccctggccggggaatcctgcggggtcgtcggttttggantaccccttttgggggatccccggttggaatgggggccccccccccccaaaagggggatttggccggtctcttggtngaggaccacttgggggtggggggtcgggggaccccggctctcccggaacgggggccccgggggaccgagcaccggaatggttttcgagtnatttttggggatcaccaaaanacctcgcgaaacaaccgggggggagcggggagtggaggatatntcttcgtgggagaggacaacacccgaacatcatnttttggggattggtggggnccaactgtggcaccgcggtctacggggaggctcgctcccccaggagggctctgagtcgagaggggacataacaccgataggttnaacacccctccccgtcgtccgtgggagatcctacaggagtgggtcgtccttgtaacccctcctctctccacgcagggggg

SEQ ID NO: 50661 - DNA, 705 bp, Zea mays
  misc_feature: Ceres CLONE 1463873-F
  misc_feature: Encodes the peptide sequence at SEQ ID NO. 50662
aagctggagctccccgcggtggcggccgctctagaactagtggatcccccgggctgcaggaattcgcacgagaccattacctagaacatcctaatcgaaaactctctctcttgattcctttcccgaggagctcagctcgctcggctagctaggcaccgggttcctgttcctgccgcgaggcgcgtctcacacgcggcggtcggtgcgcgcatgcagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccaggcccaggccctgaagccgcaggccagtaacgccccgcccaagctcggccgcccccgccccggccccgccgacgaccactccccaacgggagggaagaagttcctgagctacttccggtgttgtatcaaggcctgaagaggtgctgctctagtgcctgcagtccctgtgtttttttttcgcagcagaacacttgtgagcaatcaggcctcggttttgttaagtaccccgtgtccaaaaacgtgtaatatatttgtccttatggatcagtcgttgggcctgtatgaagaacagacc

SEQ ID NO: 50662 - protein, 111 aa, Zea mays; identical to SEQ ID NO: 45755
  misc_feature: Ceres CLONE 1463873-F

SEQ ID NO: 50663 - DNA, 703 bp, Zea mays
  misc_feature: Ceres CLONE 1463876-F
  misc_feature: Encodes the peptide sequence at SEQ ID NO. 50664
aagctggagctccccgcggtggcggccgctctagaactagtggatcccccgggctgcaggaattcgcacgagaccattacctagaacatcctaatcgaaaagagggcaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtgggcggagctggagagcggggcgacgaccatcgcgttcacgccgctgcaccagcgggagacggacgagctgtcgggggcggtgcagctgccggactcgtcggcccccggccggggctccgtggaggtctgcttcgcctacgcggacgtcgacgccgcgtacaagcgcgccgtggacaacggggcggtggccgtgagcgcgccggaggacaagccctggggccagaagtccggcttcgtgcgggacatggacggcaacatcgtgcgcatcgcgagctacgtgcgagagtagtcgcattccgctgcatcaccatcgatcaatcgatcagcctttcccatgcatgtctcgtatactacacgtctacacgtgtaccaaaaaaaataaatcgttgtgcaggtcatgtagttgtgggag

SEQ ID NO: 50664 - protein, 139 aa, Zea mays
  misc_feature: Ceres CLONE 1463876-F
  misc_feature (9)..(133): Pfam Name: Glyoxalase Pfam Description: Glyoxalase/Bleomycin resistance protein/Dioxygenase superfamily
MASGGPKPKLAYIILYVRDVEKAASFYDAAFGYTVRRLDQFRKWAELESGATTIAFTPLHQRETDELSGAVQLPDSSAPGRGSVEVCFAYADVDAAYKRAVDNGAVAVSAPEDKPWGQKSGFVRDMDGNIVRIASYVRE

SEQ ID NO: 50665 - DNA, 780 bp, Zea mays
  misc_feature: Ceres CLONE 1463877-F
  misc_feature: Encodes the peptide sequence at SEQ ID NO. 50666
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (28)..(28): n is a, c, t, g, unknown, or other
  misc_feature (46)..(46): n is a, c, t, g, unknown, or other
  misc_feature (52)..(52): n is a, c, t, g, unknown, or other
  misc_feature (55)..(55): n is a, c, t, g, unknown, or other
  misc_feature (56)..(56): n is a, c, t, g, unknown, or other
  misc_feature (58)..(58): n is a, c, t, g, unknown, or other
  misc_feature (577)..(577): n is a, c, t, g, unknown, or other
ttttttgggtggggggggtgnnnncccnccccccccctacctgccnccacanaannancccccaagagctggactccccgcggtggcggccgctctagaactagtggatcccccgggctgcaggaattcgcacgagaccattacctagaacatcctaatcgaaaaaaaaagcccgaaaaggaggaagaaccgaagtaccgaagaagaggacgcggcaccatggcgacggcacaggcagcgtcggcgtcgcaacccaccacgcgcgtctcagggatgtcgccgccgcaaccgccgtacccagcgccgccaggatcgccgactcggctggttcccccagtacaccgcctcgctcaagggtttggggggcaaccaagacaagaccaagtggccccccgccgttcccccattcccaggattgcgcaaaaaaaaggaagggagggtccgcttggaaacggaaaaaaacccaatactttttttgggccaaacaaaggcccccccccccgggagaaaatgtgtggggggggcaaaaaaatctcccgcgcggggggggggggggaaaaaatgggggttttttttnaaaaggcccccaaaaaaaaccccgggggcccgtgttgtcccgcggggggggaaaaaaaaaaacccccccctcccccccctctttaaaaataatttttgggggcggttgtgggaaaaacccccctcctacacccccaaaggggggcgggggggggagaaccccctgaccccccccgaggtgttttttttgggtaaacaacaccc

SEQ ID NO: 50666 - protein, 147 aa, Zea mays
  misc_feature: Ceres CLONE 1463877-F
  misc_feature (120)..(120): Xaa is any aa, unknown, or other
MATAQAASASQPTTRVSGMSPPQPPYPAPPGSPTRLVPPVHRLAQGFGGQPRQDQVAPRRSPIPRIAQKKGREGPLGNGKKPNTFFGPNKGPPPREKMCGGGKKISRAGGGGEKMGVFFXKAPKKNPGGPCCPAGGEKKKPPPPPPL

SEQ ID NO: 50667 - DNA, 752 bp, Zea mays
  misc_feature: Ceres CLONE 1463878-F
  misc_feature: Encodes the peptide sequence at SEQ ID NO. 50668
  misc_feature (435)..(435): n is a, c, t, g, unknown, or other
  misc_feature (436)..(436): n is a, c, t, g, unknown, or other
  misc_feature (463)..(463): n is a, c, t, g, unknown, or other
  misc_feature (503)..(503): n is a, c, t, g, unknown, or other
aagctggagctccccgcggtggcggccgctctagaactagtggatcccccgggctgcaggaattcgcacgagaccattacctagaacatcctaatcgaaaagaccttcaattcccctgcctgttgccgtacgtgcctaagctagcttcgtcgtctcgttgcacgtacgtagtagctagacagccgaatcggctttctagctagctcctcccttccgatcgatatcatcgccatgtcggggatctcgctggcggtggcgccaaggtccgacccggaccacgggtcggagcggcagccgacggcgatgctgggcggcgtgatgggctcgctccgcgtcatcgagctgcagctggtgggcttcatcatgggtgtctcggcgtcgggcctcgtcccgctcatcgacctcgtgtccccccgtcgccacaccgtttaactnnctcgcatctcccgcctggctttcccgncgctgcaacgcaacaaagtctccaaagcttgataaccccnccggttccccggcccctcctcccagttggccccaaaaaattttcccggaaaaagactgtttcaggggtaacgggggggggggccaaacagggggcccttttcccgcccctgggccactgtttgggggggttcccggggggcaaaaaaccgggggggggggtggaaaaccccccccttttcttttggttggggcaaaaaccagagaaaaaaaaggggggggccagggggcccccttcccccccccccggg

SEQ ID NO: 50668 - protein, 66 aa, Zea mays
  misc_feature: Ceres CLONE 1463878-F
MSGISLAVAPRSDPDHGSERQPTAMLGGVMGSLRVIELQLVGFIMGVSASGLVPLIDLVSPRRHTV

SEQ ID NO: 50669 - DNA, 714 bp, Zea mays
  misc_feature: Ceres CLONE 1463887-F
  misc_feature: Encodes the peptide sequence at SEQ ID NO. 50670
  misc_feature (420)..(420): n is a, c, t, g, unknown, or other
  misc_feature (421)..(421): n is a, c, t, g, unknown, or other
  misc_feature (427)..(427): n is a, c, t, g, unknown, or other
  misc_feature (586)..(586): n is a, c, t, g, unknown, or other
aaagctggagctccccgcggtggcggccgctctagaactagtggatcccccgggctgcaggaattcgcacgagaccattacctagaacatcctaatcgaaaaaccactcatcaccagctagctctagcaaagcacttgccatctaccgaccgccgcattccaaacagcccgacgagctagcagagcggcaggcacctccctcctcaaggaacatggcccgcatgcagaagttggcagtggcgacggcggccgtggtggccttggtgctgctggcggcggcggcgacctcggaggcggccatcagctgcgggcaggtggcgtcggccatcgcgccctgcatctcctacgcgcgcggccagggctcggggccctccgctggctgctgcagcggcgtcaagagcctcaacaacgccgcccgcnnacacgncgaaacgcgcgccgcctgcaactgcctcaagaacgccgccgccggcgtcagcggcctcaacgccggcaacgcccgcagcatccccctcaaggggcgggggcagcatcccctaaaccataagcacctcccccaatggtcccggtggactggaccctaaanaaaaaaaagggcccggggcccccgaaaaaaaccattttttccccccttttggggcccgggaatgaacctttggccctttccccccccgggacccaatgggtgtctcccccccccggaaaaaacccccc

SEQ ID NO: 50670 - protein, 123 aa, Zea mays
  misc_feature: Ceres CLONE 1463887-F
  misc_feature (32)..(109): Pfam Name: Tryp_alpha_amyl Pfam Description: Protease inhibitor/seed storage/LTP family
  misc_feature (70)..(70): Xaa is any aa, unknown, or other
  misc_feature (72)..(72): Xaa is any aa, unknown, or other
MARMQKLAVATAAVVALVLLAAAATSEAAISCGQVASAIAPCISYARGQGSGPSAGCCSGVKSLNNAARXHXETRAACNCLKNAAAGVSGLNAGNARSIPLKGRGQHPLNHKHLPQWSRWTGP

SEQ ID NO: 50671 - DNA, 774 bp, Zea mays
  misc_feature: Ceres CLONE 1463888-F
  misc_feature: Encodes the peptide sequence at SEQ ID NO. 50672
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (44)..(44): n is a, c, t, g, unknown, or other
  misc_feature (45)..(45): n is a, c, t, g, unknown, or other
  misc_feature (429)..(429): n is a, c, t, g, unknown, or other
ntttggtgttnnnnnnntnnnnnnatcaacttacgccccgcccnncccaaaagctggactccccgcggtggcggccgctctagaactagtggatcccccgggctgcaggaattcgcacgagaccattacctagaacatcctaatcgaaaatcctcacctggcatccagagaggaagggaagggaggaactcggggcacacagcacagggggtcgtccggaatttcctctgcttccgcttaccgccgaaacctctgtcttgaaggaagaatccgttcctctgcttgatctgtattcttatagtggagaagagaagccgaggacgattaatagagctggaaggtgaattgacgcttagtatttgaagctcgtcgccaaatggagaaagaggcgaggaaccactaccgcacgcggggatcctcgtgcggtancaacggcagaggcaccgctgccgagcgggagttgttgtcccacccccacaaccggaagggcctgcgctgggtcaaggggcagcgccgcaacgtctaggccgcccccaccgcgggcgccgagaaggccgccatcttccagtgccgcgccgtggccgcagccgcagccgcgcagtatcacccaaccgggcacacccaccacccgcgttctcaggaggccaaaagagtttcgcatcttgaaaatggccagcacgggaacaacagaatgacagtatcacaaatttgctcacaaaaaggcaggccctggtaaagtaacaccacaacgaagtcctagactttcggagaaaa

SEQ ID NO: 50672 - protein, 49 aa, Zea mays
  misc_feature: Ceres CLONE 1463888-F
  misc_feature (18)..(18): Xaa is any aa, unknown, or other
MEKEARNHYRTRGSSCGXNGRGTAAERELLSHPHNRKGLRWVKGQRRNV

SEQ ID NO: 50673 - DNA, 720 bp, Zea mays
  misc_feature: Ceres CLONE 1463889-F
  misc_feature: Encodes the peptide sequence at SEQ ID NO. 50674
ggatcccccgggctgcaggaattcgcacgagaccattacctagaacatcctaatcgaaaagaatcgatccgcctacatgcctatgaatcctcctcccccgccgcctcctgggtcggcgtcttcggcgccggcggggcccagctaccaacagtaccagcaacagctgcatcaggcgcatcagctcttccagcgggacgcgcagaccataacccccgatgcgctgcatagcgtcaaggctgctctcgccaccagcgacgtcctcgaccccgccgccgccgcgaacgccaggccctccgatccctctaccagcaagaaaccaatcccccgccgtgttgccggacaaaccatgggaggatcctaccctccctgactggcccaaaaagaacaccgggctggttttgtggaaatctaggaaaagaaatttaaagataaatgttcttatcctaagaattctgtgcgggtttcccttcctaccaacttggcaagggtttggttcaaattaaaaagactgggcaaaaccaaaaggttatggatttgtagactttttcaaaacccctattgatatcggccctccttggaaaaaaaaataaagaatggaaaacatttttgggaaacccccccttttaaacttcgctaaaagaaagccgcgagggaaaagaaaaacgcctggggtttttcaaaaaaaaaaaaaactttttgaaaaaggaaccctaattctcc

SEQ ID NO: 50674 - protein, 97 aa, Zea mays
  misc_feature: Ceres CLONE 1463889-F
MPMNPPPPPPPGSASSAPAGPSYQQYQQQLHQAHQLFQRDAQTITPDALHSVKAALATSDVLDPAAAANARPSDPSTSKKPIPRRVAGQTMGGSYPP

SEQ ID NO: 50675 - DNA, 723 bp, Zea mays
  misc_feature: Ceres CLONE 1463890-F
  misc_feature: Encodes the peptide sequence at SEQ ID NO. 50676
  misc_feature (356)..(356): n is a, c, t, g, unknown, or other
  misc_feature (431)..(431): n is a, c, t, g, unknown, or other
aagctggagctccccgcggtggcggccgctctagaactagtggatcccccgggctgcaggaattcgcacgagaccattacctagaacatcctaatcgaaaaacagcgaaggacacaaaaacacaggtagggttaggcgacgcggcggcgagagcgcgagagtaggaggaggcgtcggccatgacggggaaggcgaagccgaagaagcacacggcgaaggagatcgccgcgaagatcgacgcggcgacgacgaaccggggcggcggcaaggtcgggcaggcggatcggctagggcaggacaagggcgggcacgcgaagctggcgtgcccgctctgccgcaccccggcgcccgacatncagttcatgcagatccaccacgaggcgcgccatcccaagctccctttcgagccggagaagctcggtcacctggantcctccacccccggcggccgcgagggcaccacctccaagccaagcccggggtccgcggcagcccccaaaaatacctgggtggcttggccgcctgaatgcccgggggaattcccttcgatttaaacccctcccccgacccgattttaaattaataaagtaccccccgcccccccgccccgggggactggaaaccccccccccggttctctacccgtttttattgggaaaaccgcccccgggaaaaaggcaaatttatataccccccccccgaaacgggggtttttaaattgtc

SEQ ID NO: 50676 - protein, 124 aa, Zea mays
  misc_feature: Ceres CLONE 1463890-F
  misc_feature (59)..(59): Xaa is any aa, unknown, or other
  misc_feature (84)..(84): Xaa is any aa, unknown, or other
MTGKAKPKKHTAKEIAAKIDAATTNRGGGKVGQADRLGQDKGGHAKLACPLCRTPAPDXQFMQIHHEARHPKLPFEPEKLGHLXSSTPGGREGTTSKPSPGSAAAPKNTWVAWPPECPGEFPSI

SEQ ID NO: 50677 - DNA, 840 bp, Zea mays
  misc_feature: Ceres CLONE 1464046-F
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (146)..(146): n is a, c, t, g, unknown, or other
  misc_feature (527)..(527): n is a, c, t, g, unknown, or other
  misc_feature (547)..(547): n is a, c, t, g, unknown, or other
ggggnnnnnnnnnnnnnnnnnnnnnnnnnnnnnnnnnnnnnnnnnnnnnnnnnnnnnnnnnnnnnnnnnnnnnnnnnnnnnaagtaggggggtgagaggagagnnnnnnnnntgggtaaggtggggtttnnnnnnnnggnnngggnccaagctgggactccccgcggtggcggccgctctagaactagtggatcccccgggctgcaggaattcgtctcacccctaatcgaaaaaactatttctagggttttacatgcaccaacaggagccccttccgtcacttcgcctccaacaacagcagcgccgccgccgccgccgccgccacttaatcgccgggatcgtcgccggaggaaagcgccatggatcggtaccagcgggtggagaagccgccgcccgagcccgccgccatcggcgaagaatgaggtcgcatcaccactcaggggcctcgtcgcaactacgtcacctacgccacctccctcgtccagggaaaaacaggtgaaaggaaaatgttgttgaaagctatgggnacaggctataaaccaggcantgggctattgcttgaaatcttaaagaaaaaggagatttctgggtttggcactcaggaaaccaaaaaaatccgggtccggggccggtttttaccggagggttgggggagcccccctttggggaaagggaacttggcccccttgggaaaaaaaaaccccccccagggttcaaaaggaaaaccgaaaatttcccgggggcccccctgggggggcgctaaaaaaagaattcccccggggggaaaaaaaaagcccccccccacattttgggggttttttaagcccccaaaaaaatatt

SEQ ID NO: 50678 - DNA, 759 bp, Zea mays
  misc_feature: Ceres CLONE 1464047-F
  misc_feature: Encodes the peptide sequence at SEQ ID NO. 50679
ggagctccccgcggtggcggccgctctagaactagtggatcccccgggctgcaggaattcgtctcacccctaatcgaaaaaaaccaaaccgggaccgggcggcatcctcggtctcgtactgacccccgcaccggcaaaccctagtccacagcggcgaggcgaccttgtgacctccgttcctctgtgctccgactgagttgctgatttgggataatcatgttctctctgagtgaatgaacatgtctgggaatgatgataagccacatgctgctgcagacagaataaaggcagccacgttatcagtgactaagggattgagcagggctcaagctgaatgggctgcgactgctgctgcccgcaatgtgaatgcctatgggcagaaggaagagggaccaagccgctggcaggagaggaaggaagccaagagtcagatgtatctgatgagtacagagaaggttgcgaagctgggcactatgaagccaaaagcttcagaaacttcttctgttggcacatatacccaatgccagaagtgtttccagcatggtcactggacatatgagtgcaaaaagagcgggtgtacatatcacggccctcaagaacgtagcagcttaagaaccccagctgaagaaatgcgtacctgttttctatcgatttgagaatcctgatggtgatcggcgatcgtgagcttcccatatatgtggtgtgatacttgagacttttattatgactatatatgagatattgtctattattatgacc

SEQ ID NO: 50679 - protein, 140 aa, Zea mays
  misc_feature: Ceres CLONE 1464047-F
MNMSGNDDKPHAAADRIKAATLSVTKGLSRAQAEWAATAAARNVNAYGQKEEGPSRWQERKEAKSQMYLMSTEKVAKLGTMKPKASETSSVGTYTQCQKCFQHGHWTYECKKSGCTYHGPQERSSLRTPAEEMRTCFLSI

SEQ ID NO: 50680 - DNA, 736 bp, Zea mays
  misc_feature: Ceres CLONE 1464056-F
  misc_feature: Encodes the peptide sequence at SEQ ID NO. 50681
  misc_feature (374)..(374): n is a, c, t, g, unknown, or other
aagctggagctccccgcggtggcggccgctctagaactagtggatcccccgggctgcaggaattcgcacgagaccattacctagaacatcataatcgaaaaaagaagcgagtggagaccgcagcacacccgggcggcgtctggggatgacgcgcgcccgccgccaatggccgcaccgacgcagacgctagtgctggcggggatcatcctcctcaacttcgtcctcgccgcggcagcgctctaccgccgcatccgcggccgccgcaggccccggcagcacgtcccgccgccgccgccgctcgagccggccgccgcggaggaggcggacggagaagcggaggacgaagaaggaggcggtggggagaggcggcaaanccaacggaggaagacgagagcacgaaggaagcggcaccaccaggaggagggcgccgcgacagagggtggtggtggcgacggcgcggacggggccgccgcgaaggcgacggcgaaggaggagctgctgccccgccggtcgcagttcccgctagcctccttggcgggcgcgctgcagcgccggatccacgcgcggtactacgacctcgcgcgggccaccgaggcgcagtgcctcaccatcgagcaagttaacgagattcttaactgtctcgtagatgctaaaaaccagctgctgcaaaggtacgagaatgtacaaagaagcttcaaaataaagaaggcgatgctatccaaccatcgaaactatg

SEQ ID NO: 50681 - protein, 190 aa, Zea mays
  misc_feature: Ceres CLONE 1464056-F
  misc_feature (70)..(70): Xaa is any aa, unknown, or other
MAAPTQTLVLAGIILLNFVLAAAALYRRIRGRRRPRQHVPPPPPLEPAAAEEADGEAEDEEGGGGERRQXQRRKTRARRKRHHQEEGAATEGGGGDGADGAAAKATAKEELLPRRSQFPLASLAGALQRRIHARYYDLARATEAQCLTIEQVNEILNCLVDAKNQLLQRYENVQRSFKIKKAMLSNHRNY

SEQ ID NO: 50682 - DNA, 716 bp, Zea mays
  misc_feature: Ceres CLONE 1464059-F
  misc_feature: Encodes the peptide sequence at SEQ ID NO. 50683
aaagctggagctccccgcggtggcggccgctctagaactagtggatcccccgggctgcaggaattcgcacgagaccattacctagaacatcctaatcgaaaagccatctggctctccgtccgtttactcacacggtcacaccgcctcaactcgcgctgcccgtcgcccctcggttccgccggcgcgcgaggggattcgagctgggtcttgggtagcctctaaccgtctcacgatgccgccagcacccaagtccggcgacgccctcttccccagcgtggatcgcgtcaatgcggagctgttcacgctcacgtacggcgccatcgtgcggcagttgctcacggatctggaggaggtcgaggaggtcaacaagcagctcgatcagatgggttacaacattggaacacgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgagggtacaagttgcagccttgtcctggaagacaaccctcttgttgatttcgtcgagctccctgacacttgccaaggccttcagtattgcaatttgttaagtggagttattaggggggcattggaaatggtgtctatgaaggcggaggtgacatgggtgcgcgacatgcttcgcgggg

SEQ ID NO: 50683 - protein, 161 aa, Zea mays
  misc_feature: Ceres CLONE 1464059-F
  misc_feature (22)..(159): Pfam Name: TRAPP_Bet3 Pfam Description: Transport protein particle (TRAPP) component, Bet3
MPPAPKSGDALFPSVDRVNAELFTLTYGAIVRQLLTDLEEVEEVNKQLDQMGYNIGTRLVDEFLAKSNVSRCVDFKETADVIAKLGFKMFLGVTATVTNWDAEGTSCSLVLEDNPLVDFVELPDTCQGLQYCNLLSGVIRGALEMVSMKAEVTWVRDMLRG

SEQ ID NO: 50684 - DNA, 714 bp, Zea mays
  misc_feature: Ceres CLONE 1464066-F
  misc_feature: Encodes the peptide sequence at SEQ ID NO. 50685
ggagctccccgcggtggcggccgctctagaactagtggatcccccgggctgcaggaattcgtctcacccctaatcgaaaactcatacctcaatcatcatcttctttaatcaacattgcgagagcctccctcctcgttcggttcggacttttgcttcggcgactttacgcggtaggccaccgtaaaccctagccccagaccgcgggtcatagccaacgagatgcagatcttcgtcttgacgctgacggggaagaccatcacgctcgacgtcgagagcagcgacaccatcgataatgtcaaggccaagatccaggacaaggagggcatttcgcgtgaccagcagaggctgatttttgctggcaagcaattggaggatgggaggacattagctgattacaacattcagaaggagtcaacactcccttcggtcttgaggctcaagggtggaactatgatcaaggtgaagacactaactgggaaggaaatcgagattaacatcgagcccaatgacacaattgataggatcaaggagcatgttgaggagagagaaggcatcccacctgttcagcagaggctcatttatgctgggaagcaacttgctgatgacaaaactgtcaaggattacaacattgaaggtggttcagtgctccatcttattcttgctctgaggggtggttgctagattaaaaagttcttgtactttctgcttatgctc

SEQ ID NO: 50685 - protein, 153 aa, Zea mays
  misc_feature: Ceres CLONE 1464066-F
  misc_feature (82)..(150): Pfam Name: ubiquitin Pfam Description: Ubiquitin family
  misc_feature (6)..(74): Pfam Name: ubiquitin Pfam Description: Ubiquitin family
MQIFVLTLTGKTITLDVESSDTIDNVKAKIQDKEGISRDQQRLIFAGKQLEDGRTLADYNIQKESTLPSVLRLKGGTMIKVKTLTGKEIEINIEPNDTIDRIKEHVEEREGIPPVQQRLIYAGKQLADDKTVKDYNIEGGSVLHLILALRGGC

SEQ ID NO: 50686 - DNA, 736 bp, Zea mays
  misc_feature: Ceres CLONE 1464070-F
  misc_feature: Encodes the peptide sequence at SEQ ID NO. 50687
aaaagctggagctcccccgcggtggcggccgctctagaactagtggatcccccgggctgcaggaattcgtctcacccctaatcgaaaattcctcgtgcccgtcccctcaggcgctcttgctggttctggaagccggagcatcggcgctgtcgctcaggtctgtccattcccctccaaagccctaaagctaggcttcctgtgctaacccgaatcaagcaagccccgtcaacctcccccgccgtcgtcttcttctctgttgctctcctctccaccgggtccccatctcctcccttcaccgccccagaactcctcactcgggcgctgccgctgcgaggtctccgtggcatcgggccttcgtcattacgcagcagacgaagcagtgggaaacttggaactgcatgcacccaaggcaaaacgtcggtcatatatcccaacgaaaaatggaacagccatgatgcttccgctccatattcattacgaagatgtactacgtcaggatctgttgctcaaacagaatcatgccaatatcatgcaagttccagggttgtttgaggtcaaattagcaccaaaagctggctctgatctcaagatcccaattgggaaaatggccatggaggttttgagtggtcagagattcaaagaggcaaaaattgaccctttcgccaaagcaagaaagtcttctcgaaccaatccatttattggggccgacaaggacggtagcactgtcttcgcgcaa

SEQ ID NO: 50687 - protein, 95 aa, Zea mays
  misc_feature: Ceres CLONE 1464070-F
MMLPLHIHYEDVLRQDLLLKQNHANIMQVPGLFEVKLAPKAGSDLKIPIGKMAMEVLSGQRFKEAKIDPFAKARKSSRTNPFIGADKDGSTVFAQ

SEQ ID NO: 50688 - DNA, 579 bp, Zea mays
  misc_feature: Ceres CLONE 1464077-F
  misc_feature: Encodes the peptide sequence at SEQ ID NO. 50689
  misc_feature (275)..(275): n is a, c, t, g, unknown, or other
agagctggactccccgcggtggcggccgctctagaactagtggatcccccgggctgcaggaattcgcacgagaccattacctagaacatcctaatcgaaaaaaaaatccattcactaccgccggcgccggatccaataggaggaggaggaagatgactgtgggcatgatcaacgcaaacccggtggtgcacgagcggccggagcgcgcctcgcacccccacgccgccgatgtgctcgaccctctcgatgtctttgataacgtgcggacatcaggnacccggagcccccggtactccctgtggagccagctcccaccgtggcttttcccgaaaggaaacccccttttccccctttttaaaaaaaaaaaacccctttttggggacccccccttctcccgaagaaaaacacccttttcccctccccccccagtgggggggcgcacaccccctcgctccaattatgtggggccccaccacaaattttatttccccccccccggggggcccccccccccccacattatttgggggtgggggggggggggaaaaaaatttttcccccctccccccccccacattg

SEQ ID NO: 50689 - protein, 142 aa, Zea mays
  misc_feature: Ceres CLONE 1464077-F
MTVGMINANPVVHERPERASHPHAADVLDPLDVFDNVRTSGTRSPRYSLWSQLPPWLFPKGNPLFPLFKKKKPLFGDPPFSRRKTPFSPPPPVGGRTPPRSNYVGPHHKFYFPPPGGPPPPHIIWGWGGGGKKFFPPPPPHI

SEQ ID NO: 50690 - DNA, 800 bp, Zea mays
  misc_feature: Ceres CLONE 1464091-F
  misc_feature: Encodes the peptide sequence at SEQ ID NO. 50691
ggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttgggagctttctgaagcatggcgtgcgcgtgaactatgaatgtatgagtcactccgaaaagctaactgttgagtactatgctaagctgaagagctgcattcacatcatgtggtggaaccgcgaggaaagcctcttttatcgaacagcctcccttggtcaccgaccaaatcagggaccccccccaaacccgggaacaaccctggggtttggcttttgggaagagaaaccacccctggggtttggccaaaatccctttcgaacctaggaaaacaagaactttttaaaacccaaagggtccccccccccaccaaaaaatgggggcccttttgaaaaaagggcgaaaaaaccttttttaaaaaaaaaaaaaaaaaaagggcccggggggcccccctctcccccctaaaagggtaataccccgccccccgggggccgcttttaaaaacggga

SEQ ID NO: 50691 - protein, 71 aa, Zea mays; identical to SEQ ID NO: 46198
  misc_feature: Ceres CLONE 1464091-F

SEQ ID NO: 50692 - DNA, 734 bp, Zea mays
  misc_feature: Ceres CLONE 1464093-F
  misc_feature: Encodes the peptide sequence at SEQ ID NO. 50693
aagctggagctccccgcggtggcggccgctctagaactagtggatcccccgggctgcaggaattcgcacgagaccattacctagaacatcctaatcgaaaactggacggttcggtgtataaagctccggcgactggtgcccaccacggctagctgccgtcgtcgcagaagtaggagctctcgtttctccatcagtagtgattgggcagcatcgtcatcgatcgatcgccatgaggctccgcggcttgctgcgcctcgtcctcgcgctcctcctcgccgccaccgccatcgtgccggtgctgctccttagcgagaacggcggcggcggcgtcgcacctgcgccgccgttcaactcctcgcgtgtcaaggccgtctcgtggcatccaaggatcttcgtgtacaaggggttcccctccgacgccgagtgcgaccacctcgtgactctggcgaagaagaagatccagcgggtcatggtgggcggacacgagtcccgcaagagcgtcaagagcgaggtgcgcacagcttcggcatgttcttcgaaaagcgccaggaccccgtggtgagtccgatccagaaaagggtcccggcatggacgtttcttccccaggaaacacccaaaacatggaggtgctgccctaccaaccggggcaaaaataaaaaccggacttttaataattttcccgaaaagggtaaaccgggcccgggggggggccaccgttaaccccccggggtttt

SEQ ID NO: 50693 - protein, 110 aa, Zea mays
  misc_feature: Ceres CLONE 1464093-F
MRLRGLLRLVLALLLAATAIVPVLLLSENGGGGVAPAPPFNSSRVKAVSWHPRIFVYKGFPSDAECDHLVTLAKKKIQRVMVGGHESRKSVKSEVRTASACSSKSARTPW

SEQ ID NO: 50694 - DNA, 705 bp, Zea mays
  misc_feature: Ceres CLONE 1464102-F
  misc_feature: Encodes the peptide sequence at SEQ ID NO. 50695
aaagctggagctccccgcggtggcggccgctctagaactagtggatcccccgggctgcaggaattcgcacgagaccatacctagaacatcctaatcgaaaactgttcggtatccctgtttctcgcttggaggctgcctgaagcggccagcagccatggcgactcgcgccggacgaccgcccactccggcgcccgctcttctgctcctcctcaccttcctgtttctgttgcggggagttcttccgtcgcgagccggggacaccgtcgccgccggccgcccgctgtccgatgcgcagagcctcgtgtccaagcgtggcaagttcaagctcgaattcttccgtccaggtacacaatgtttgctaacgtcatcgactcgagccaggggagggttcagcgtggaggttcgtcgaggtctgctgctcgtagctcccgtcgctccactcaagatccaacaaaagtggagcaactgcgagaagaacttaggcgaaaccctcttcgctagtggaggtatcgaccatcacttgtcaatgtaactcgatgctgatcggcgaccgtgagcttccatgttattgtgttctgatacttgagacttttattatgactatgtatgagatattgtctcttattagtactggatgatgagatgtgtcttattatgactatggatgagacttttgtgatgtaaaaaaaaaaaaaaaaagcttat

SEQ ID NO: 50695 - protein, 125 aa, Zea mays
  misc_feature: Ceres CLONE 1464102-F
MATRAGRPPTPAPALLLLLTFLFLLRGVLPSRAGDTVAAGRPLSDAQSLVSKRGKFKLEFFRPGTQCLLTSSTRARGGFSVEVRRGLLLVAPVAPLKIQQKWSNCEKNLGETLFASGGIDHHLSM

SEQ ID NO: 50696 - DNA, 784 bp, Zea mays
  misc_feature: Ceres CLONE 1464105-F
  misc_feature: Encodes the peptide sequence at SEQ ID NO. 50697
  misc_feature (524)..(524): n is a, c, t, g, unknown, or other
  misc_feature (525)..(525): n is a, c, t, g, unknown, or other
  misc_feature (531)..(531): n is a, c, t, g, unknown, or other
  misc_feature (532)..(532): n is a, c, t, g, unknown, or other
  misc_feature (544)..(544): n is a, c, t, g, unknown, or other
  misc_feature (545)..(545): n is a, c, t, g, unknown, or other
  misc_feature (555)..(555): n is a, c, t, g, unknown, or other
  misc_feature (571)..(571): n is a, c, t, g, unknown, or other
  misc_feature (572)..(572): n is a, c, t, g, unknown, or other
  misc_feature (606)..(606): n is a, c, t, g, unknown, or other
  misc_feature (706)..(706): n is a, c, t, g, unknown, or other
  misc_feature (712)..(712): n is a, c, t, g, unknown, or other
  misc_feature (717)..(717): n is a, c, t, g, unknown, or other
  misc_feature (718)..(718): n is a, c, t, g, unknown, or other
  misc_feature (784)..(784): n is a, c, t, g, unknown, or other
ccccgcggtggcggccgctctagaactagtggatcccccgggctgcaggaattcgtctcacccctaatcgaaaagtgcttggcttgctcgctttcctttcccgtctcgactctcgagtctcgactcctcgcattcgccgctgcgtcaacgtgtcttccttcccgcgggctctccgccgcctcccagatccggcgggcatggcaaggaacccgggctgcaccgtcttcataggtaacttggatgacaaggttcctgagagggttctgtatgaaattcttattcaggtaggtcgctggtgtagacctacaactacctcttgtcgagagaggaatctagcgacccacaagggcttgctttttgctgagtatgaaaacagaggagattgccccaatatgctggtttagctattttttctggtccttgttgccacttcattaataaaaacgctttagattttgcgatcctctggggcaagaccaacaccctcattaaaatgggcaatatccccctgtaaactccctagnngttaannactctgtaccanncagccaaagncccctcatcaacctanntgaggggtctagtgatacctccctttgccacagncatgccagcagtgaatgggcaggaaatgcccgggtatggtatccccaccaatcaattcctaaccacactcacactcagccactggtcgagtgggtaccgnatagangactnnagcacgtacatatgataatagtaggcctgtattttggtctgttctgaatgatgtagccgtcagctn

SEQ ID NO: 50697 - protein, 68 aa, Zea mays
  misc_feature: Ceres CLONE 1464105-F
MARNPGCTVFIGNLDDKVPERVLYEILIQVGRWCRPTTTSCRERNLATHKGLLFAEYENRGDCPNMLV

SEQ ID NO: 50698 - DNA, 755 bp, Zea mays
  misc_feature: Ceres CLONE 1464110-F
  misc_feature: Encodes the peptide sequence at SEQ ID NO. 50699
  misc_feature (700)..(700): n is a, c, t, g, unknown, or other
  misc_feature (701)..(701): n is a, c, t, g, unknown, or other
  misc_feature (708)..(708): n is a, c, t, g, unknown, or other
  misc_feature (710)..(710): n is a, c, t, g, unknown, or other
  misc_feature (744)..(744): n is a, c, t, g, unknown, or other
aaagctggagctccccgcggtggcggccgctctagaactagtggatcccccgggctgcaggaattcgtctcacccctaatcgaaaattcctcgtgcccgtcccctcaggcgctcttgctggttctggaagccggagcatcggcgctgtcgctcaggtctgtccattcccctccaaagccctaaagctaggcttcctgtgctaacccgaatcaagcaagccccgtcaacctcccccgccgtcgtcttcttctctgttgctctcctctccaccgggtccccatctcctcccttcaccgccccagaactcctcactcgggcgctgccgctgcgaggtctccgtggcatcgggccttcgtcattacgcagcagacgaagcagtgggaaacttggaactgcatgcacccaaggcaaaacgtcggtcatatatcccaacgaaaaatggaacagccatgatgcttccgctccatattcattacgaagatgtactacgtcaggatctgttgctcaaacagaatcatgccaatatcatgcaagttccagggttgtttgaggtcaaattagcaccaaaagctggctctgatctcaagatcccaattgggaaaatggccatggaggttttgagtggtcagagattcaaagaggcaaaaattgaccctttcgccaaagcaagaaagtcttctcgaaccaatccatttattgnngccgacnangacggtagcactgtcttcgcgcaaccaaccgttnctcgagggcag

SEQ ID NO: 50699 - protein, 102 aa, Zea mays
  misc_feature: Ceres CLONE 1464110-F
  misc_feature (84)..(84): Xaa is any aa, unknown, or other
  misc_feature (87)..(87): Xaa is any aa, unknown, or other
  misc_feature (99)..(99): Xaa is any aa, unknown, or other
MMLPLHIHYEDVLRQDLLLKQNHANIMQVPGLFEVKLAPKAGSDLKIPIGKMAMEVLSGQRFKEAKIDPFAKARKSSRTNPFIXADXDGSTVFAQPTVXRGQ

SEQ ID NO: 50700 - DNA, 737 bp, Zea mays
  misc_feature: Ceres CLONE 1464112-F
  misc_feature: Pfam Name: Gelsolin Pfam Description: Gelsolin repeat
  misc_feature: Pfam Name: Sec23_helical Pfam Description: Sec23/Sec24 helical domain
  misc_feature (441)..(441): n is a, c, t, g, unknown, or other
aaagctggagctccccgcggtggcggccgctctagaactagtggatcccccgggctgcaggaattcgcacgagaccattacctagaacatcctaatcgaaaatcaataacagtccagatgagacagcttatttcaggatgttactcaatcgcgagagtatcactaactcggttgccatgatccagccttccttgatatcattttcctttgattcacctccatctccggtgtttctagatgtggcatcactagcggcagatcgtatactgctacttgatgcgtactttagtgttgtcattttccatggcatgacaattgctcagtggagaaacatgggttatcagaaccaacctgagcatgagcaatttgcacaactattacaagcaccacacgaggatgcgcagatgataataaaaggtcgatttccagttccaagactangtgtctgtgaccaacatggctcacaggcaaggttttttgtggctaagctgaatcccatcggcacatataactcagctcatgatgttgctccaggttccgaactcattttcaccgatgaatgtaagctccctggccttcgggaaccccctacaagggctggctgtttcactctttaggacctggaagcaaaaagttggccccctcattggaaaaggggggaaaaattaataaagcctcaaggggggacttggaaaaaaaaccccccttttttggccccctttcccccagttttttag

SEQ ID NO: 50701 - DNA, 772 bp, Zea mays
  misc_feature: Ceres CLONE 1464114-F
  misc_feature: Encodes the peptide sequence at SEQ ID NO. 50702
ctggagctccccgcggtggcggccgctctagaactagtggatcccccgggctgcaggaattcgtctcacccctaatcgaaaactcttcggtcaaaaatatccttgtacctgcatctcgacctcaccggcgtccggcggtggtatcacgatggtggcgttgctggaccggcggatcggggtggctgcggcagctgccgcgttcatcgccctcgtggagttcggatccgcctcatcctcgcccaagtccttcgtgaagtccaccgtctccgcccacgacgtcgtcatcttctccaagtcatactgcccgtactgcaaaagagcacaggccgtgtttaacgagcttgagttgaagaaagagccatatgttgtggagcttgatcagcgagaggatggctcagagattcaggatgccccacatgagatagttggcaggcgtactgtccctcaagtttttgtccatgggaaacacctgggtgggtctgaaaaactggtgaccctaccaaaggtgaaaactggctaaacttctaaacctcgaatccagggccacctttggatgaaatgctacctcggcaagccctgttttttggggtttaatccgaaccggttttaaaaatttaaaaggggttatgcccccgggaaccccttccccccctcaaaagggttttttttcccaggggaattcccaaaaaacctcttttttggaacccaagggatattttgggcccctcaaaaaaaaagaaaacaaagttttatttttttcacccctcccccc

SEQ ID NO: 50702 - protein, 123 aa, Zea mays
  misc_feature: Ceres CLONE 1464114-F
  misc_feature (44)..(108): Pfam Name: Glutaredoxin Pfam Description: Glutaredoxin
  misc_feature: SWISSPROT Homolog: EC 1.11.1.15 Peroxiredoxin
MVALLDRRIGVAAAAAAFIALVEFGSASSSPKSFVKSTVSAHDVVIFSKSYCPYCKRAQAVFNELELKKEPYVVELDQREDGSEIQDAPHEIVGRRTVPQVFVHGKHLGGSEKLVTLPKVKTG

SEQ ID NO: 50703 - DNA, 723 bp, Zea mays
  misc_feature: Ceres CLONE 1464116-F
  misc_feature: Encodes the peptide sequence at SEQ ID NO. 50704
ggagctccccgcggtggcggccgctctagaactagtggatcccccgggctgcaggaattcgtctcacccctaatcgaaaaaggagaactgggacgacagcagcggcgggcgacggggaacggggaacccctgtactgtatttcgtcgacctttgccatggcgtcgatgatgagttctcgcgcgggcgcggcggcggccggaggaggagaacaccgccgtcagcacgtcacggtggcgtgcggtgggctgacgcggccgagtaccaggcccgtgccgggcgctgctggcccacggcccgggacgccgaggccgcggggtcctgctgcagctgcgggcggctcttcgtcttcgtcgccgacggggcgcgcggggccggagtgcagctggtggggcgctgcctccccccaccaggcgacgccgaggcggccgaggagcggcagggccgcgggcgcgcgcgtgcccacgggcaaggggaaccgcgagctggtgagacgggcgctcacgccgcccgccgcgcgcggccgtggccgtggccgcgccggaggagccgtcctcctcaggaggtggagcttccggcccgcgcccagccgcctgcgcaacgcgtcgtcgctctcctcgcagtcccctgactcgccgcggccacgtccgtcgtgatcgaccgtcgcgaccgcattctttgattcgatgttttgtggggaagaaatcttggtctgcactgcagtt

SEQ ID NO: 50704 - protein, 165 aa, Zea mays
  misc_feature: Ceres CLONE 1464116-F
MASMMSSRAGAAAAGGGEHRRQHVTVACGGLTRPSTRPVPGAAGPRPGTPRPRGPAAAAGGSSSSSPTGRAGPECSWWGAASPHQATPRRPRSGRAAGARVPTGKGNRELVRRALTPPAARGRGRGRAGGAVLLRRWSFRPAPSRLRNASSLSSQSPDSPRPRPS

SEQ ID NO: 50705 - DNA, 774 bp, Zea mays
  misc_feature: Ceres CLONE 1464122-F
  misc_feature: Encodes the peptide sequence at SEQ ID NO. 50706
  misc_feature (99)..(99): n is a, c, t, g, unknown, or other
  misc_feature (126)..(126): n is a, c, t, g, unknown, or other
aaagctggagctccccgcggtggcggccgctctagaactagtggatcccccgggctgcaggaattcgtctcacccctaatcgaaaagaaaaaaaaaacntctgcggagattgaccgaccaccaccnaccgcctgcgttcccgcgccgccaccgccatggctgccgctgccccccatgcatactcctccctcgtgcctgtttcggctgcgcggcctctctccggaagcacagtttctttcggtgcttcgtgccacaagtggaggaaggttccggcatggcgactccactgtgttgctgaagacgaagcagaggaagtcaaagattttggagtcaatatggcactatccatgctaaaattttacaaacgagaaatatcacctttactaccttcaagctgccgatatgtaccaacttgcagtgagtactctatgcaggcgtacaaacgatatggtgttgtaaagggttccatcttgactgcttggcgcctttgccgttgtaatcctcttggtggatatgggtatgatcctccaaaatggtttggcgaggaagatgtacctctgcaatagtaatgcctagtaattgaaagtacaggcattgtaattcttcagatccagacttgcagcattttttatgttcctggtcactgtcagaaacaatgcacaactgtatgtggtagtttcaaggaaaaagctccccatcgactatactgccaaggaaacttgattggatttctagaaatttctatgctggaaaatacataaaatggcaagggga

SEQ ID NO: 50706 - protein, 136 aa, Zea mays; identical to SEQ ID NO: 50257
  misc_feature: Ceres CLONE 1464122-F
  misc_feature (58)..(125): Pfam Name: DUF37 Pfam Description: Domain of unknown function DUF37

SEQ ID NO: 50707 - DNA, 744 bp, Zea mays
  misc_feature: Ceres CLONE 1464127-F
  misc_feature: Encodes the peptide sequence at SEQ ID NO. 50708
  misc_feature (361)..(361): n is a, c, t, g, unknown, or other
aaagctggagctccccgcggtggcggccgctctagaactagtggatcccccgggctgcaggaattcgcacgagaccattacctagaacatcctaatcgaaaaaaaaaaaaaaaggtccagtcctcaaactctacagcgggggcgagccgaggaagaagaggtcgccgccgccgccaccgcttccatgtctgggggaatcgcccgcggccgccttgccgaggagcgcaaggcctggcgcaagaaccacccgcacggtttcgtcgcaaagccggagtcgctgcccgacgggacggtgaaccttatgatttggcactgcaccatcccccggcagcaagggactgattgggaaggtggatacttncctctcacccttcatttcagtgaggattacccctagcagcctccccaagtgcaagtccctcagggtttttttccacccaatgtatatcccttctgaaacagtctgtctttcgaatctttaatgaagaaaggggttggagaccagctattactgtttagcaaatttccccccgggatccaggactttgtaagatcgccaaaatcttggtaaacctgccaaaacggaggggtttcccccttttatccccggatcctaccaaaattaaaagggcggttaaaatgcggggaaaaagatttccccggttggttagaaaaatttcccccttaggggaccccagcgcccctctccccaaatttttccccagcccttataagaaaaaaaaa

SEQ ID NO: 50708 - protein, 70 aa, Zea mays
  misc_feature: Ceres CLONE 1464127-F
  misc_feature: SWISSPROT Homolog: EC 6.3.2.19 Ubiquitin--protein ligase
  misc_feature (59)..(59): Xaa is any aa, unknown, or other
MSGGIARGRLAEERKAWRKNHPHGFVAKPESLPDGTVNLMIWHCTIPRQQGTDWEGGYXPLTLHFSEDYP

SEQ ID NO: 50709 - DNA, 402 bp, Zea mays
  misc_feature: Ceres CLONE 1464135-F
  misc_feature: Encodes the peptide sequence at SEQ ID NO. 50710
aagtggactccccgcggtggcggccgctctagaactagtggatcccccgggctgcaggaattcgcacgagaccattacctagaacatcctaatcgaaaacattcctgaattcctccctggccagcggcgccgccaccgccatgaaccgcgttcacagcgagctgccgctgctgcgaaggagcagcgcaagacgacaagagggagaagagggagaagcacaaggatgcccaaggagaataacttggcggcgcctcccatgcccgaggaagaaagcccccaaaggaaaaaaaagcccaaaaccccaaaaacccaaaggggaagggtataaggggcccaaaccgggggggggggggagaaaaaaaaaaaaactttaaaacccccaaggggttttaaaaaaaagcc

SEQ ID NO: 50710 - protein, 34 aa, Zea mays
  misc_feature: Ceres CLONE 1464135-F
MPKENNLAAPPMPEEESPQRKKKPKTPKTQRGRV

SEQ ID NO: 50711 - DNA, 753 bp, Zea mays
  misc_feature: Ceres CLONE 1464139-F
aagctggagctccccgcggtggcggccgctctagaactagtggatcccccgggctgcaggaattcgtctcacccctaatcgaaaaaacgtacaaatgtctgtctgactgattagcttatgccgtctctgttctctagcagacgatacctgacgaaacgcccccactggaccggagggcgtgggtttggtctagctcgggcgttgtgtgctgtgatctatcggtgtctgttagctccagggttccagtgctatcgagctgtaggggacagaaggaatctcgcgggagaggggtgctcagcagggggagggagaagaggagacgcccgcctgacgacggggcaacagctgaccaagaacctgacctggagagttgtgggagcggacgtggaaagattgcacaggtcattgctacgctcttcgactctttcttctccactagggagatgagggttgtgatgattggtctggatgcagctggtaaaacaacaatactgtacatgcatcacatggaagaggttctttcatgagaacctacagtcggtattcatgtccatgaggttcactatgatgatgtcgacatcactggtgtgctatgtcggtggaccagattaactcatgtcactgtggcagatgtacctgagatattctgaggcactgatctatgtcggtgattctctgacataggaacgatcatacatgcgagctaagagttcttcatctttatcacgaaccttctgatgtaacatcataatt

SEQ ID NO: 50712 - DNA, 772 bp, Zea mays
  misc_feature: Ceres CLONE 1464142-F
  misc_feature: Translation starting site: 173
  misc_feature: Pfam Name: 2-oxoacid_dh Pfam Description: 2-oxoacid dehydrogenases acyltransferase (catalytic domain)
  misc_feature: SWISSPROT Homolog: EC 2.3.1.61 Dihydrolipoyllysine-residue succinyltransferase
  misc_feature (446)..(446): n is a, c, t, g, unknown, or other
atagctggagctccccgcggtggcggccgctctagaactagtggatcccccgggctgcaggaattcgtctcacccctaatcgaaaaaagcaacttcaaaagaatcatctccaccaaaagttgaagataaaccaaaggtagaggaaaaagccccaaaagtagatcctcccaagatgcaagcaccaaagccaactgcaccatcaaaaacatccccttcagaaccacagctccctccaaaagaacgagagcggcgggtgccaatgccaaggctcaggaagcgtattgcaaaccgtcttaaggattctcagaacacctttgcaatgctgagtacatttaatgaagttgacatgaccaatttgatgaagcttcgttctgattataaagatgaatttgtcacaaagcatggtgtaaaattgggccttatgtcttgctttgtcaaggctgctngttctgcacttcaaaacagccaattgtcaatgctgtcattgatggtgatgacatcatatacagagactacgtagacatcagtggtgctgtttggacctcccaaggccctggtgggtcctggtatccaaatgctgaaaccatgaactttgctgacctggaaaaggaataaacaaccttccaaaaaagcaactgaagggcccttcccattgaggaaatgggagggggaaaatcccctcctccaccggggggggtatgggaacccccttaggaaccttttattaccctccaaaggggtattttgggggaggttttccttgggacccccc

SEQ ID NO: 50713 - DNA, 771 bp, Zea mays
  misc_feature: Ceres CLONE 1464143-F
  misc_feature: Translation starting site: 152
  misc_feature (650)..(650): n is a, c, t, g, unknown, or other
aagctggagctccccgcggtggcggccgctctagaactagtggatcccccgggctgcaggaattcgtctcacccctaatcgaaaaatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccccgctggtccccgccgcgctgctcatcgggacggccgtcatggggttcctcacgtcgggcgcgctggggctcgggggcctgtcctcgctcacgtgcctcgccaacacggcgcggcaggcgttccagcgcaccccggactacgtggaggaggcgcaccgcaggatggcggaagcccgcgccgcacgcgggccacaagaacgcgcaggccaggcaggccctccagggcatgtcccangaggccggcgcccgggggaggtgcaagtgccggcgcctgcgcgcgggcgcagggctttcctcgaaagcaagtcatccctgcctggattattggatagaagccccccgtgccgtgtcctata

SEQ ID NO: 50714 - DNA, 723 bp, Zea mays
  misc_feature: Ceres CLONE 1464145-F
  misc_feature (106)..(106): n is a, c, t, g, unknown, or other
ctggagctccccgcggtggcggccgctctagaactagtggatcccccgggctgcaggaattcgtctcacccctaatcgaaaattaacaaggggaaggttgtaccantccatggatttgtaaatgtgaataaagtagctggcaactttcactttgcccccgggaaaagcttggaccagtcattcaacttcctgcaagacctgttgaacctccaaccagaaacttacaatataagccacaagataaataagctgtcctttggggaagagttcccaggtgtagtcaatcctcttgatggagttgagtggatacaggataactccaatggattaacggggatgtaccagtattttgtaaaggttgttccaacaatctacacagatatcagggggcgcaagattcactcaaatcagttttctgtgacagagcacttcagagaggcaattggctatcctaggcctccacctggtgtatatttcttctacgaattttcaccaatcaaggttgattttactgaggaaaatacgtcgctccttcacttcctgacgacatatgtgctattgttggaggtatcctcacggttgctggcatcatagattcttttcggaaccatggtcaccgccccatcagaaaaaaaatgaacctcggaaacttggggaaacccaattttcggcttatgcaatttggaccataccggaaacaatttgacttgggttgccctgccc

SEQ ID NO: 50715 - DNA, 758 bp, Zea mays
  misc_feature: Ceres CLONE 1464147-F
  misc_feature: Encodes the peptide sequence at SEQ ID NO. 50716
  misc_feature (369)..(369): n is a, c, t, g, unknown, or other
agagctggagctccccgcggtggcggccgctctagaactagtggatcccccgggctgcaggaattcgtctcacccctaatcgaaaacttcttcttttctgtttctttttctccccctccagccgcccgtcctctcggtctccgaccacgactgtgcgccttcctaagtaaccctagctcggcgccctccctccgcgacatccaagcccggcaatctcatcgtcgcgcttgcaccgttacgcagtgcgacctctgcgtcttcgaatccaggaaggtagagaggaggaggaggtttgtggcaggatttgaccagcccaatggttccatccgagatggggagcgtcgccaccgccgtcagcacgcctgctgnggacaagctgctccatgggcctatctctggcaagaagtgcaagaaaccatcccccaggaagattcataaggctgagagggagaagcttaaacgagaccacctaaatgatctctttgttgagctgggtaatatgctagaagcagatagacagaacaatgggaaagcatgcatactgactgacactactcggatactaagagacctgcttgttcaagtagactctcttcgaaaggacatagcgacctacaaaacgaatctcattatgtaacaatggagagggatgagatgcaagatgaaaacggcgtgctccgccaagaatttcagagcttcaaaccagttgacaatgcggggttcagggagtccagcagggtgggggcatggcaccgcca

SEQ ID NO: 50716 - protein, 106 aa, Zea mays
  misc_feature: Ceres CLONE 1464147-F
  misc_feature (18)..(18): Xaa is any aa, unknown, or other
MVPSEMGSVATAVSTPAXDKLLHGPISGKKCKKPSPRKIHKAEREKLKRDHLNDLFVELGNMLEADRQNNGKACILTDTTRILRDLLVQVDSLRKDIATYKTNLIM

SEQ ID NO: 50717 - DNA, 820 bp, Zea mays
  misc_feature: Ceres CLONE 1464148-F
  misc_feature (434)..(434): n is a, c, t, g, unknown, or other
aaagctggagctccccgcggtggcggccgctctagactagtggatcccccgggctgcaggaattcgtctcacccctaatcgaaaaccaaacaaaccgcgtccgcgtcgagtctctactctctcggctgtccggtccggcgcggctctcgcgtctccaacctacccatgctgcagctcctccaactccaaggctcacaccaccccgcgacgggcgacgctaattaagtagagctgcaacacctgggttggaggctagagcttgcaaacaccaccagccgaaacgtcgtggccagccatcccggtgtcgtcccgcgttctacagccaccgctgtcgccgccgtcctagactcctaaatccgtcagcttaagaagccccattccttcgaggccagcccatccgggggtttttttcccccccccccccccaacaaagntcttggtttctgggggaagaacccatcgccaattcccgccgggcggggggctcttgggcccccctcttccccggcccccaaaagggctaaactccccttgtcccggaaaaggcccttttccggccaaaaaaggccttcacaaccaacccccgaaatccaagggaagaaaccttcctggccccaaaaaaaattcccctcggaaactttggtttccaaaaacacccacatcctccaaaaaatggcgaaaagacacaaattttcccccaccccacatggggggcgcccaccaacaaagaaaccccgcccccctttaaaaaaatcccccatagacaaaaaaaaaaagagggcccccccaaatttgcaccacccccccccctgctggagac

SEQ ID NO: 50718 - DNA, 855 bp, Zea mays
  misc_feature: Ceres CLONE 1464158-F
acacgctggagctccccgcggtggcggccgctctagaactagtggatcccccgggctgcaggaattcgtctcacccctaatcgaaaactaacccctccttcgtttgcccatcctcgtgacggctcctcgccagtcgcctcgtctctccctgccgcgtcgcctccagttccgcctccgccgcgcctcccgcctccgacgcgcctgaagaacgcagtataggactgtgcaggtagagaggaggagggtcccgccagatggggatgccacaaaaaagcggaaccgaatctgaggcccgcgcgccgtagccgcggcccgcgcctaggcaaggggagggtttcctggcccttggaagggggcccttgttaaaaaggtttttccacggggggggggcgcgttaaaatttttaaaaaaattttttcccccccgccccgcttggggggtgccccccccccggggccacctattgcacggtgatcaatccgcccccttgaacgtgtcgtcggggattctcactgggtgttgtacctgatcttcctctcgtgatcgcctggcactgaagagctcgctacctcttcactcgggtagtattgcatgatcacccggcgctcctcggctcttcgcacacccccgcgtgctgctcatcaccacacacgagcgcgtgtagtgttgtcgccggggccgctcctgacaagtgctccctcgctgtcgcgtctcacgctagaccggctgctcggagtgtccctcctagtatcgctcgctatgtgccactgaggcgctcgctctcttgcgcgcgcaccctgcgacttgtggcaggccggccctccaactctctcttgtgcggtgccaatggccggt

SEQ ID NO: 50719 - DNA, 808 bp, Zea mays
  misc_feature: Ceres CLONE 1464162-F
  misc_feature: Encodes the peptide sequence at SEQ ID NO. 50720
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaaccccaactgtttgagtactatgctaagctgaggagctgcattcacatcatgtggtgggagcccgagggaggctcctttatcggaacagctcccctggcaccgacgcaatcagggcacccccccaagccctggacctaccctggttttgggcttggcaatgaaaacaaccccttggtttgtccaaagcctattccgaactaagagaaccaaggggccttttaaaccccatgtgtccccctccccacaaaacattggagcgccctttgcacaaaggcgcggaataaaggcctcttaaaaaaaaaaaaaaaaaaagaaaccccccgggggcacccaatttcccccaaaaagggaggctatattcccccgccccctcggggcccccttttataaac

SEQ ID NO: 50720 - protein, 72 aa, Zea mays; identical to SEQ ID NO: 46180
  misc_feature: Ceres CLONE 1464162-F

SEQ ID NO: 50721 - DNA, 755 bp, Zea mays
  misc_feature: Ceres CLONE 1464164-F
  misc_feature: Encodes the peptide sequence at SEQ ID NO. 50722
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (403)..(403): n is a, c, t, g, unknown, or other
  misc_feature (422)..(422): n is a, c, t, g, unknown, or other
  misc_feature (462)..(462): n is a, c, t, g, unknown, or other
acccgcggtggcggccgctctagaattcaaggatcccccgggctgcaggaattcttcccacccctaatcgaaaaaacattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacggggggcaccaagccggagtacatggtggtattnnnntccggaaaccacccctactacgtcggnaacacccccctttgtctcnggtcatggacagccagatcgagaacttccccaccaactgnggccacatcaaggagtactggcccaaggaccagtggagggagatgcacccagacggcgacccgaagtttcgagccggagggggacaactgattgatggctccccgtcttcctcacccggtgcgtggtcaccggtccaatttacatttccccccttgaatggaattgaaactcctgtctcgtcccattgctctccagctgtcccgctaaaggctccgatggaaatgtaaattatctactctcgaaaagggggcctggttaaacaggagccccccaattacaatgggttttctgt

SEQ ID NO: 50722 - protein, 100 aa, Zea mays
  misc_feature: Ceres CLONE 1464164-F
  misc_feature (5)..(54): Pfam Name: Ribosomal_L31 Pfam Description: Ribosomal protein L31
  misc_feature (41)..(41): Xaa is any aa, unknown, or other
  misc_feature (42)..(42): Xaa is any aa, unknown, or other
  misc_feature (58)..(58): Xaa is any aa, unknown, or other
  misc_feature (71)..(71): Xaa is any aa, unknown, or other
MRCSMRKKGLHPEIYEDAKVYCNGELVLVTGGTKPEYMVVXXSGNHPYYVGNTPLCLXSWTARSRTSPPTXATSRSTGPRTSGGRCTQTATRSFEPEGDN

SEQ ID NO: 50723 - DNA, 611 bp, Zea mays
  misc_feature: Ceres CLONE 1464168-F
ctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaaaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctctttttttttcctaaagaacgtacattgtcattttttggaagcttctgaaagcatggcgtgcgcgtgaactatgaaggatgagtccctccaaactaaactgtttggtactatgctaagccaaggacctgattcccatcttgttgtggaccccaggaaagcttctttttcgaaaaccctcctttgcaccaaccaattcggaccccccccagcccgggaacaccccgggtttggctttggcaaaaaaaaaccccctgggttttccaaaacccatacccaacctaggaaaaaac

SEQ ID NO: 50724 - DNA, 752 bp, Zea mays
  misc_feature: Ceres CLONE 1464170-F
  misc_feature: Encodes the peptide sequence at SEQ ID NO. 50725
  misc_feature (380)..(380): n is a, c, t, g, unknown, or other
  misc_feature (382)..(382): n is a, c, t, g, unknown, or other
  misc_feature (383)..(383): n is a, c, t, g, unknown, or other
atagctggagctccccgcggtggcggccgctctataactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcattttgggaagcttctgaaagcatgncnngcgcgtgaactatgaatgtatgagtctatctcccaccccaaactgtttgagtactatgctaagctgaggagctgcattcacatcatgtggtggagcgcgagggaggcttctttatcggacagcctcacttgtcaccgacgcaatcaggcacccccccaagccgtggactacgctgggtttggctttggcatgagaacgaccgctgtgtttgtcataagtcatatcgtaactagagaaacaagtagctttataatcacaatgtatcaccctcctacagaactatggatgcgtcttgtacttaggccggataaagcgcttcctaaaaaaaaaaaaaaaacgagacgctcgaggtacccatttcccctatag

SEQ ID NO: 50725 - protein, 73 aa, Zea mays
  misc_feature: Ceres CLONE 1464170-F
IAGAPRGGGRSITSGSPGLQEFVSPLIENKWERQRFGLQGGFVTNPLAEPNISSAGKTMVTHEGRKKDKTLQK

SEQ ID NO: 50726 - DNA, 769 bp, Zea mays
  misc_feature: Ceres CLONE 1464171-F
  misc_feature: Encodes the peptide sequence at SEQ ID NO. 50727
  misc_feature (437)..(437): n is a, c, t, g, unknown, or other
  misc_feature (439)..(439): n is a, c, t, g, unknown, or other
  misc_feature (469)..(469): n is a, c, t, g, unknown, or other
  misc_feature (524)..(524): n is a, c, t, g, unknown, or other
aaagctggagctccccgcggtggcggccgctctagaactagtggatcccccgggctgcaggaattcgtctcacccctaatcgaaaatcacattcacatcgcactctcctccagcctccaggcttggcaagcgtgcttcaacatgaccacatccatgtcgaacagcgccgctagcgagaagcaagcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctcccccgcagcgagctcctcgcacgggcgccgcgaggtgtccgccatgatggacgagctgggacacgaccgcgacggcttcgtggaccctcgcgaagtcaaggcgttcccacncnccccggcggcggcggcttggacaaacaacncccaaaatcggggcggccttcgacgttctacaaagtcaaacggggaccgcccgcntcccggcggccccaacttgtaaaagtggctccccccccaccggcaaaggcggatcccccccccaaaaaatggcaaccggaagggcccccgggtttaatcccaaggggtgctccgggttcaaaagaattcaaaaaaaaaagtggccccccacccaaaacaaaaaacgggcccccccgggggggaaaaaggaaaagcccccgccccaaaaaaaagagaaaggggggtttttccggggaaaaaaaaac

SEQ ID NO: 50727 - protein, 130 aa, Zea mays
  misc_feature: Ceres CLONE 1464171-F
  misc_feature (29)..(57): Pfam Name: efhand Pfam Description: EF hand
  misc_feature (95)..(95): Xaa is any aa, unknown, or other
  misc_feature (96)..(96): Xaa is any aa, unknown, or other
  misc_feature (106)..(106): Xaa is any aa, unknown, or other
  misc_feature (124)..(124): Xaa is any aa, unknown, or other
MSNSAASEKQAQQAGHRQRPPAASAADAEMQRVFCRIDADGDGRISASELAAVTRAISPAASSSHGRREVSAMMDELGHDRDGFVDPREVKAFPXXPAAAAWTNNXQNRGGLRRSTKSNGDRPXPGGPNL

SEQ ID NO: 50728 - DNA, 751 bp, Zea mays
  misc_feature: Ceres CLONE 1464172-F
  misc_feature: Encodes the peptide sequence at SEQ ID NO. 50729
atagctggagctccccgcggtggcggccgctctagaactagtggatcccccgggctgcaggaattcgtctcacccctaatcgaaaagttactcctccgtcctccctccgcgtttacacccgccgccactcctgccttggcgccgtagctagcaaaggcgatatccatggcgagccctgcacggatcgagctggacaagctgagcgtggagcagctcaaggggctcaaggagcagacggatctggaggtcaacctcctccaggacagcctcaccaagatccgcaccgccgccacccgactcgagaacgcctccgccgcgctccaggacctatccctccgcccccaagggaagaagatgctcgtgccgcttacagcgtccctctacgttccgggttcactggacgacgcggagaacgccctcgtcgatgtcggcaccggatacttcatcgagaaaaccatggctcaggggaaaaaatacctgtcaaggaaattaattttattgaagcaatttttgtgaattgggtgaagggggtaccaaaacaaaaaccaaaccaaacaaattgggtttgcttctccaaaccaaacttaagaaaaggtgcaccgggccccaagtccaaaaaagcgggaagacaaacctggtttcttcccccttttttgtgaccaaaccctcttttaaaatttttaaaggagaaacccccccccccccaaaaaattattctttttggaacctcccgcccaaaaaaaaatttttc

SEQ ID NO: 50729 - protein, 116 aa, Zea mays
  misc_feature: Ceres CLONE 1464172-F
  misc_feature (24)..(117): Pfam Name: Prefoldin Pfam Description: Prefoldin subunit
MASPARIELDKLSVEQLKGLKEQTDLEVNLLQDSLTKIRTAATRLENASAALQDLSLRPQGKKMLVPLTASLYVPGSLDDAENALVDVGTGYFIEKTMAQGKKYLSRKLILLKQFL

SEQ ID NO: 50730 - DNA, 780 bp, Zea mays
  misc_feature: Ceres CLONE 1464177-F
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
atagctggagctcaccgcggtggcggccgctctattaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgatatnannnngtgcgcgtgaaccacgaatgtatgagtcactccgcaccccaacctgtctagagtactatgctaaactgaggagctgcattcacatcatgaggtggagcgcgggggaggcttctttatccgacagcctcccttgtcaccgacgctatcagggacccccccaagcccgtggactaccctggggtttggctttggcatgagaaccaacccgctgggttggccccaacgcctatccccaactagagaaacagagacctttaaaaaacccaatgtatcaccactcctacagaaaccttggaacgcggcttgttcctcaggccctgaataaagcgcttcctaaataaaaaaaaaaagaatcaggcccccccaggtcccccaattcccccttatatcggacccgt

SEQ ID NO: 50731 - DNA, 779 bp, Zea mays
  misc_feature: Ceres CLONE 1464179-F
aaagctggagctccccgcggtggcggccgctctataactagtggatcccccgggctgcaggaattcgtctcacccctaatcgaaaacttcccctcgcgcaccgctcctgttcaccctgaccaccgacgacgccgagccgccgctgcaactgtacactgtcactatggcccgtaataaggtgaaccagcttcgtcggacgagcgtgagcgacctgccggcggacgtcatggagctgaggtctgatctctccttcatccgcgtactcaggacaccggaggcgcacctagaagttctctagatgaagtgatgcgcacctctatcgcttgtttgttgaagttatctcggactaccatatgtctgggtttcgatgaagcgacaaaaagagaacctgttcccccttgagtttcgccccaccaaaacccgtgcatccgcttccgtctaaataagaccggcttttttttgttccgaaaggggaaagaaggtttgaaacccttccccaagagaaatttgttttaagggccggtcataacgggaagggggtggttttgaaattccccgggggggttaaaattttgggttttaggggcatttggtgtgggccaaaaataaaatcttccctttttttgccataatgggccaattggttttgacggggaaaaaaaaaaaaaacagaagggttggaggcccccatttcgccctatatgggggttttttttcggggcgcccacgggcgcgctatataaaaagcgcgtgtgggggaaaacacctgtgtttcaaaa

SEQ ID NO: 50732 - DNA, 763 bp, Zea mays
  misc_feature: Ceres CLONE 1464182-F
  misc_feature: Encodes the peptide sequence at SEQ ID NO. 50733
agagctggagctccccgcggtggcggccgctctagaactagtggatcccccgggctgcaggaattcgcacgagaccattacctagaacatcctaatcgaaattccataattccattcatccgctccgctccactccagtcggtcctactagtcctaccctccccgcctccccggcatcccttcgccatagcagcaccagacagcagagcaccaaacccacacttctttcacctcccctgccccctcctccattctccatcgcaatccgccgccgccgatggcgaggccgacgcgcgcgctcctgctcccgctcctcctgctcctggtgctggcccgcgcgtcgggcgacgtgccggcggcggcgtccctcggctgggacctccgcgtggtgggcgcgggagaggacgaggacctcggcttccctggcggggactccgtggcgtgccgggtgctgcagggcggcggctacctcagctacggcgcgctgcgcagggacaacttgccctgctccgtccggggagcctcctactacaactgccgccccggcgggcaagctaacccctactcgcgcggctgctccgccatcacacgctgccgcggctgatctcggcgtccgccaataggaagaggaggttcatatccgtttatcctgcgccgtttgtggctgataccgagaaaatcattcatctccctccctgcccctttaatcgattattgggacaggtacgccaccctctccccccccccccctggtgatggattt

SEQ ID NO: 50733 - protein, 108 aa, Zea mays
  misc_feature: Ceres CLONE 1464182-F
  misc_feature (43)..(108): Pfam Name: RALF Pfam Description: Rapid ALkalinization Factor (RALF)
MARPTRALLLPLLLLLVLARASGDVPAAASLGWDLRVVGAGEDEDLGFPGGDSVACRVLQGGGYLSYGALRRDNLPCSVRGASYYNCRPGGQANPYSRGCSAITRCRG

SEQ ID NO: 50734 - DNA, 763 bp, Zea mays
  misc_feature: Ceres CLONE 1464185-F
  misc_feature: Encodes the peptide sequence at SEQ ID NO. 50735
tggagctccccgcggtggcggccgctctagaactagtggatcccccgggctgcaggaattcgcacgagaccattacctagaacatcctaatcgaaaaaccaccatctcagttcatatacggctcccgaggaggacccagttaccctcacagccgagctttgcttaaggcggatgaacaggaagccaggagactgggactgcagggcgtgccagcacctccacttcggccgccgagacatctgccagcgctgcggcgagccccgtggagttgctgatcgtgggggcagaagacgaggaggggactacaccagctccggtggacgcgggggctcctccttcggaggcggctttggcgctgctgaggatgacacccggcctggagagtggtactgctgctgctgcgcgcaccacctcgccagccgctccagctgcttgaagtgctccgcctactaagaggacgccgctgtgaacagtggcgctggcggctttgacggcgacatgtcacacgcatggggctacggactccgcagctgcggtgctggtgctggcgcgcggcctgctcgtactacctgacgccccggtcggaagtccggagactggaccggcaccagatgcggagggcacgggcacaacatcccctccaggatgtactgcttctggtgcgacgaacggctggactctggcagcgctgccatgacctagcacaacacttgcccggaggtggagggatcatcaattataaaggtccgcaccgccaagaagg

SEQ ID NO: 50735 - protein, 93 aa, Zea mays
  misc_feature: Ceres CLONE 1464185-F
MNRKPGDWDCRACQHLHFGRRDICQRCGEPRGVADRGGRRRGGDYTSSGGRGGSSFGGGFGAAEDDTRPGEWYCCCCAHHLASRSSCLKCSAY

SEQ ID NO: 50736 - DNA, 764 bp, Zea mays
  misc_feature: Ceres CLONE 1464193-F
gctcttgaactagtggatcccccgggctgcaggaattcgcacgagaccattacctagaacatcctaatcgaaaagaggccatatggaccaccaacgagcccagtcgaaaaggcaggcaccgcccccaacggtaaaggtggtgatcgagcaagtcctcccaatacccaggtcatggaggatggcagcagtgctccgagaagggctactccccccacccgcaggagcagatctgccgacttccacaacttttcataaaggacgagaagggacaggatcaacgagaagctgagagcgttgcaggagcttcttccaaactgcaccaagaccgacaaagtttggatgttatatgaaccgatcgaatgcgtaatatccctccagctaaagccccaccttcccgccaatgatgcaaccggggaagaaagggaaccggcggttcctcctgcaactacaagcagagctgcccctaggttatggtccaaccccgccccaccagatgagggcctacgccggatgcgaccctgcacccggtggaattgtaaacccgccccctgcccgccctttttcgtatcccccaattagtcagccgcaccctgccaggatccggctacacacccccccgcctcctattaatgtcccacctgtcaaaaccggacttcttttctccaggaagcctaaacctgtcccccctcccaacaagccccccctatcgacacccctttctccctggcctgaaaaccttggggtttcttttccccctcaacagg

SEQ ID NO: 50737 - DNA, 620 bp, Zea mays
  misc_feature: Ceres CLONE 1464194-F
  misc_feature: Encodes the peptide sequence at SEQ ID NO. 50738
tggagctccccgcggtggcggccgctctagaactagtggatcccccgggctgcaggaattcgcacgagaccattacctagaacatcctaatcgaaaactggtcctccattcaagctccactactccacacctagacttcccaatcctccattgggcaacctgtcacacagtacgccgtcgcctgtggtttggtttgtggagtgagagagaaagatagagatagacatcagactcggactcggacagaaggagatgatgtcgagggagcgcaagaaggcggctgctcttcaggagaagctgaagatcctccgctccatcactcacttccacgctctgagcaacacgtccaatatcatggacgcgtcggcgtacatcagggagctgaagcaaattgtggtgaggctgaacccagtaaattgcttgcgcgcaagacccccctaaaaaaaaaagggcattaatcctatcccccgggggaaccttgtgaaacccttagaaagttccggggggcccccccttccctggaggaacgggttttcccccaaaaaaaaaaattttcccccgggggttttttttttcccccccggggggtggaaaggccttttcaaaaaaaaaggtggggg

SEQ ID NO: 50738 - protein, 62 aa, Zea mays
  misc_feature: Ceres CLONE 1464194-F
MMSRERKKAAALQEKLKILRSITHFHALSNTSNIMDASAYIRELKQIVVRLNPVNCLRARPP

SEQ ID NO: 50739 - DNA, 766 bp, Zea mays
  misc_feature: Ceres CLONE 1464197-F
  misc_feature: Encodes the peptide sequence at SEQ ID NO. 50740
ctggagctccccgcggtggcggccgctctagaactagtggatcccccgggctgcaggaattcgcacgagaccattacctagaacatcctaatcgaaaagtacgtattcgaggccaagacggtgcgccggatggagctgctcgtgctctccgcgcttgggtggcggatgcaccctgtcacgcccttctcctacctccagcccgtcctcgccgacgctgcgacgcgcctgcgtagctgcgagggcgtcctgctcgcggtcatggccgactggaggtggcctcggcaccggccttcggcgtgggccgccgccgcgttgctgatcacagccgccgccggcgacggcgacacggagctcctggcgctcatcaatgcccccgaggtcagcgcagcacaatgccattgcatcagcacaatactgtaggctgttgtgagactgcgttgataaccaactgctggacgcgtcgcaggacaagaccgccgagtgtgccaagatcatctccgaggtgacgggcatgagcttcctcgcctgcgatgtcggcgtgagcgccggaaataagcgtaagcacgcggcggcgcagttgtactcgccgccgccgagcccgagcggcgtgatcggcgcgctgtcctgcttcagctgcgagagctcgacgtccgccaccgctatggctgcggcggtcggcccgtgggcgccgtcggcgtccgtgtccgtgtcgtcctctccagagccacaggtcgggcccccagcgcgcagcggcggcgtccgcgtc

SEQ ID NO: 50740 - protein, 96 aa, Zea mays
  misc_feature: Ceres CLONE 1464197-F
MELLVLSALGWRMHPVTPFSYLQPVLADAATRLRSCEGVLLAVMADWRWPRHRPSAWAAAALLITAAAGDGDTELLALINAPEVSAAQCHCISTIL

SEQ ID NO: 50741 - DNA, 757 bp, Zea mays
  misc_feature: Ceres CLONE 1464200-F
  misc_feature: Translation starting site: 233
ggagctccccgcggtggcggccgctctagaactagtggatcccccgggctgcaggaattcgcacgagaccattacctagaacatcctaatcgaaaaaaccatcacccgcccacacggagcacgctccacgccccgcgcggaaaagacggagagagaacaaaaaagttaggggggggaagaggagactcggcggcccgaacgacaagcgctgacgcacgtacgtcggcaagtaatgtaccaggccatcccctacagcagcgcccggccgtggctgatgccggcgggcgaggcggccgccgtcgtcgccgtgaagccggagcctgagccggcggcggcggcgaccgtcgcggaggagcgcgcccgggccgacgccgcgggcgggacggacgacgacggcgactgttttcccccccccacgtcgggagggccgtggcggagagcccggtgctggtggtggggcggcgcgggtgctgcctgagccacgtggtgaagcggctgctgcaggggctcggggtgaacccggccgtgcacgaggtcgcggacgaggccgcgctcgccggggtcgtcccggccggcgcggaggccgccgccgccgcgctgcccgcggtgttcgtgggcgggaagctcctcggcgggctcgaccggctcatggccgtccacatctcccgcgagctcgtggccatcctcaagaaagccggtgccctctggctctaattttaaatctgtcaggcaagcgtatctcttccttcctcgtttt

SEQ ID NO: 50742 - DNA, 756 bp, Zea mays
  misc_feature: Ceres CLONE 1464203-F
  misc_feature: Encodes the peptide sequence at SEQ ID NO. 50743
  misc_feature (460)..(460): n is a, c, t, g, unknown, or other
  misc_feature (462)..(462): n is a, c, t, g, unknown, or other
  misc_feature (474)..(474): n is a, c, t, g, unknown, or other
  misc_feature (476)..(476): n is a, c, t, g, unknown, or other
  misc_feature (477)..(477): n is a, c, t, g, unknown, or other
  misc_feature (501)..(501): n is a, c, t, g, unknown, or other
  misc_feature (505)..(505): n is a, c, t, g, unknown, or other
  misc_feature (506)..(506): n is a, c, t, g, unknown, or other
  misc_feature (541)..(541): n is a, c, t, g, unknown, or other
tggagctccccgcggtggcggccgctctagaactagtggatcccccgggctgcaggaattcgcacgagaccattacctagaacatcctaatcgagaaatcccaaatctcaacccaagaacaaaaatggccaccgccaccactgaagccgaagtccgtgagtccctcggcacgaagttcggtcgcctcaaggaacaggcgaaagacatggcctccaggcaccccgtcgctggagccgcggccgtcatcgctgtcagcgccgtgggcgcctacttcttgtggcccgtggcagccccggccgtggccatgatgaaggcgcctggatccggcggtgtgctcgtctcccgcgcggcgtttctcgcgaagaaggagctgtactttcagctcttgcgcacccgggggcgttttgcggcgcggtcgccgcttttggcgtagctgcgcatgcagtagtggtacatgctngntcgtgaacgaancnngcggcccgaacgtttcaggtttgnatgnntgaccaagtgggttaattagtactttccctttccntggggggtgaaatccccgactccccgagttttggattaactggcaaaaacccattgtttgggggcatgaaccagtttgatgaaaaaagggaaacccttttaaaaaaaaaaaaaaaaaaaagtttttcgaaaccctcaaccccgaggggggggccggtgacccaatttcccccaatagggggtcattttacgccgccccggggccccttttttaaa

SEQ ID NO: 50743 - protein, 102 aa, Zea mays
  misc_feature: Ceres CLONE 1464203-F
MATATTEAEVRESLGTKFGRLKEQAKDMASRHPVAGAAAVIAVSAVGAYFLWPVAAPAVAMMKAPGSGGVLVSRAAFLAKKELYFQLLRTRGRFAARSPLLA

SEQ ID NO: 50744 - DNA, 778 bp, Zea mays
  misc_feature: Ceres CLONE 1464207-F
  misc_feature: Encodes the peptide sequence at SEQ ID NO. 50745
  misc_feature (360)..(360): n is a, c, t, g, unknown, or other
  misc_feature (414)..(414): n is a, c, t, g, unknown, or other
  misc_feature (746)..(746): n is a, c, t, g, unknown, or other
ctggagctccccgcggtggcggccgctctagaactagtggatcccccgggctgcaggaattcgcacgagaccattacctagaacatcctaatcgaaaaagcaatcagcaataatctcgccgtctcatcgcaaaacccagcgccccaaagcgaccccaccgaagcgtcccagcccgaccggaatggcgatggcaccgtgcgcacccgcctccgtctcctccttccccgcccgtccagtgcggaccccttccgctgtccggccgcgcggcgccgcgatccgcgccgctgcggcggcggtggagggtggcaggtggtgggcgccactactggggtggtcggggaaggccgactaccttgaggncccggccccggccccgggcgttgcgcaggacgacgacgcgtcccgcgcgcgcangcagttcgtggggggcctgacggaggaaaaagcccgccagctgcgggcgcggatggcccaaaacggatctttccacaagccttgttacaatcggcattggcttaaggcctggcggttcggcaaaaaagggcgggcggccggccgcccgccccgggggttaattctaaaggcccccccccttttggggaaaccgggttcccccctccttttcgggggggatttttgttcccccaccccttttgcccccccccccccccgggaaaaaaggggggaaagggatctccgtttttttaaagaggccccaaccccccccccccttttcaccactaaanccccccccggggtgcccaaaattgagaaaaaa

SEQ ID NO: 50745 - protein, 199 aa, Zea mays
  misc_feature: Ceres CLONE 1464207-F
  misc_feature (60)..(60): Xaa is any aa, unknown, or other
  misc_feature (78)..(78): Xaa is any aa, unknown, or other
  misc_feature (189)..(189): Xaa is any aa, unknown, or other
MAMAPCAPASVSSFPARPVRTPSAVRPRGAAIRAAAAAVEGGRWWAPLLGWSGKADYLEXPAPAPGVAQDDDASRARXQFVGGLTEEKARQLRARMAQNGSFHKPCYNRHWLKAWRFGKKGRAAGRPPRGLILKAPPLLGKPGSPLLFGGDFCSPTPFAPPPPREKRGERDLRFFKEAPTPPPLFTTKXPPGVPKIEKK

SEQ ID NO: 50746 - DNA, 723 bp, Zea mays
  misc_feature: Ceres CLONE 1464208-F
  misc_feature: Translation starting site: 198
aaagctggagctccccgcggtggcggccgctctagaactagtggatcccccgggctgcaggaattcgcacgagaccattacctagaacatcctaatcgaaaaccgggttctggctcgccaaaccctagccgccgagtgccgcccaccgcccgcccgccctccgccgcgcgtcggacggtgccgagggaagaggcaccatgaggttggagaagtgctggttctgctcctctaccatctaccccggccatggaatccagttcgtccgcaacgacgccaaggtcttccgcttttgccggtcaaagtgccataaaaacttcaagatgaagaggaacccctcgtaaggttaagtggacaaaagcatacaggcatttgcatggcaaggacatgacccaggatacaacctttgagtttgagaaggaagaggaacaggcccgagcgctacgaccgcaatttgacggagcagactcctgaaggctatccccgcttattgcaaagaattaggcatgaccgtatgggaaaacacatctcaaacagacataaacctggtaaacgcaaggagatggaaaaggactccaaggagctggagcaggacatcggcatgctcccgaaaaagcttattatcaaccatctcgcggctgaaaaaacgaaggtcaagggttgaagttgttcagcagcagacagaaaataacctatggaggaatagtgcgtggccatttgttgtgc

SEQ ID NO: 50747 - DNA, 838 bp, Zea mays
  misc_feature: Ceres CLONE 1464210-F
  misc_feature: Encodes the peptide sequence at SEQ ID NO. 50748
  misc_feature (420)..(420): n is a, c, t, g, unknown, or other
  misc_feature (422)..(422): n is a, c, t, g, unknown, or other
ctggagctccccgcggtggcggccgctctataatagtggatcccccgggctgcaggaattcgcacgagaccattacctacaacatcctaatcgaaaaaactggttagttattccgtgccgtcccaactcacccgcggctccgtgccatccgtcgccgccggcgcaccgcgatggccgcctccgccccggccgtgaggcctctcgcccgggccgcaatccctatcccgctctctgcgcggccgcggaccgccagggtctccttgctccccctggctcctcttgctccggcccagcgcctcgctctcgggcggaccgggcaagcgcgcttgccagcgcgccaccggtcggtggcgtgcttggggtgtgttaacccaaagatgcgggaaacgcttgaaaaggtgtggaccacctgactccgcnanaaattaaaaaaagggaacaaagggactttccccaggggggcttcccccacacctacaagaaaaacccgggccccgtaccaatgggccctttaggaacgtttaaagtggcccccaaaaaaggggccccgcggcggggttcaaaggaaataccaggttggcgcccatttcccagggttttaaatcaagagggggaggttctcgcgcgaatgggatacccccgcccaggccaacaaaaatggggaaaactcgcgcacaacccctagaaaaaaattgggtgttctcctaaaaaaaaaagacacttatgccgaggggggacaaatatttaaccaaggggtgtatatattttgtgtggggtctaataaaggggtgtggcctcccacgcgataatacccctctttggataatattacttcttg

SEQ ID NO: 50748 - protein, 80 aa, Zea mays
  misc_feature: Ceres CLONE 1464210-F
MAASAPAVRPLARAAIPIPLSARPRTARVSLLPLAPLAPAQRLALGRTGQARLPARHRSVACLGCVNPKMRETLEKVWTT

SEQ ID NO: 50749 - DNA, 722 bp, Zea mays
  misc_feature: Ceres CLONE 1464211-F
  misc_feature: Encodes the peptide sequence at SEQ ID NO. 50750
  misc_feature (686)..(686): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaagataaaccacagagccaccccactaactactttcaccattgtttccagaaaaatctccgcgcataatattctctagagcaaacgctctgtcatcacacaacactagttcgtccgcacgacactcccgcagttcctcgacaggggagaggtttccattccaggcggttgcggttgcggttggcggcggagatgagccgggggagcaagctccggtggctgtggcgcgcgccggcgcgggcgctggggcgggcgcgggacctgtacgtgcgggggctgacggggtgcgcgcgccacgtcccctccgacgccgtgttcgggtaccccgtgttcgtgccggcgccgctgtccaggagccacagcgccgtcggctggggcgccgggtcgtccgaggccgacgaggacctgcgcgaggtggtccgcgccgcgtcgcagcgccgcgtggagcagcgccgcgccgagctgcaggccgtggcccggagccagagcatggccgcctcgctctccatggcgcgcatcgacgaggacgcgccgtgcgacttcggggcgcccggggcgctgtgcccgaggagccagagctgtgtcgncgacgtcgncggggaggaggccccaccgccgcggcc

SEQ ID NO: 50750 - protein, 143 aa, Zea mays
  misc_feature: Ceres CLONE 1464211-F
  misc_feature (132)..(132): Xaa is any aa, unknown, or other
  misc_feature (135)..(135): Xaa is any aa, unknown, or other
MSRGSKLRWLWRAPARALGRARDLYVRGLTGCARHVPSDAVFGYPVFVPAPLSRSHSAVGWGAGSSEADEDLREVVRAASQRRVEQRRAELQAVARSQSMAASLSMARIDEDAPCDFGAPGALCPRSQSCVXDVXGEEAPPPR

SEQ ID NO: 50751 - DNA, 744 bp, Zea mays
  misc_feature: Ceres CLONE 1464214-F
  misc_feature: Encodes the peptide sequence at SEQ ID NO. 50752
  misc_feature (536)..(536): n is a, c, t, g, unknown, or other
aagctggagctccccgcggtggcggccgctctatactagtggatcccccgggctgcaggaattcgcacgagaccattacctagaacatcctaatcgaaaaaattttctcctcggggactccactcggttgccggccatggcggagaatttggcccccgagaagcgccacaccttcgtgcacaacgggcagaaggtgttcgagtgggaccagacgctagaggaggtgaacatgtacatcgagctccccaagggcgtgcccaccaagctcttccactgcaccatccaggccagccacgtcgaggtctgcatccgcggcaacccgccatatctcaaccatgacctgatgcaccccgtgaagaccgattctttcgttctggacaatagaggatgcttagatgcctataaccccccccccaacaagaaaggggaaaacttgggcatccccataacaggggcaagggattttggaatccctttgctggaaatcaagacccaaaacggtttttgctcccaagggttttcgagaaaaacacccnggggtcaaatttttccaggggccaattctatggaaacctcccccgaccccaaaaccttctgggaaggaaaaacccctcgggggggccccccccccccccttttgtgtggtattttcccgggggggggttctcccggaaaaccccggggggggccccctctttggggcccccctattgatggggcacacaccctctttacccccttttt

SEQ ID NO: 50752 - protein, 202 aa, Zea mays
  misc_feature: Ceres CLONE 1464214-F
  misc_feature (19)..(83): Pfam Name: CS Pfam Description: CS domain
  misc_feature (134)..(134): Xaa is any aa, unknown, or other
MAENLAPEKRHTFVHNGQKVFEWDQTLEEVNMYIELPKGVPTKLFHCTIQASHVEVCIRGNPPYLNHDLMHPVKTDSFVLDNRGCLDAYNPPPNKKGENLGIPITGARDFGIPLLEIKTQNGFCSQGFSRKTPXGQIFPGANSMETSPDPKTFWEGKTPRGGPPPPLLCGIFPGGGSPGKPRGGPPLWGPPIDGAHTLFTPF

SEQ ID NO: 50753 - DNA, 799 bp, Zea mays
  misc_feature: Ceres CLONE 1464223-F
  misc_feature: Encodes the peptide sequence at SEQ ID NO. 50754
  misc_feature (373)..(373): n is a, c, t, g, unknown, or other
  misc_feature (377)..(377): n is a, c, t, g, unknown, or other
aaagctggagctccccgcggtggcggccgctctataactagtggatcccccgggctgcaggaattcgcacgagaccattacctagaacatcctaatcgagaaatctacctcgaaagagaggtcgcagacggaacccttccaccctcccgacaccaccttcgattcctctgcgatttccccccgcgcgctcgccgattccttgatcgactcccgcgtgattcgctttctggtcggattctctctcctcaagcatgcagtcggatcagcctgtgatcagcttgcgccccggcggcggcggcggcccgcgcgccggccgcctcttctcccccgcctttgccacctccgtttccggagacttcctccggctgaacgncggnggcgcctccggcatctccaagatcggtgattcccccccccggcccccgtgagcgtgtccgtttcccaagaaatcaacttctccaacctccttgagctggttaatgggtctgaagaattttaaaggctccagccaaaaattggttttgacctttttggtggaaaaatcaacccggggttcccaaaggtttccgttttttaaggggaaagtcccggggtaaaacaaaccctcaaaactgtttggggaagaaggaaaatctgttttgggggggggggttcaaaaaacccttttttgtataaaagaaaaaattgggggaccaccccccggggggaaaaacccccccccctgggggggggggagtttttttcactcccccccccgggggggggggcgcggccccacccctctcaaggggggattatc

SEQ ID NO: 50754 - protein, 58 aa, Zea mays
  misc_feature: Ceres CLONE 1464223-F
  misc_feature (41)..(41): Xaa is any aa, unknown, or other
MQSDQPVISLRPGGGGGPRAGRLFSPAFATSVSGDFLRLNXGGASGISKIGDSPPRPP

SEQ ID NO: 50755 - DNA, 839 bp, Zea mays
  misc_feature: Ceres CLONE 1464225-F
  misc_feature: Encodes the peptide sequence at SEQ ID NO. 50756
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (308)..(308): n is a, c, t, g, unknown, or other
actttgtgtagaaacccagaaataacacnnnnacacccactaaatagctggagctccccgcggtggcggccgctctagaactagtggatcccccgggctgcaggaattcgcacgagaccattacctagaacatcctaatcgaaaacccagatcccaccaacgcagcgcagggatcgagtagcccaccaccccaccccgcgacgctaaccgacgcaatggcgacgctcaccgttccttcctccgtcccggccgtcgccgaggactgcgagcagctccacaaggctttcgaaggttggggcaccaacganaagctgatcatctccatcctgggccaccgcaacgccgcgcagcgccgcgcgatccgccgcggctacgccgaggcgtacgggaaggagctgctccgtgctctgggtaacgagaaccacggcaagttcgagagggcggtgatcctgagggggccccaccccccggagagggacgcggtgctggcgaacgaggaggccaacaacaaccacaccgggagacgcgcgctgttgtgagattgcgtgggcgcgctcggcccgtgcggctcattgcgggttaagcaggtgtaccatgaacgggttaaagcgaaggcgcggaaaggacgtggccggcccatgtcacccggcaaacttcccaaaaggcgaagggcgtcggaatctaatgaaggccttgaaccctggctttgcaataatcgcacggggccgaaattcgcgttatcgctcctttgacgagatgcgtgggggcttgaacgtggtcagcgctaccggatactggagaggctcgcctaagtacgggtggcctgcaacggggtggtt

SEQ ID NO: 50756 - protein, 107 aa, Zea mays
  misc_feature: Ceres CLONE 1464225-F
  misc_feature (15)..(80): Pfam Name: Annexin Pfam Description: Annexin
  misc_feature (31)..(31): Xaa is any aa, unknown, or other
MATLTVPSSVPAVAEDCEQLHKAFEGWGTNXKLIISILGHRNAAQRRAIRRGYAEAYGKELLRALGNENHGKFERAVILRGPHPPERDAVLANEEANNNHTGRRALL

SEQ ID NO: 50757 - DNA, 879 bp, Zea mays
  misc_feature: Ceres CLONE 1464232-F
ctttttcttatccacaacccgcaagaacccaccacacaccaaatactgggactccccgcggtggcggccgctcttttactagtggatcccccgggctgcaggatttcccacgagaccattacctaaaacatcctattcaaaaactcaccactcatcaccacctacctataccaaagcacttggcatccaccgagcgcgggctgcaccacgagccgacgagcctacaagaggggcaggcacctccctcctcaaggaacatggcccgcatgcaaaagttggcagtggcgacagcggccgaggtggccttgctgctgctggaggcggcggccaacctcgtagctctatgtaagctacgagtcttctgcgacatgcatcgccctcttgtactcctacaccactggacaagacttgtgacccacccccgaggtgtttatatggcttctatatcataaggtgtgcccccccccacaaaattgcgaagctcctcatagagccggcaacctaccttcccaaaccccccccccacatggatcctgcagtattcaatgattctacaaagggtctcaagcctccttacttcctctatggagccagtcaaagatacgccttatttctaaagggctaacgatcacctatactggctcccgagatgaggatctcaaatccgtttacttctactatcaaggagcgctcctgagggtcttctcaaagaacattcccgtgaacacatccacaccaatcctgcagagcagtggcggtaccggtaccgggctatgtcacccatgatatgctaatccaccggtctcccaagttgtcttgtcctacgcctgtacgtgtaacaaaaaaacactccttgcctttctctttagtcacagtata

SEQ ID NO: 50758 - DNA, 911 bp, Zea mays
  misc_feature: Ceres CLONE 1464237-F
  misc_feature (17)..(17): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (38)..(38): n is a, c, t, g, unknown, or other
tggctgggccccacccngntacagcannnnnccacacnacaaaatagctggaactccccgcggtggcggccgctcttcactagtggatcccccgggctgcagtttttcgcacgagaccattacctagaacatcctaatcgaaaaatcccttttcttccccaaatcacaggaaacatagccgagagcagactaccagatccatggtgcatgctcgaccgtgctatcttcttcccgtacagtgccagccaacaggccatcttccccagcaggctagtgctgcctgcccgtaacctaatggacggctgatgcttcattgtgcgctcatcttccccgagcagcgcccaccgaacatccgcatgcgcaacctcctatctcatcgaccggatggtgtgctcgtgtgtggccgtgatgtagaacccgaaagacagcatcgggatttgcccatgaaggaggggaggttgtgccccccccacaccccaacacgccaagggacaaccgcctcaactgcgcggccctctccctagcccccaagcacaacggctaggtgccgaaggtcgttattttcgttgtccgacggagactcccaatacggtgctggcaggggaagccgagctggggacgcgtggaaccggctatcttggtggctcggtcaaagactgggtcgtgcgggagtcgggaaaggcccttctttgccggtatgggtaccagtcaaccttggctaggtgatcagtctctcccctgagctacccgctgggagcgacgagggcacatggggcacatgtagacacgtgcagcaggatctgtagtcaatgaatgaggtcatctcgcagagcttggtagtacggggttgaacaaattactcgcggggcacctcggtacccgtgtgtgtatcattgctgcgatgtctgtga

SEQ ID NO: 50759 - DNA, 722 bp, Zea mays
  misc_feature: Ceres CLONE 1464239-F
  misc_feature: Encodes the peptide sequence at SEQ ID NO. 50760
cgcggtggcggccgctctagaactagtggatcccccgggctgcaggaattcgcacgagaccattacctagaacatcctaatcgaaaaactcccagtctcccaccgtcccacgaaacacactcaagactctgccgtctgccccgaagcggagaaccgccagccagacatgaagagaaccagagcgcagcagcccaaggtcgaggagccgcaggacctcgccgccaacctaaagccgcagcgccgggacaaacagccgaggcagcccaaggcgggcgccaaagcgaagcccgccgcgggcccgcgcgtcgcggcggccacgaccctcgccgccgccgccgcagcaacagcagcaaatgtggtttctgccgcgtcgtcgcccgggccggaaacggctccgacccccttcttctgcgcgtcggcggggacaaggacgaggacgcggacgcgagcgccgtggactgggacctcgacgccgggctgagcgcggcggcgtggtggacgtggggcgtggacgaggagaagctgctcggctggttccccttcgtggaggaggacttccggtgcgccggcgccggcggcggcgccgtagtggccgccttcgaccacgacatttggagcatctggtgaacgaacctttgagagacagacaacccgagcggtggcgatgcttcttttggctggtcttgctctgccctgccccatgggttggtggttattgcttg

SEQ ID NO: 50760 - protein, 208 aa, Zea mays
  misc_feature: Ceres CLONE 1464239-F
RGGGRSRTSGSPGLQEFARDHYLEHPNRKTPSLPPSHETHSRLCRLPRSGEPPARHEENQSAAAQGRGAAGPRRQPKAAAPGQTAEAAQGGRQSEARRGPARRGGHDPRRRRRSNSSKCGFCRVVARAGNGSDPLLLRVGGDKDEDADASAVDWDLDAGLSAAAWWTWGVDEEKLLGWFPFVEEDFRCAGAGGGAVVAAFDHDIWSIW

SEQ ID NO: 50761 - DNA, 695 bp, Zea mays
  misc_feature: Ceres CLONE 1464240-F
aaagctggagctccccgcggtggcggccgctctagaactagtggatcccccgggctgcaggaattcgcacgagaccattacctagaacatcctaatcgaaaaattacaatgagttgccactagatatacgcgaagcctctcccacctcatctgcctcgcgtgcggcggcggcgactccacctggcttgcgtcctcccgttttccagccagcaagccagactcctcccctctccgaagactccgatcgtccggattcatccagatccgggcgttctgagtcctgccgaggctctagatcgcgtcgcgcacgatgccacgcgacctgtcgcggtcgcggtctccgccgcgccgacgttggcggtcgccgtctcccgcgcggtaccgcggccggagggggcgcagggaccgaagccccagtcccatccgtagcaggtccccctatcgctcctcgtatagaaggaggagccctttgccttccccaagaaggcacaagagccgttctccgtctcctaggaggcgcaagagtccgtctccatcacaaaagcgttacagaagaaagagaagtccgagtgtcactagctctccagtcgctgcatctcagagttcccaccttgggttggcagagaataagaatgttattgatacacaaaggctagaagaagaaaagaaaaggcgccaaaaggaagttgaactga

SEQ ID NO: 50762 - DNA, 715 bp, Zea mays
  misc_feature: Ceres CLONE 1464245-F
  misc_feature: Encodes the peptide sequence at SEQ ID NO. 50763
  misc_feature (495)..(495): n is a, c, t, g, unknown, or other
  misc_feature (496)..(496): n is a, c, t, g, unknown, or other
  misc_feature (545)..(545): n is a, c, t, g, unknown, or other
ctccccgcggtggcggccgctctagaactagtggatcccccgggctgcaggaattcgcacgagaccattacctagaacatcctaatcgaaaaagagaaacacctctgagcattctaaagctcatagccctctccttccagagcatttcacatcgctctcatctccacctgcttgcatccagcgcctcgtcactctgcaaaacaacagcacatacctccaaaggatgagccgcagcaacaggaagagctctaggggccttgacctgaaactgaacctctcacttcctgcaacaggggactcctccaggagggcgatggctgatgaggagtcatccccgagctcctgcctatcgtcagagaacgagcatggcctgcagtggtccaacagccctgaggccacatccatggttcttgctgcctgtcctcgctgcttcatctacgtcatgctcccacaagatgaccctcggtgcccccagtgcaagagccctggtctccnntgacttctgcagggacacacaacagtaaagaccacagtaataatagcancaggaggagcaggaggggatgaagcaatatggttccatagccgcacgacatcagaaaaaaagttatttgaagtcctagggccaggaagtctattttgccaagccatttcttcaggggaacgggggaaatacccctccaaaaatgggaaaactacgccccctatctttagt

SEQ ID NO: 50763 - protein, 90 aa, Zea mays
  misc_feature: Ceres CLONE 1464245-F
MSRSNRKSSRGLDLKLNLSLPATGDSSRRAMADEESSPSSCLSSENEHGLQWSNSPEATSMVLAACPRCFIYVMLPQDDPRCPQCKSPGL

SEQ ID NO: 50764 - DNA, 718 bp, Zea mays
  misc_feature: Ceres CLONE 1464249-F
  misc_feature: Encodes the peptide sequence at SEQ ID NO. 50765
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaaaaaccagtcctgactccctgaggtttgacggaggttgggttggatgggtggcccttcctctccccgtcgggagaacgacggccaggggagtggcgggagatctccggctccggctacatggaacgagcgcccgaggtccttccacgacaagaccattacggcgtgttggcgtaaggcaccggtgctgtcgggacggcacccggaacgctggcggcaggacgccgtgggcaacgtggtctgccgccgtttctggggctgccacggatgcctctgctacgagtacgaccacatcggccctttctccaaaggaggagaatccactgttgagaactgccagatcctccagactagggtgaaccgttccaaatctgataaagcatgggtagcgcaagcacagatgcacggtttttcctgcgatattatgtttactgataatgagctagatataattgagatggctgtgtacggagacgtcattcgtccagagaagctatgtcgctgcacaacagtactcgaggtgctcgggcaggtgaagccaacgaatcgcatggctgcatcgcagttgattccattcaacagaggaacttgagttctttctcacaagtcataatcttg

SEQ ID NO: 50765 - protein, 181 aa, Zea mays
  misc_feature: Ceres CLONE 1464249-F
  misc_feature (70)..(112): Pfam Name: HNH Pfam Description: HNH endonuclease
MGGPSSPRRENDGQGSGGRSPAPATWNERPRSFHDKTITACWRKAPVLSGRHPERWRQDAVGNVVCRRFWGCHGCLCYEYDHIGPFSKGGESTVENCQILQTRVNRSKSDKAWVAQAQMHGFSCDIMFTDNELDIIEMAVYGDVIRPEKLCRCTTVLEVLGQVKPTNRMAASQLIPFNRGT

SEQ ID NO: 50766 - DNA, 720 bp, Zea mays
  misc_feature: Ceres CLONE 1464253-F
  misc_feature: Encodes the peptide sequence at SEQ ID NO. 50767
aaagctggagctccccgcggtggcggccgctctagaactagtggatcccccgggctgcaggaattcgcacgagaccattacctagaacatcctaatcgaaaaagtttcgactttcgattcccctcgccctcgccgacggccagacgccgaacgtctcgccctctcccgacgctccccgcctcccccttgatccgccgagcgcggcggccgccgccgccgccgaacccgatctccccccctcccgcgtgacaggcacggcctcccctcggttggaagggtttgctgtatcatgcattttttgtggataatcttcattttctcttgagtcaccgattcttttgttgtcttcaaaatgtcgggcttgctgaactcaaaccttaatagttcggcatcaaatctttcagactcagctggaaggccatttacagcatccttttcgggtcaatctggatcaattccaggttttcatcattctggcttgcataacactcatggaagttacaatcttccgagtatgcctggatcacttgcacaaaggaatgctgccatgagtggccttccgtcctctggggttcaacaacctggaggtagcattcctgggagattcccttcaaacaaccttccagttggcatgcctcagtatcgataccgtcgacctcgagggggggcccggtacccaattcgccctatagtgagtcgtattacgcgcgctcactggcc

SEQ ID NO: 50767 - protein, 122 aa, Zea mays
  misc_feature: Ceres CLONE 1464253-F
MSGLLNSNLNSSASNLSDSAGRPFTASFSGQSGSIPGFHHSGLHNTHGSYNLPSMPGSLAQRNAAMSGLPSSGVQQPGGSIPGRFPSNNLPVGMPQYRYRRPRGGARYPIRPIVSRITRAHW

SEQ ID NO: 50768 - DNA, 758 bp, Zea mays
  misc_feature: Ceres CLONE 1464254-F
  misc_feature: Encodes the peptide sequence at SEQ ID NO. 50769
  misc_feature (471)..(471): n is a, c, t, g, unknown, or other
aagctggagctccccgcggtggcggccgctctataactagtggatcccccgggctgcaggaattcgcacgagaccattacctagaacatcctaatcgaaaacttttccggttctaccgtcccatctggattcctcttctgctccccttcgcctcccttcccttcctcgacttcacctcaccaccatctccagctccatccgcacgcagccatccaccaaccgacgcagcgaggagatgaacgcgtcgcagttcatggacaagcagatcctcggcctggctgcctccgcttccccctccggcggcggcgcggggggcggtgggggtgtggatctcagcgatctgatgataccgatcccccaggaggacggcgagaaccgcctcggtcgccggcgtagcagcaccaacgtcaaacgaaccgcagacgacatgctaccccagttatgacttccacccaatcggcactagttgcnggcgccacggccgcgcccgccgccgcgcctcaggcttgggggggtcgctcgacttccagggaccctttggcttaaaaaaaccccaaagggctggaaaatttggaacccctggggcgtaaaaaatttagcctggagaaaaaaaaagaaaatttttcaccaacttctttttgggggatttgtgcccaccccggaaaaaaaacccggtaaaaccctttttggcgcgcccgagggggggagaaccccccgcggcttttccaggagggggggggaaaacaccccccccttat

SEQ ID NO: 50769 - protein, 69 aa, Zea mays
  misc_feature: Ceres CLONE 1464254-F
MNASQFMDKQILGLAASASPSGGGAGGGGGVDLSDLMIPIPQEDGENRLGRRRSSTNVKRTADDMLPQL

SEQ ID NO: 50770 - DNA, 835 bp, Zea mays
  misc_feature: Ceres CLONE 1464257-F
  misc_feature: Encodes the peptide sequence at SEQ ID NO. 50771
  misc_feature (16)..(16): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
atatatttaaaaaaanaaacaacacccccccccccnnnttcatactggagctccccgcggtggcggccgctctactactagtggatcccccgggctgcaggaattcgcacgagaccattacctacaacatcctaatcgaaaaaaggaaggttccagcgaccgcggtcgtggagtatgactgtaggagaaagcgcgatggggaagaagcggcagcttatctgcctcgcagccgccgtcgccgccgcggccatcctcctgacagcgtcggccaagaagtccagcgacgtcaccgagcttcagatcggcgtcaagtacaaacctgagtcatgtatcctgcaagcacacaaaggagacaaaattaaggttcattatcgtggggcactcactgacggatcagtttttgattctagctatgacagaggtgacccgtttgaatttactcttggaaatggccaagtgatacccccctcccaccaaggattgctaggtatgtgcgtcggtgacaagccgaagctaaagatacctgcaaagatgggctatggcgagcgaggctcctcaccgaagattccaggcggagcgactctggtcttcgacacggagcttatcgccgtcaacgggaagacatctggcggtggcgaatccagaaactgaaagtgagctatgatacgatgcattggtatggagagtttccagctccaggggagtagtagcatgagtccacgtaagttctgttttggtgcccgtgaaaaggggcttgttggtattcgtcttccttccaagccatgggcaaatcttatgttttctataaagatgctcatcaactccgtgggagatg

SEQ ID NO: 50771 - protein, 151 aa, Zea mays
  misc_feature: Ceres CLONE 1464257-F
  misc_feature (43)..(137): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGKKRQLICLAAAVAAAAILLTASAKKSSDVTELQIGVKYKPESCILQAHKGDKIKVHYRGALTDGSVFDSSYDRGDPFEFTLGNGQVIPPSHQGLLGMCVGDKPKLKIPAKMGYGERGSSPKIPGGATLVFDTELIAVNGKTSGGGESRN

SEQ ID NO: 50772 - DNA, 718 bp, Zea mays
  misc_feature: Ceres CLONE 1464261-F
  misc_feature: Encodes the peptide sequence at SEQ ID NO. 50773
aaagctggagctccccgcggtggcggccgctctagaactagtggatcccccgggctgcaggaattcgcacgagaccattacctagaacatcctaatcgaaaactcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgagtccaccgtctcgcccacgacgtcgtcatcttctccagtcatactgcccgtactgcaaaagagcaaaggcgtgtttaagagcttgagttgagaaagagcatatgttgtgagcttgatcagcgagagatggctcaaagatcaggatgccttactggaaatagtggcaggcgtactgcccctaggtttttgtcatggaaaacacctggtgggttttaaaaatctgttacccctacaaaggggaaatggttaaacttaaaaccccgaaacagggaaaccctttggggaagtgaaaatcggacccctttcttttggtttaaacaccaccgggttacaaaacccaaaagggtttttcccccccggggaacccccccccccccccaaagtgtttttttttccgagagaaacccccaccccttttttttttttatcaaaagagtttttttt

SEQ ID NO: 50773 - protein, 63 aa, Zea mays
  misc_feature: Ceres CLONE 1464261-F
MVALLGRRIGVAAAAAAFIALVAFGSASSSPKSFVSPPSRPRRRHLLQSYCPYCKRAKACLRA

SEQ ID NO: 50774 - DNA, 741 bp, Zea mays
  misc_feature: Ceres CLONE 1464263-F
  misc_feature: Encodes the peptide sequence at SEQ ID NO. 50775
  misc_feature (1)..(1): n is a, c, t, g, unknown, or other
  misc_feature (336)..(336): n is a, c, t, g, unknown, or other
  misc_feature (349)..(349): n is a, c, t, g, unknown, or other
  misc_feature (354)..(354): n is a, c, t, g, unknown, or other
  misc_feature (366)..(366): n is a, c, t, g, unknown, or other
  misc_feature (386)..(386): n is a, c, t, g, unknown, or other
  misc_feature (422)..(422): n is a, c, t, g, unknown, or other
  misc_feature (423)..(423): n is a, c, t, g, unknown, or other
naaagctggagctccccgcggtggcggccgctctagaactagtggatcccccgggctgcaggaattcgcacgagaccattacctagaacatcctaatcgaaaaagtagcatccatttgattgttctatcctcttctctgttctcacccccttgcaagcaacaatcgttcaccgatcgatccagtgcgtcctgcatggaaactgccgccgtcgccgcctccagtgccgggcgccgcatcatggtggccgtggacgagggcgaggagagcctgcacgcgctcaactggtgcctcgccaacgtcgtctcctcggcaggaggcgacacgctggtgctcgntcacgcccgccgncctgngcctggtctacngcgccatggacagcgcaggntacatgatgaccttcgacgtgcttgcaagcgttgannagcacgccaacgcggttcttcgcggcggcggtcgacagggcaaagcggtttggcccgaacacccgaactttaaggtgaaaacaaccggggaaagggggaccccgggggaatttttttggaaccaacccaaaaaagtggcccggaaacctgtctccttgggggcccccttggtttccctttttcccccaagggggttttttggcgaggttccaaaaaccctggccccaaaaaattaaaaacccccggccttttttttaaaaagccccaaaaaaaaaaagtcctccccaaagaagccccctctttacaaaaaaggttttc

SEQ ID NO: 50775 - protein, 75 aa, Zea mays
  misc_feature: Ceres CLONE 1464263-F
  misc_feature (48)..(48): Xaa is any aa, unknown, or other
  misc_feature (54)..(54): Xaa is any aa, unknown, or other
  misc_feature (58)..(58): Xaa is any aa, unknown, or other
  misc_feature (65)..(65): Xaa is any aa, unknown, or other
METAAVAASSAGRRIMVAVDEGEESLHALNWCLANVVSSAGGDTLVLXHARRPXPGLXRHGQRRXHDDLRRACKR

SEQ ID NO: 50776 - DNA, 726 bp, Zea mays
  misc_feature: Ceres CLONE 1464270-F
  misc_feature: Encodes the peptide sequence at SEQ ID NO. 50777
caaagctggagctccccgcggtggcggccgctctagaactagtggatcccccgggctgcaggaattcgcacgagaccattacctagaacatcctaatcgaaaaagagctgttcagggaacacaacacactggggaacggagagggacaccggcgccatcgcaagtacgcactcggattggggagcgacagaggaggcgcatccctgttgcctcgccagctccgtgactctctctctctctctctctctcctctcccggtgcaagcaagcaagcaagctaggcttggacaacgacgacgacgatggcgtgcgggtctcgaagccggaccaacgagatggttgacgagtacgagaagctggttctcagaatgaaccctccaagggtcaccgtggacaacgactccgacatgactgccaccttgctcaaggtggacagcgccaacaagtacgggaccttgctggaggtggttcaggtgctgaccgatctgaagcttaccatcaagcgggcctacatttcctccgacggcgagtggttcatggacgtgttccatgtcgtggatcaggatgggaataaactttatgattgccaagtcatcgacagaattgaacagtctctgggagcgggatcgctcagcttccgcgggccgccggagcgggcggtggccgtggaggcggaggcggaggaggcgcaaaccaccatcgagctggtggggcgggaccggccggg

SEQ ID NO: 50777 - protein, 141 aa, Zea mays
  misc_feature: Ceres CLONE 1464270-F
  misc_feature (39)..(106): Pfam Name: ACT Pfam Description: ACT domain
  misc_feature: SWISSPROT Homolog: EC 2.7.7.59 [Protein-PII] uridylyltransferase
MACGSRSRTNEMVDEYEKLVLRMNPPRVTVDNDSDMTATLLKVDSANKYGTLLEVVQVLTDLKLTIKRAYISSDGEWFMDVFHVVDQDGNKLYDCQVIDRIEQSLGAGSLSFRGPPERAVAVEAEAEEAQTTIELVGRDRP

SEQ ID NO: 50778 - DNA, 757 bp, Zea mays
  misc_feature: Ceres CLONE 1464277-F
  misc_feature: Encodes the peptide sequence at SEQ ID NO. 50779
ggagctccccgcggtggcggccgctctagaactagtggatcccccgggctgcaggaattcgcacgagaccattacctagaacatcctaatcgaaaaatcacaggcaacaaggcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagctgcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccgccattatcgatccatggtcgctcctggggttcatgttcatctgtaacgtgctcgcggtcatgtccgtctcgtgccggatttaatatttatatgcatgtatttgtggttttttctggcgtattacatgtgccggtttcttgcgtgtcttctctgcgcgcgtctgtctgatgcatggatccatatcaaaaaaaaaaaaaaaaagcttatcgataccgtcgacctcgagggggggccgg

SEQ ID NO: 50779 - protein, 80 aa, Zea mays
  misc_feature: Ceres CLONE 1464277-F
  misc_feature (1)..(79): Pfam Name: Metallothio_2 Pfam Description: Metallothionein
MSCSSGKCDCGSSCSCGSSCNCMSPNVETAAASCIKTTVLAAPTTKASAGGFEAATEGGGCDCNTCNCGTSCGCSCCSCN

SEQ ID NO: 50780 - DNA, 761 bp, Zea mays
  misc_feature: Ceres CLONE 1464279-F
  misc_feature: Encodes the peptide sequence at SEQ ID NO. 50781
  misc_feature (372)..(372): n is a, c, t, g, unknown, or other
  misc_feature (373)..(373): n is a, c, t, g, unknown, or other
  misc_feature (387)..(387): n is a, c, t, g, unknown, or other
  misc_feature (761)..(761): n is a, c, t, g, unknown, or other
acccgcggtggcggccgctctattttagtggatcccccgggctgcaggaattctcacgagaccattacctacaacatcctaatcgaaaaaggagcaggagaggggagagaaaacctcgccgtcaatgtcagcgttcgttcccaagggcgctagggtttaaccccccaactgttcggtctctctctctccccgaatccaattcagcgtcatctagtccgggagcctgcgacatggggtacctccaggaggcccgggagaatcacgtcaagaagaaggtcgaggaagctctgaggagcaaaatgaaacaaaaggctcttcaggaatgtgatttctattgttcaaaatatgctgagtgtgcacgaggaagaacannttctgtggtatggnaatgccacaaacaagcaaaacaccccaatgagtgccttcatcaatacacaaatgatgcaatcctgcaacaaatgaagaaggcttatatgattgagcaaaagagcaaggagataaatcaataagcaaaaatccattgcacaatgtgcatcacgatcaccctgctggtatgtatactgttgcctttgatagatactattcatgggtagtgttgcaaacattgttctccccacatgcttaacctgatactagtattgggtgggcaaactggcaatctttgctggtttctgtcaaaatggggaaaaaagtgtgttttccttccggtggaaattttcctacccccataagattttggtttggattgagaattaaaacan

SEQ ID NO: 50781 - protein, 92 aa, Zea mays
  misc_feature: Ceres CLONE 1464279-F
  misc_feature (48)..(48): Xaa is any aa, unknown, or other
  misc_feature (53)..(53): Xaa is any aa, unknown, or other
MGYLQEARENHVKKKVEEALRSKMKQKALQECDFYCSKYAECARGRTXSVVWXCHKQAKHPNECLHQYTNDAILQQMKKAYMIEQKSKEINQ

SEQ ID NO: 50782 - DNA, 783 bp, Zea mays
  misc_feature: Ceres CLONE 1464290-F
  misc_feature: Encodes the peptide sequence at SEQ ID NO. 50783
  misc_feature (405)..(405): n is a, c, t, g, unknown, or other
  misc_feature (434)..(434): n is a, c, t, g, unknown, or other
  misc_feature (459)..(459): n is a, c, t, g, unknown, or other
  misc_feature (470)..(470): n is a, c, t, g, unknown, or other
  misc_feature (497)..(497): n is a, c, t, g, unknown, or other
ctccccgcggtggcggccgctctagaactagtggatcccccgggctgcaggaattcgcacgagaccattacctagaacatcctaatcgaaaacttcccgtgctcgacccagatcgagggctcgatccgtcggccatggcgctggagtgggtggtgctgggctacgcggcgggcgcggaggcgatcatgctgctgctgctgacgctgccggggctcgacggcctgcgccggggcatgatctccgtggtgcggagcgcgctgaaacccatgatgtcggtggtgcccttctgcctcttcctgctcatggacatctactggaagtacgagacgcgccccacctgcgacgacgagcacgcctgcatcccctccgagcacctccgccaccagaagtccatcatgaagtccncaccgaacgcgctcctcatcggccgccgngctggtcctctactggatcctcttnctcgtcacccngttcgtcgtcaggctcaagcaaaagcngcaccccggcaacaagctccgggaaccccgcccactgatggttcccctccctccggggggggccggtcctcctttgcccggccggacttccgggtttatttgggggggccggaggttttaaacccccgaacccaatttgagaccccggggggaactttttctctaaaaaaaaaaaaaaaaagtttttcggccccgccccccccggggggggggcgcggggcccatttccccccataaagggagaaaattaccgccgcccacgcgggcccccttttataacccgggc

SEQ ID NO: 50783 - protein, 199 aa, Zea mays
  misc_feature: Ceres CLONE 1464290-F
  misc_feature (91)..(91): Xaa is any aa, unknown, or other
  misc_feature (109)..(109): Xaa is any aa, unknown, or other
MALEWVVLGYAAGAEAIMLLLLTLPGLDGLRRGMISVVRSALKPMMSVVPFCLFLLMDIYWKYETRPTCDDEHACIPSEHLRHQKSIMKSXPNALLIGRRAGPLLDPLXRHPVRRQAQAKAAPRQQAPGTPPTDGSPPSGGGRSSFARPDFRVYLGGPEVLNPRTQFETPGGTFSLKKKKKSFSAPPPPGGGRGAHFPP

SEQ ID NO: 50784 - DNA, 748 bp, Zea mays
  misc_feature: Ceres CLONE 1464292-F
  misc_feature: Encodes the peptide sequence at SEQ ID NO. 50785
ctccccgcggtggcggccgctctagaactagtggatcccccgggctgcaggaattcactgctgtttagtaacaagaattcgcacgagaccattacctagaacatcctaatcgaaaagtcgatcaatactactacacagtaggaagctaggaggaaatcaaagcaacaaagttgccggccgagagaaccaaaccatgaggcctcaggtgttactcgtcacactggctgttatcgtcgtccttgcagctctgccactcagcaaagggacggaggaggaagacggaggggcggtagtcgccgccgtggacgacgccggaacgagctcgtggccatgctgcgacaagtgcggtttctgctacctgtcttacccgccgcagtgccaatgcctggacttctcgacggtcgggtgccacccagagtgcaagcagtgcatcaggtacaccgccgacgatggcgtcgacatcccgcccgtgcacgcctaccgctgcgccgacatcctcgtcaacttctgcgagcgccgctgcactcccgccgcagctgcttcgatgtctagcgctagcaccaagtagaagaaggatgcatgcatcctcgtcgatgccattgccgggttccgcttctgagaagaacaaataaatgttgccgctgttgatgcgtgcctctccttaaataaactaatatttctgtaatatttattgtaaaaaaaaaaaaaaaagcttatcgataccgtcgacctcgagggggggcccggc

SEQ ID NO: 50785 - protein, 124 aa, Zea mays; identical to SEQ ID NO: 48073
  misc_feature: Ceres CLONE 1464292-F

SEQ ID NO: 50786 - DNA, 703 bp, Zea mays
  misc_feature: Ceres CLONE 1464295-F
  misc_feature: Encodes the peptide sequence at SEQ ID NO. 50787
tacccgcggtggcggccgctctagaactagtggatcccccgggctgcaggaattcgcacgagaccattacctagaacatcctaatcgaaaaagggaactgaggaaacgtctcgaatggtcgaacagtagtttgctcgctattatccatggcgacttctacggctgctgccactgcactgctccgccccaggccggcagttccagccaagaggaggtgcctccatgcggttgctgggtggacgacgatgaggaggaggggagctgcaggggtcgtgcgagctttcttcaaccctctcggggatgagcgcatcctccgagaagccatcaaggagccagtagcattcatgggtggtgtgtttgctggcctcttgaggcttgacctgaatgaggatcctctcaaggaatggataagtcggacagtggaggcttctggaatagctgaggaaaacagctctgaagaatcaagtgaggcagatcaaaatgatgcacctcagcaaattgagattgagtgaggtgcattgtctacttttgtccacttgtcacttttcccttgtaacttatcctgaatataaaaaaaaaaaaaaaaagcttatcgataccgtcgacctcgagggggggcccggtacccaattcgccctatagtgagtcgtattacgcgcgctcactgggcgtcgttttacaacgtcgtgactgggaaaaccct

SEQ ID NO: 50787 - protein, 121 aa, Zea mays
  misc_feature: Ceres CLONE 1464295-F
MATSTAAATALLRPRPAVPAKRRCLHAVAGWTTMRRRGAAGVVRAFFNPLGDERILREAIKEPVAFMGGVFAGLLRLDLNEDPLKEWISRTVEASGIAEENSSEESSEADQNDAPQQIEIE

SEQ ID NO: 50788 - DNA, 823 bp, Zea mays
  misc_feature: Ceres CLONE 1464298-F
  misc_feature: Pfam Name: RNA_pol_Rpb2_6 Pfam Description: RNA polymerase Rpb2, domain 6
  misc_feature: SWISSPROT Homolog: EC 2.7.7.6 DNA-directed RNA polymerase
  misc_feature (402)..(402): n is a, c, t, g, unknown, or other
  misc_feature (410)..(410): n is a, c, t, g, unknown, or other
cgctctagaactagtggatcccccgggctgcaggaattcgcacgagaccattacctagaacatcctaatcgaaaaaatattgctttcaacatatgatcaacggaacaattttgctgtggttactctaatacacgttcggacactttgccttggagataagtcttccagcatgcatggccaaaaacgcgttgttggttttctagaatctcaagagaacttcccatttactcacgaaggtatagtcccagatattgtgataaatccagatgccttcccaacacgtcacactcccggactgctgcttgaatctgctctgcggaaggtaatagtttggagaggtataaccacacatgcatctccttctcaggacatgtttaggttgacaaccacccccgtttttcnaacaaaangtttagtttgttcttgtattgtcaccctaaaacccccctaaattgggcgaaatggtttgaaagagtggcagtccttggtgttttgatggggtgcttaccttttttgcattaggcttgattcaatatcgccacaaacataaacgtccaattttcatatcgacgtggtggcgcggtgtttccgctcctaagaaagccaacctttgttggctaaatccgataaaagattctggtggaattctatatttttgaagaaatggaggaaggtgtagggtttctcctccgcctggggggtggaagcgtgcataccttgacatgagacaccacgctttcctccgcattatgaggagattcacccccgaaatggacactttataagagaaatatactcaacctgcgttccttcataatatgca

SEQ ID NO: 50789 - DNA, 742 bp, Zea mays
  misc_feature: Ceres CLONE 1464320-F
  misc_feature: Encodes the peptide sequence at SEQ ID NO. 50790
ggagctccccgcggtggcggccgctctagaactagtggatcccccgggctgcaggaattcgcacgagaccattacctagaacatcctaatcgaaaaacctcctcaacctccagcccaacctccagcccggaatcgagagcaatggcgctcgccaaggccaaggagatcgttgcctccgctcccctcgtcgtcttcagcaaaacttcctgccctttctgcgtccgtgtgaagcagttgttcgagaagctcggagcaagctacaaggccattgagttggataaggaaagtgatggagctgagctccagaatgccctgaaggagtggactggacagaggactgtcccaaatgtcttcatcaatggggagaatattggcggctgtgatgatactatggcattggaaaatcccccctaagctggggcctctgctgactgaggctggagccatcgccgggttctgcctcgaagacaaccctccccgggctgagagggggggttaccatttcccggggtttaaaaaaaatgaaggctttccaagggcgtaaatttcccaaatgccatgggggaaggggactgtccccttccccggggttaaaacccccctaaaaacctacatacaaaacccgggtttcccgtgggggggtttgtgaaaaattctcaaaaaaatcctctgcgccacaacaaaaagggggcggggtcccctcaaacccttttgagggggcaaaagtgtttagacaaaacaa

SEQ ID NO: 50790 - protein, 90 aa, Zea mays
  misc_feature: Ceres CLONE 1464320-F
  misc_feature (15)..(77): Pfam Name: Glutaredoxin Pfam Description: Glutaredoxin
  misc_feature: SWISSPROT Homolog: EC 1.11.1.15 Peroxiredoxin
MALAKAKEIVASAPLVVFSKTSCPFCVRVKQLFEKLGASYKAIELDKESDGAELQNALKEWTGQRTVPNVFINGENIGGCDDTMALENPP

SEQ ID NO: 50791 - DNA, 699 bp, Zea mays
  misc_feature: Ceres CLONE 1464322-F
  misc_feature (455)..(455): n is a, c, t, g, unknown, or other
  misc_feature (459)..(459): n is a, c, t, g, unknown, or other
  misc_feature (460)..(460): n is a, c, t, g, unknown, or other
ggagctccccgcggtggcggccgctctagaactagtggatcccccgggctgcaggaattcgcacgagaccattacctagaacatcctaatcgaaaaaaaagctagagacaaccgctgcgtaaacgaatccatcgccatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtgggtacaagctttttagtggaaagaggaagccagactgaggcggcatcaccacaggcataggtggcggagatgggagtatacccgtatctgtggcctggncacnnatgtaataaaaggaaaatgcttatgtgtgctttcaagtgaaaaattggggcacaggagattttgcttacctagggcaaaatttgaaaacctcccttacccctccccaggaaaaacctttgcggcagggaattttgtgcggaaaaaaaggaaagttttacttctttccggcaatagaaaataaaatttttctttgtggcccccaacaattaaacccgtctcttcaaaataaaaaaccccc

SEQ ID NO: 50792 - DNA, 815 bp, Zea mays
  misc_feature: Ceres CLONE 1464327-F
  misc_feature: Translation starting site: 190
  misc_feature (362)..(362): n is a, c, t, g, unknown, or other
  misc_feature (363)..(363): n is a, c, t, g, unknown, or other
  misc_feature (377)..(377): n is a, c, t, g, unknown, or other
ctggagctcaccgcggtggcggccgctctataactagtggatcccccgggctgcaggaattcgcacgagaccattacctagaacatcctaatcgaaaaaccgatcacaaaaccaatcgcggagattcaatcacgtacgtatacacacggccacacgggcacgtagctagctagcagtcgtagcgtgacgatgagggttctctctgttgcggtcgctctggtcgtggtggtggccgcggcctgcctcgccgcgccgcggggcgcggacggcgcgggcgagtgcggtgcgacgccgccggacacggtggcgctgaggctggcgccgtgcgcgtcggcggcggaggaccccggctccgcgccgtnngggtcctgctgcancgcggtgcacgccatcgggaagcagagccccacccgcctcctgcgccgtcatgctgtccaacaccgccaggagcgcccgggatcaaggcccgaaggtcggcatcaccatccccaaacgttgcaaactcggcgaaccgccccgttggctacaaggggcggagatttaaccttccggcccatgaacggggggtggaaggtctcccaggccggattttgtgcctggcatggcccaaaaattccccaaaagcgagagttcttggggtcaaagagaaacccggtttgtcaaaacatctctctaagggggtgccccaaaaaaaaaaaaaaacgggggaaataccagaaattggacaccttcagaaaaacgggggggggggttaccaaagggaccccgcacctccatatagtggtggtctcctcccggggcttataaagaagacg

SEQ ID NO: 50793 - DNA, 733 bp, Zea mays
  misc_feature: Ceres CLONE 1464331-F
  misc_feature: Encodes the peptide sequence at SEQ ID NO. 50794
  misc_feature (398)..(398): n is a, c, t, g, unknown, or other
  misc_feature (483)..(483): n is a, c, t, g, unknown, or other
  misc_feature (484)..(484): n is a, c, t, g, unknown, or other
ctggagctccccgcggtggcggccgctctagaactagtggatcccccgggctgcaggaattcgcacgagaccattacctagaacatcctaatcgaaaagaggtagcagctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggntgaggaaacaccaagggtcaagcctaagaagcctacttctggggaagcccctttgggccgtgggcgtggccgtggtccttggccnncgtcggggtcggggactttgagcatgctacctgctttggaaaattgcattgcctgcattcggcagggaatctaacttccaatcaattggacaaagaatgcttttgattttgcacccaggattcattggtttttttttcccggggatttttttggagggggcccccggggaacaaaaaaaaaaaaaaaaaatttttctttaccctcccccccccgggggggggcgcgggaccccaattcctcctaagagg

SEQ ID NO: 50794 - protein, 133 aa, Zea mays
  misc_feature: Ceres CLONE 1464331-F
  misc_feature (5)..(70): Pfam Name: LSM Pfam Description: LSM domain
  misc_feature (81)..(81): Xaa is any aa, unknown, or other
  misc_feature (110)..(110): Xaa is any aa, unknown, or other
MKLVRFLMKLNNETVTIELKNGTVVHGTITGVDISMNTHLKTVKLTLKGKNPVTLDHLSVRGNNIRYYILPDSLNLETLLXEETPRVKPKKPTSGEAPLGRGRGRGPWPXSGSGTLSMLPALENCIACIRQGI

SEQ ID NO: 50795 - DNA, 770 bp, Zea mays
  misc_feature: Ceres CLONE 1464332-F
  misc_feature: Encodes the peptide sequence at SEQ ID NO. 50796
  misc_feature (370)..(370): n is a, c, t, g, unknown, or other
tggagctccccgcggtggcggccgctcttgaactagtggatcccccgggctgcaggaattcgcacgagaccattacctagaacatcctaatcgaaaaactcttctcggatcgtgctaattctacttctacttcggaaccgccgccgctcccagagcctcggattatcaactaccgcaggaggacgcgctgtcaggatcggaggtccagcttgcgatggggatagctcctaccgtgcggtgttactgcccatcctcgccgtcatcttcttctttcctggtgatgtctcgtccggcatctgcctcgcccgcgcctcctctcgcacgtgacgactcgtggagagtcgcctacgatgcatctggaggtggaaanaccctacacgcctcaccgcgggggcctgtagatccggcccccccagcaggactaggggctatctgggaccgtgttctcccatatcgaggaccatgaggtgccgcacacagtctgagaagacaacgtggagcggtggatgccgaattctatctctaaaacctgccgccccttcgggaaggccccttcctgggtgccctttttcgcgggcgcccaagggcaaacccgtgaccggggtcgcatggaacccccggtcgccttaaaacctggcgcgtacgtgtccggccccggaagggaagccatggtgtgtgcgccaaaggccccgtaacgggatttatccctggggccaaacaaagggggtccctcgggaatggtgggccaggggcccctccccccgcccctt

SEQ ID NO: 50796 - protein, 62 aa, Zea mays
  misc_feature: Ceres CLONE 1464332-F
MPNSISKTCRPFGKAPSWVPFFAGAQGQTRDRGRMEPPVALKPGAYVSGPGREAMVCAPKAP

SEQ ID NO: 50797 - DNA, 791 bp, Zea mays
  misc_feature: Ceres CLONE 1464334-F
  misc_feature (387)..(387): n is a, c, t, g, unknown, or other
  misc_feature (395)..(395): n is a, c, t, g, unknown, or other
tggagctccccgcggtggcggccgctctagaactagtggatcccccgggctgcaggaattcgcacgagaccattacctagaacatcctaatcgaaaaagtttgcatcctgagctctctcctggaccagccgagatttctcgctctgcgcatctctgattcatcttcgtcgagaggagctgttcctcttctttgccgcctcgaatctgggactggtcggttttctggatccctgctgcctgtcgggttctcgagaggtgtaaaatccaatggagggtgtgtcatcgttgaaccagccgttgatcaacgacgaccggcagcccgtgcccagcagtatcgccaagggtgatcaaatccaaggcctgttgtcgggggatgggacaaatganccgcacanctcttacataaactcccacgcagcatcttttcgggaagcaactccgtaggggttccaagggcctccaggagggcttggtgccaagcatgagggttcccaagggaatgaggtcccaacccctgactttcccggaaaatccctggggggggggagaaggggttttaagggccccggtggccccccctggggtatgggaaggaaaggggacccctttgggcgaagggtgtatggtaaagggcccggaccccgcccccagaaaaaggcccccacacccccccaaaaaaaagaaagggtttcccctttttaatgagaacccccgccaaccaaattttttttcggggagggggattccttcccccgagcggggggtggagaaaaaaaaaaaaattcttcccc

SEQ ID NO: 50798 - DNA, 753 bp, Zea mays
  misc_feature: Ceres CLONE 1464335-F
  misc_feature: Encodes the peptide sequence at SEQ ID NO. 50799
ggagctccccgcggtggcggccgctctacaactagtggatcccccgggctgcaggaattcgcacgagaccattacctagaacatcctaatcaaaaaaccagtcctcacataatcatcttcattcactcactctcttcgatcactgtactgaagataccatggccaagtcgaccgcgatgtttgtagccgccctggccctggtggtggtgatggcgacgacgagcacaggcggtggcagggcggcagcggcgtgcgatcccaagccgctggtggtgtgcgatccggcgttcatggacggagcgaaacccgcggcagcatgctgctccaccctgcgtgcgcaggaggcatgcttgtgcgtgtacgccaaagacccccaagtttgcaaaataattcaacacccccaacaccgccaaaaacttttacctcgtggcggaatagccatcccccaagggtaaagaaggggttttggggccgccccttcccttggctctggccttgggggggaaacaatcccgccttagaaaaaaattttgtggggtccgttaaaaaaaaaaaaaaaaaagttttatccttcccctcacaccccgggggggggcccgggacccaattttcccataaaaggggggctaaatatcccccccccccctgggcgccttttttaaaaccgcggggaaggggagaaacctggggtcccaccatatttatctgttggggaaacacccccttttcccggggggggaaaataaagaaacc

SEQ ID NO: 50799 - protein, 98 aa, Zea mays
  misc_feature: Ceres CLONE 1464335-F
MAKSTAMFVAALALVVVMATTSTGGGRAAAACDPKPLVVCDPAFMDGAKPAAACCSTLRAQEACLCVYAKDPQVCKIIQHPQHRQKLLPRGGIAIPQG

SEQ ID NO: 50800 - DNA, 775 bp, Zea mays
  misc_feature: Ceres CLONE 1464337-F
  misc_feature: Translation starting site: 143
  misc_feature (388)..(388): n is a, c, t, g, unknown, or other
  misc_feature (478)..(478): n is a, c, t, g, unknown, or other
  misc_feature (634)..(634): n is a, c, t, g, unknown, or other
ggagctccccgcggtggcggccgctctagaactagtggatcccccgggctgcaggaattcgcacgagaccattacctagaacatcctaatcgaaaaaccaagatccaacagacacttcttcaatccactagctaagcgcgccatggcaaagttcgctcttggtcaccaccgcgaggcctccgacgccggctgcgtccgtgccgtcctcgccgagctcatcctcaccttcctcttcgtcttcgccggcgttggctccgccatggcaacagggaagctggccggcggcggcggggacacggtggtgggcctgacggcggtggcgctggcgcacacgctggtggtggccgtcatggtgtcagcggggctgcacgtctccgggcggcacatncacccggggcgtgacgctgggccctcgccgccacgggccgcatcacgctgttccgctccgcgctctacgtggccgcccagttgtctcggntcacagtttcgctgcctcctccttggttttcctccaatttgccgacgggggggggccccttcaacccttgggggcccgggttcggccccttccggggggggcttatgagggggggggtcccctttctccggggtctttggggggaaaacccccccnttttaaacccccccccccgcccttggggagaggggccccccctggtggggggcctgttttttctgccccaaaattttccccgggggggcctctttctcggggggttaaaaaaaccccgggggtctttttgggccccgggtg

SEQ ID NO: 50801 - DNA, 744 bp, Zea mays
  misc_feature: Ceres CLONE 1464340-F
  misc_feature: Encodes the peptide sequence at SEQ ID NO. 50802
ggagctccccgcggtggcggccgctctagaactagtggatcccccgggctgcaggaattcgcacgagaccattacctagaacatcctaatcgaaaaatcccaagaagagccgccctacctattccttcttcacgccgtcgagctgcccaacccagagcaccagcagccctcacctccttcctctcggacggtccttccaacgagcccgctggtcttggagccgccgccggtctcgttctggacgaacgttcaaggagattgcatttgtggatgctctaatggagtcgaaaggtggtaagaagtctagtagtagtagtagtaatttcatgtacgaagctccccttggctacgagatcgaggacgttcgcccagccggaggaatcaagaagttccagactgctgcttattccaactgcgtccgccagccatgctgatatcgcctcacatgcaattcgcggtagagtacgattttaaatacagtttccctctggagcgggagttctccgttgggatctggctgccatcctctgcttctgaaattcaaagttggcatggccatcttggctttggctcttacatcatttctttgaaggaaaaccgacttcctgggggcaaggcttccggaaaaatccggggggggttcccccaggcgcccccaattggttttgggaggccaaaaaaaaccccgcccaaaacacggtcgggggaaggggcggtgctttaaaaaacctttgtgggggggcg

SEQ ID NO: 50802 - protein, 51 aa, Zea mays
  misc_feature: Ceres CLONE 1464340-F
  misc_feature (1)..(51): Pfam Name: AdoMetDC_leader Pfam Description: S-adenosyl-l-methionine decarboxylase leader peptide
MESKGGKKSSSSSSNFMYEAPLGYEIEDVRPAGGIKKFQTAAYSNCVRQPC

SEQ ID NO: 50803 - DNA, 811 bp, Zea mays
  misc_feature: Ceres CLONE 1464343-F
  misc_feature: Encodes the peptide sequence at SEQ ID NO. 50804
  misc_feature (302)..(302): n is a, c, t, g, unknown, or other
ctggagctccccgcggtggcggccgctctataactagtggatcccccgggctgcaggaattcgcacgagaccattacctagaacatcctaatcgaaaaaacccgcagctcgctcccaccaaacccacacccgaacaatggcgtcggcgtccaaggaggaggtgatcgggaagctcaacgtccgcgtggtgcggggcaacaacctggtcatcgccgacccgctcacccacaccagcgacccctacgtcgtcctccagtacggcgctcagaaggtgaagactagtgtccagaagaagaactccnatccagtgtggaacgaagtactgcagctctcagtaacacatcctacgaagccagtgcaccttgaagtttttgaagaagacaagttccacagcagacgacagcatgggtggcccccaaatcaacattactggactctacaatgcttccaaactgggaccctgaaccccccctctgatggaaaaagattcaaaacaaatctccttggccgaaaaaaaataccttggcgggaaaaaaccctgttttatggaaaagatgggaaaggtggcccaaaatttttttttaaaacttaaaaaaagcccaaaaggccccttttttggggcacccggaaggggttcttttttcctcgggggaaaactttaaaagcccccttttaaaaagggggtgaaaagccccccttggggcgccccgttttttttttttttggaacaaaaaaacccccaccaccgctaaatacccgccaaaaaaaaagatggtgggggttctctttttgggacccccctcccagaaga

SEQ ID NO: 50804 - protein, 151 aa, Zea mays
  misc_feature: Ceres CLONE 1464343-F
  misc_feature (13)..(88): Pfam Name: C2 Pfam Description: C2 domain
  misc_feature: SWISSPROT Homolog: EC 3.1.4.4 Phospholipase D
  misc_feature (56)..(56): Xaa is any aa, unknown, or other
MASASKEEVIGKLNVRVVRGNNLVIADPLTHTSDPYVVLQYGAQKVKTSVQKKNSXPVWNEVLQLSVTHPTKPVHLEVFEEDKFHSRRQHGWPPNQHYWTLQCFQTGTLNPPSDGKRFKTNLLGRKKIPWREKTLFYGKDGKGGPKFFFKT

SEQ ID NO: 50805 - DNA, 767 bp, Zea mays
  misc_feature: Ceres CLONE 1464347-F
  misc_feature: Encodes the peptide sequence at SEQ ID NO. 50806
  misc_feature (456)..(456): n is a, c, t, g, unknown, or other
ggagctccccgcggtggcggccgctctagaactagtggatcccccgggctgcaggaattcgcacgagaccattacctagaacatcctaatcgaaaaatcagttggatcttatgactgatctacttggtacaccttcagcagagtctatctccaagataaggaatgagaaagctcgacgatacatgaacaatatgaggaaaaagcctcgggttccctttactaaaaagtttccagggatagatcctatggctctccatttgcttgaacgtcttcttgcttttgatcctaaggaacgaccaagtgctgctgaggccctggcagatccatactttaatggatttagcaaatatgaacgtgaacccatagcacaacctatctcaaaacttgattttgagtttgagaagcgaaaactgggcaaagatgatgtccgagaattgatttaccgagagatttggnagtaccatcctcaaatgctacaagaataccctacaggagagaccaccatcagatgaccttcatggttcaagtggggtggatcgcttccaggccccaattggccattttgaaaaaggtcttgcgaagggtgaaaaaaacagccaacgctggcacaaaatgttctttgccaagggaaaaatattgggaaaaacttggaaagggcaaaacgggataacctgcggttgcctctgggggaggggctcccccccccgttttggggaaaaatttttaaaaagaaaaaccatcgctccccggtggggggagaaaaacca

SEQ ID NO: 50806 - protein, 133 aa, Zea mays
  misc_feature: Ceres CLONE 1464347-F
  misc_feature: SWISSPROT Homolog: EC 2.7.11.24 Mitogen-activated protein kinase
  misc_feature (116)..(116): Xaa is any aa, unknown, or other
MTDLLGTPSAESISKIRNEKARRYMNNMRKKPRVPFTKKFPGIDPMALHLLERLLAFDPKERPSAAEALADPYFNGFSKYEREPIAQPISKLDFEFEKRKLGKDDVRELIYREIWXYHPQMLQEYPTGETTIR

SEQ ID NO: 50807 - DNA, 754 bp, Zea mays
  misc_feature: Ceres CLONE 1464353-F
  misc_feature: Encodes the peptide sequence at SEQ ID NO. 50808
  misc_feature (709)..(709): n is a, c, t, g, unknown, or other
ggagctccccgcggtggcggccgctctagaactagtggatcccccgggctgcaggaattcgcacgagaccattacctagaacatcctaatcgaaaactctcacctccccgaagcaagcgagcggggcagcgcgccaggaaggatcggaggagacgccatcaatcagcacttgcacgcgcgcggtcggccgcaggtggaggaagaagatgggcctgtgctcgtgctgctgccggtgcctggagctgctgtgctcggtcctcctcccgcccctcggcgtctgcctccgccacggctgctgctccatggagttctggatcagtgtgctgctcaccatcctcggctacctccccggcgtcctctacgccgtgtacgtcatctgctccgtcgacccccaccgccaccgcgacaacgacgactacgtctacgtagcatgacaagatggaccggtccccgtggtgctctggtccgtgtctctgctgctacctccgtcctctgtgctgtgtgcatctttttgtttggtttagtaaactaaatccatcctgtggccttctgtaaactgtaaattcgtatgtcgaatctgacaatctggacggattcattccataaactaagatctggtgttgcgggatctgtggagttagttagggttactttgctacctcgttcagttgtgcttgtgaaatgaaactgcagatggttattaaatccngaaaaaaaaaaaaaaaaagcttatcgataccgtcgacctcgaggg

SEQ ID NO: 50808 - protein, 75 aa, Zea mays
  misc_feature: Ceres CLONE 1464353-F
  misc_feature (8)..(59): Pfam Name: UPF0057 Pfam Description: Uncharacterized protein family UPF0057
MGLCSCCCRCLELLCSVLLPPLGVCLRHGCCSMEFWISVLLTILGYLPGVLYAVYVICSVDPHRHRDNDDYVYVA

SEQ ID NO: 50809 - DNA, 750 bp, Zea mays
  misc_feature: Ceres CLONE 1464354-F
  misc_feature: Encodes the peptide sequence at SEQ ID NO. 50810
aaagctggagctccccgcggtggcggccgctctagaactagtggatcccccgggctgcaggaattcgcacgagaccattacctagaacatcctaatcgaaaagaggagagcactggcttgtatccctctggcctctctcgtctccagcgacggcagcgggcgagggttacgcgaaggcgaagcggagtagtggaagcagaggcggcagccatggcggtgatggagaagctcaagatctttgtcgttaaggagcccgtagtcgcggcctcctgcctcatcgctggattcggtctctttcttccagcagttgtccggccaatcctggattcatggcagaccgcggaacaagttcctccacctcttctaaatgatgtggttgcaggtgtcaccggcaagaaaaagtagtaaacttgcattgttttctcatgccaatattgccccacattttcttccccgtgttttttctggcgaccagattggaaggcttttcccaagagtgtcttgaactctagatggtatccgcggaataatcattgtacctgaatcatatactgcaatgtggcagttatgaaaatctttcccctcctacaaaggttgatagaatgccatacccttaaaaaaaaaaaaaaaagcttatcgatacgtccgacctcgaggggggggcccggtacccaattcgccctatagtgagtcgtattacgcgcgctcactggccgtcgttttacaacgtcgtgactgggaaaaccctgt

SEQ ID NO: 50810 - protein, 64 aa, Zea mays
  misc_feature: Ceres CLONE 1464354-F
MAVMEKLKIFVVKEPVVAASCLIAGFGLFLPAVVRPILDSWQTAEQVPPPLLNDVVAGVTGKKK

SEQ ID NO: 50811 - DNA, 904 bp, Zea mays
  misc_feature: Ceres CLONE 1464357-F
  misc_feature: Encodes the peptide sequence at SEQ ID NO. 50812
  misc_feature (10)..(10): n is a, c, t, g, unknown, or other
  misc_feature (11)..(11): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (421)..(421): n is a, c, t, g, unknown, or other
  misc_feature (422)..(422): n is a, c, t, g, unknown, or other
  misc_feature (455)..(455): n is a, c, t, g, unknown, or other
  misc_feature (484)..(484): n is a, c, t, g, unknown, or other
gtgtttgtanncaaaaacacccccnnnnnnggccccnnnnncaaaactggagctccacgcggtggcgggcgctctattactagtggatcccccgggctgcgggagattctcacgagaccattacctagaacatcctaatcgaaaaacttcactactctctctcgctctgggtgggaagctgattgatccagcatcgatgccgtcactccacccatcctggtgcaccaacgtaccacgcatgggagatggcgaccgaagaggcatatacggcggcggcgcctacggggagtagcaggggggcggacgtccgatgggtgagcaggggaacggcatgatccacgaccaggggccgacggagtcccaagcgctgactgtggagacgctgttccctctgggcgggctgcttgtggtggttgttttnnctgctggtggggagtattaaggggggggtttgnaaaaaaccacctgttccacaccaaaaaanacaaccacccgtcccgagaaccgccaccccggccacccgaggaacccaaaaaaaggggtctgatacccacgggggtcagatggggtctgggggcgccttgaattgggctgcaggtgtttggtgttaaccaggtgggcggacatgtgtggcgtatatgaggtctggagacacgaggcggaagaggaatgccttcgcccgcaaggcaattaagttgatctctcgtgtgtgcggatccatcgtcaagctatttgttgtggaggaagacggtaaggttagtatctgttggtttcaatattcagtcgagtatcgtgctaaggtcgctacacgctttgccggtcaggggttttcggttgctgaatctagaaaagtaagccgcgcaccgcgacatagctgatcggtaattagatgtctcggccgggg

SEQ ID NO: 50812 - protein, 43 aa, Zea mays
  misc_feature: Ceres CLONE 1464357-F
  misc_feature (37)..(37): Xaa is any aa, unknown, or other
  misc_feature (38)..(38): Xaa is any aa, unknown, or other
MGEQGNGMIHDQGPTESQALTVETLFPLGGLLVVVVXXAGGEY

SEQ ID NO: 50813 - DNA, 742 bp, Zea mays
  misc_feature: Ceres CLONE 1464362-F
  misc_feature: Encodes the peptide sequence at SEQ ID NO. 50814
  misc_feature (368)..(368): n is a, c, t, g, unknown, or other
  misc_feature (369)..(369): n is a, c, t, g, unknown, or other
  misc_feature (371)..(371): n is a, c, t, g, unknown, or other
  misc_feature (372)..(372): n is a, c, t, g, unknown, or other
  misc_feature (404)..(404): n is a, c, t, g, unknown, or other
  misc_feature (405)..(405): n is a, c, t, g, unknown, or other
  misc_feature (422)..(422): n is a, c, t, g, unknown, or other
  misc_feature (427)..(427): n is a, c, t, g, unknown, or other
  misc_feature (428)..(428): n is a, c, t, g, unknown, or other
ggagctccccgcggtggcggccgctctttaatagtggatcccccgggctgcaggaattcgcacgagaccattacctagaacatcctaatcgaaaattcgatagttcaggccgtgtaattcagttctctgagaaaccaaagggtgctgccttggaagaaatgaaagtggataccagcttcctcaatttcgccattgattccccagctgaatatccctatatcgcttcaatgggagtttacgtttttaagagagatgttctgttagaccttctaaagtcacggtatgctgaactgcatgactttggttctgaaattctgcccaaggctttgcatgagcacaatgaacaggcatatgttttcactgagtanngnnacgacattgaaacaatcagatctttctttgannacaggctcgccactgcnagcannctccaaagtccaagttttaccatccgaaaacaccattcttcacttcccctcgatacttgccaccaagcaagtcggataagtgcacgataaaagacccgatcatttcacaccggctggcttcctgcgtgagagagacatcgaaaactctattgttggtgttcgctcaagcgctaatctctgagatggcagctccaaaaaaccttgttcatggtttgcgaatttgtatgaaacccaaatatcaaatctcaagggctactggacaaagggcacgggggccccttttgcctttcggggaaacaatccaataatattca

SEQ ID NO: 50814 - protein, 171 aa, Zea mays
  misc_feature: Ceres CLONE 1464362-F
  misc_feature: SWISSPROT Homolog: EC 2.7.7.27 Glucose-1-phosphate adenylyltransferase
  misc_feature (122)..(122): Xaa is any aa, unknown, or other
  misc_feature (123)..(123): Xaa is any aa, unknown, or other
  misc_feature (124)..(124): Xaa is any aa, unknown, or other
  misc_feature (134)..(134): Xaa is any aa, unknown, or other
  misc_feature (135)..(135): Xaa is any aa, unknown, or other
  misc_feature (142)..(142): Xaa is any aa, unknown, or other
SSPRWRPLFNSGSPGLQEFARDHYLEHPNRKFDSSGRVIQFSEKPKGAALEEMKVDTSFLNFAIDSPAEYPYIASMGVYVFKRDVLLDLLKSRYAELHDFGSEILPKALHEHNEQAYVFTEXXXDIETIRSFFXXRLATASXLQSPSFTIRKHHSSLPLDTCHQASRISAR

SEQ ID NO: 50815 - DNA, 774 bp, Zea mays
  misc_feature: Ceres CLONE 1464367-F
  misc_feature: Encodes the peptide sequence at SEQ ID NO. 50816
  misc_feature (349)..(349): n is a, c, t, g, unknown, or other
aagctggagctccccgcggtggcggccgctctagaactagtggatcccccgggctgcaggaattcgcacgagaccattacctagaacatcctaatcgaaaaaacttccaacacgcctcgatctagatccactcttcccccttctccttccggtcctccccccgagactattcatataggcgggtaggcgtccgaggcctcgtttgttctcggcttctcgtctccaagggtgctactccgtccgcgcttggtctgctctcgttcttccggaggccgcggcgtcacatggcgaagaatcagccgaaaggcttgctcgcgcaaagcaaggtgaagaagggtccccggccaantcagcgtggccacgatcgtcacctacatgatcctcgggcgtcctggtcgggtcctcccgttaccctgcctacagggactgttgggcaacgccccggacccccggaaggcaggaaccgccccgggaaactgatcccccgccaaatggcggggcagatcccccggtgggtggaacctcgcgtgggggaaaatttttggtgttttccttcccaccaaaaggggtttttggaaacagaaaaggttttttttttccccgctccccccccacccaaaaaaaaagggggaaaaccccccccctttaaccccgggggtcctccaaaaaaaaaaaaaacttttttttcccccccctcccgggggggggcccggcccccccttcccccaaagaggaaataatacccgcccccgcgcgctgttttttacaaagaga

SEQ ID NO: 50816 - protein, 34 aa, Zea mays
  misc_feature: Ceres CLONE 1464367-F
MILGRPGRVLPLPCLQGLLGNAPDPRKAGTAPGN

SEQ ID NO: 50817 - DNA, 752 bp, Zea mays
  misc_feature: Ceres CLONE 1464370-F
  misc_feature: Translation starting site: 178
  misc_feature: SWISSPROT Homolog: EC 1.11.1.15 Peroxiredoxin
tggagctccccgcggtggcggccgctctataactagtggatcccccgggctgcaggaattcgcacgagaccattacctagaacatcctaatcgaaaaacccattcactcgccttgcgcttcctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccagggtgtagacgagatcctgctttatcagcgtaacgaccccttcgtcatgaaggcatgggcgaagacctactccgagacaaagccctgaaagttccttcgccaacgattctggagcggaacccaagggctttgacctcaagttcgatttcccggaaaaaggtcttgggcgggccccccaaaggtttcctttcctggggaaaaaaacttcgggtcaccgtgaaaaaatttaggaaagggggggattccaaatttcgggggggaaaaaaaccccaaggggtttttaaaaccccaaaaaaaagggggaaattaaaacccccttaaaaaaaatggttgggaaaaagaatatctgggggtggtagaaagccccccc

SEQ ID NO: 50818 - DNA, 690 bp, Zea mays
  misc_feature: Ceres CLONE 1464372-F
  misc_feature: Encodes the peptide sequence at SEQ ID NO. 50819
ctggagctccccgcggtggcggccgctctagaactagtggatcccccgggctgcaggaattcgcacgagaccattacctagaacatcctaatcgaaaaaaaaaaatctcgcctgccatctcgcggtccagccccgtcgttcacctcaatctccacgcgtcaccgccgccttccggcgagtctattcccctccgccacgccgtcgaagctttccagaccccgcagcggttcggataaggcggccgcccgccacccgccctcgtttcggccccactcgtctcggccccgggaccgcttcggggtggatctagggttgcgtggggaggggttctggaagcctccgccgcgatggacgaggcggacgatgacgcccgcaccttcaaggtcggattcaccgccgccggagagaagcagttccgggagctcgtgagggagaagctgcgcgggttcaggaggggcctggacgacaccctcctggtacggttttcttccgtcgccctccgactcgttagcttatggtactagcggttgattgcggctgttcaaggacttggggttctctgcagactgcagcttcaagtttttggtcgaactcaattaacacttaacagtatgtaaaggactggttagaattaaagatggcttgtgcgagttacgcaactgtgccctgtgttttcgttcagtgccgccc

SEQ ID NO: 50819 - protein, 58 aa, Zea mays
  misc_feature: Ceres CLONE 1464372-F
MDEADDDARTFKVGFTAAGEKQFRELVREKLRGFRRGLDDTLLVRFSSVALRLVSLWY

SEQ ID NO: 50820 - DNA, 744 bp, Zea mays
  misc_feature: Ceres CLONE 1464374-F
  misc_feature (335)..(335): n is a, c, t, g, unknown, or other
ggagctccccgcggtggcggccgctctagaactagtggatcccccgggctgcaggaattcgcacgagaccattacctagaacatcctaatcgaaaactagacagcgaaagggacggcagagggaggagagggctcaaaccgcctgcctgctgccctgcaccccgcgcccaccccacttcttccacttccaccacctcctcccctccagtccccctctccacctgccccccgctccctggtccggcgcggagaaccagccagccagcccgtcgtcgctgtcgcccgccggtgaagcagtagccgcgcgtgacgccggatccaatcccgcggcctcngcgcgcgcgcggtcatggacttcgacggcgccattggcgatcaggggtgagttgcgcgcaccgaaacaccgcccgtgtactactggtcctgggcccgcggcccggaaaaggcccggccttgtgcccgcgctgggaacaaattccagtccccgggttccttttccccttcgggtccggccgtgaaggttggagcacccgctaatccccattttttttaaggagctctcggggggggtgggaccagtactaaaaccccgaaattgcgcccccccttttggggggggaccctttttgcccccccaaaatatttaggggagaggaacccgggaataattttttgggggaaaaggccctaatctccccctttttaaaaaaaattttgggggttttgcccctttcccggggggcc

SEQ ID NO: 50821 - DNA, 807 bp, Zea mays
  misc_feature: Ceres CLONE 1464377-F
  misc_feature: Encodes the peptide sequence at SEQ ID NO. 50822
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (447)..(447): n is a, c, t, g, unknown, or other
aagtgggctctttttttnnnnnnnnnnnnnnnncctannnnnnnccagactggagctccccgcggtggcggccgctctagaactagtggatcccccgggctgcaggaattcgcacgagaccattacctagaacatcctaatcgaaaatcatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtaccgcgggaggaaggtgggggccaggacggaggtgcgggacgtgaagggcgacggcgaggtgcangagctcggccggttctccccccccgagtacaaccggcagctcccaaaaagtggcggcggcggcggcaggctcgagttcggaaggttggtggcggcgccacggcaggtggtgtcggggctcaagtactacctccgcgtcttggccctggaaagaaggcggcccgggaaacggcggcaagcgcgtgttcaacgccgcggtcgtcgtcaagccctgggtcgattcgcgcacccggctcccgttccccccggcgcccgccaagaagcgcggagcctccccccggggtagacgcctaatgtaagattcctggggtggccctctcggaaaacaagggaccctgaaaaaaagctttgtggggtttgg

SEQ ID NO: 50822 - protein, 158 aa, Zea mays
  misc_feature: Ceres CLONE 1464377-F
  misc_feature (64)..(64): Xaa is any aa, unknown, or other
MARALGACVLLAVLLGALAPAAAARAHDDQGSGAGIRQPSGEYRGRKVGARTEVRDVKGDGEVXELGRFSPPEYNRQLPKSGGGGGRLEFGRLVAAPRQVVSGLKYYLRVLALERRRPGKRRQARVQRRGRRQALGRFAHPAPVPPGARQEARSLPPG

SEQ ID NO: 50823 - DNA, 812 bp, Zea mays
  misc_feature: Ceres CLONE 1464391-F
  misc_feature: Encodes the peptide sequence at SEQ ID NO. 50824
  misc_feature (390)..(390): n is a, c, t, g, unknown, or other
aaagctggagctccccgcggtggcggccgctctagaactagtggatcccccgggctgcaggaattcgcacgagaccattacctagaacatcctaatcgaaaaatcctttccatcaaaactgagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagatcggcgttgatgaagagatcctcgtgttcaacctcaangaagggcgaggtcaccaaagggcccctaacaggaaaagccggatgccactttccccttcaacgaaaaacgatttctttggaatccccaccggcaaaacgaatcccaaaattgctttcttcccggggggaataaaaattcaggggaacctccttggcgggcaaaaaattcccccctggaaacttttcccaaatccgttaaaatttaaaaaaggtaaattggttttttctttgggcaaagggaaaaaaaaggtgtgcggcctttttttttttttgaaaaaaaaaatggggggggaaaaaaaaaaccccctcccccgggggaaaattaaaaggggaaaaactccccaaaaaaccccccgaatgtgttttctataaaaaaaaaaaaaaaaaaaaatttttttcccccccccccagggggggggggc

SEQ ID NO: 50824 - protein, 178 aa, Zea mays
  misc_feature: Ceres CLONE 1464391-F
  misc_feature: SWISSPROT Homolog: EC 2.3.1.176 Propanoyl-CoA C-acyltransferase
  misc_feature (55)..(55): Xaa is any aa, unknown, or other
MDSSSLKSAQLLELMRQHLATDAGKEVTKKVGLVYQLNIAPKIGVDEEILVFNLXEGRGHQRAPNRKSRMPLSPSTKNDFFGIPTGKTNPKIAFFPGGIKIQGNLLGGQKIPPWKLFPNPLKFKKGKLVFSLGKGKKKVCGLFFFLKKKMGGEKKNPLPRGKIKRGKTPQKTPRMCFL

SEQ ID NO: 50825 - DNA, 775 bp, Zea mays
  misc_feature: Ceres CLONE 1464394-F
  misc_feature: Encodes the peptide sequence at SEQ ID NO. 50826
  misc_feature (1)..(1): n is a, c, t, g, unknown, or other
  misc_feature (640)..(640): n is a, c, t, g, unknown, or other
naaagctggagctccccgcggtggcggccgctctagaactagtggatcccccgggctgcaggaattcgcacgagaccattacctagaacatcctaatcgaaaattttcctgtccgactcccagccgtcgtctgctgcggactccgcctccattttgctctgtttcttgcaagttgctcttgcggtagttcccccaactgccaccatgcagaacgaggagggtaagactgtggacctctatgtccccaggaaatgctcggccacaaacaggatcatcactgccaaggaccatgcctctgtccagatcaacattggccacttggatgcgaatggcctgtatgatggtcacttcacaacgtttgctctctctgggtttgtccgtgctcagggcgacgcagacagctccttggacaggctgtggcagaagaaggctgatatcaagcagtagattttacatctagtttaccaagaattggacactgccttagctatgttttgaattcatgtcactatatgcaatgttgtgatttcagctggtaccttaaatctgaagatttagtatctttgttgggttccttctgagtttgatgtgtggtgttcaattcaaccgtccagtctccagtggcaccgaaatatgctgnttggtgtagtttcattcaaaaaacgtgccattcaattcaactgtccagtgccattcaataaaaaaaaaaaaaaaaaagcttatcgataccgtcgacctcgagggggggcccggtacccaattcgccctatagtga

SEQ ID NO: 50826 - protein, 80 aa, Zea mays
  misc_feature: Ceres CLONE 1464394-F
  misc_feature (1)..(81): Pfam Name: Ribosomal_S21e Pfam Description: Ribosomal protein S21e
MQNEEGKTVDLYVPRKCSATNRIITAKDHASVQINIGHLDANGLYDGHFTTFALSGFVRAQGDADSSLDRLWQKKADIKQ

SEQ ID NO: 50827 - DNA, 739 bp, Zea mays
  misc_feature: Ceres CLONE 1464404-F
  misc_feature: Encodes the peptide sequence at SEQ ID NO. 50828
aaagctggagctccccgcggtggcggccgctctagaactagtggatcccccgggctgcaggaattcgcacgagaccattacctagaacatcctaatcgaaaactttatgtagctcttgcacagcgtaaagatgacagaaaggcaaagctacaggcacagttttcacaaatgcgtcctgttgcaatggcaccttcagtaggtcctcgcatgcccatgtttccacctagtgttcctggagttggtcagcagctgttttatggtcagccacctccagccttcatcaaccctcaggctggatttgctttccagcaacctatgatgcctggtatgaggcctggtggtccaatgccgaactttatgatgcctatggttcagcagggacagcaaccgcaacgtcctgctggtaggcgtgctgggtctggtggaatgcagcagcccatgccaatgggtagtcagcaacaggtatgctgtatcattcttggcatttttcatttttgttcgttgaactgtggcttgaaatttctgtatggctgtagatattccctagaggtggtcgtggctaccgctatgctactggacgtggaatgcctgatcctggcatgcataatgttggtgctgtgatgccatctccatatgagatgggagggatggcaatgagagatgctggtgtctcacaacctgttccaattggggcactagccactgcgcttgctaacgcctcaccagatcagcaaagact

SEQ ID NO: 50828 - protein, 206 aa, Zea mays
  misc_feature: Ceres CLONE 1464404-F
KAGAPRGGGRSRTSGSPGLQEFARDHYLEHPNRKLYVALAQRKDDRKAKLQAQFSQMRPVAMAPSVGPRMPMFPPSVPGVGQQLFYGQPPPAFINPQAGFAFQQPMMPGMRPGGPMPNFMMPMVQQGQQPQRPAGRRAGSGGMQQPMPMGSQQQVCCIILGIFHFCSLNCGLKFLYGCRYSLEVVVATAMLLDVECLILACIMLVL

SEQ ID NO: 50829 - DNA, 744 bp, Zea mays
  misc_feature: Ceres CLONE 1464406-F
  misc_feature: Encodes the peptide sequence at SEQ ID NO. 50830
  misc_feature (240)..(240): n is a, c, t, g, unknown, or other
  misc_feature (241)..(241): n is a, c, t, g, unknown, or other
  misc_feature (246)..(246): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
tggagctccccgcggtggcggccgctctagaactagtggatcccccgggctgcaggaattcgcacgagaccattacctagaacatcctaatcgaaaaatagcttatatagcaaaacaatagaagtagaacaagcacagaactgttaagctccgcaggctgcagctcgtccccaatgtcgtctgcttctcttgcatcttctctcttgtgcagcagcagtgcttctactagtagaagcgcannaccgntgnnnccaagaaaagtaaccaggaacccctcttttttccaagaaccagtacaaaccgccctcttcggcctcttaggagtagttcagtagtaaggcgatcgttgcagcaggagcaagaggagagggtgggcccccgcgtccctctggtctctggtgggccctccgggcgaagcgaaccgggaggggaaggccgaaagggcgtcccatcctgttgggagggggtggaatgaagcccaaggcgtccgggcccttgtttggaaaaggccaaaataaaggggaggcccaagggaaaaaagggcccgcggggtgggggaaaaggggcccccagccaacccccgggaggggggactggaaatccaaacaagggattcaaaaaatttctgggggaaacccccccctgaggggccccctaaatttgaaaaaaaacccccccaaaggaaatcccccagagtggacccgggaacccaaaacaacccccgggggggggggtggggggggt

SEQ ID NO: 50830 - protein, 53 aa, Zea mays
  misc_feature: Ceres CLONE 1464406-F
  misc_feature (23)..(23): Xaa is any aa, unknown, or other
  misc_feature (25)..(25): Xaa is any aa, unknown, or other
  misc_feature (26)..(26): Xaa is any aa, unknown, or other
MSSASLASSLLCSSSASTSRSAXPXXPRKVTRNPSFFQEPVQTALFGLLGVVQ

SEQ ID NO: 50831 - DNA, 810 bp, Zea mays
  misc_feature: Ceres CLONE 1464409-F
  misc_feature: Encodes the peptide sequence at SEQ ID NO. 50832
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (414)..(414): n is a, c, t, g, unknown, or other
  misc_feature (445)..(445): n is a, c, t, g, unknown, or other
aagctggagctccccgcggtggcggccgctctagaactagtggatcccccgggctgcaggaattcgcacgagaccattacctagaacatcctaatcgaaaaaagaggattcagaagaagcaggcttccgctgctgcttcccccactcgaatccaagcaaccacgcccccacgcccagtccaaccccaacccgcgaagctggcgcgcgaggcggccgacgcgagcgcccgcaagcgcaaggcgggggacggcggcgaggtccccgacgccaccgcctcggcagaggtggccgcagcgccgacccccggagaggacgcggccatgggcgacgttccacaggcgccgcacgctgcgggaggtggaaaaaagtgggcggggccggaccctaccctagccnnngagctcgcggctgctncgaccccgtgtcggtgaactctccatgggcnggggactactaccgggcctggtgggggaaggccgaatcccaacttccccaaggggcccaagctgcctgggctttgggaaaaagaaccccctcccctctttaaacctggattttaggcttggggccccccttttaaaaaaaaaaaattaattggtggggagacaaatatggggctttaaaaccccccccggggaaagggaaaccgtgtttacaaaacttttgtttcccccccggggaattccggggggtttttttcaaaaaccccccttaaaaaaaaaaaaaaagggggggggtgcccccccgggaaaaaagggggagagaaaaaaacccccccccccggagaaaaaagggcccttttgagagacc

SEQ ID NO: 50832 - protein, 36 aa, Zea mays
  misc_feature: Ceres CLONE 1464409-F
  misc_feature (26)..(26): Xaa is any aa, unknown, or other
  misc_feature (32)..(32): Xaa is any aa, unknown, or other
MGDVPQAPHAAGGGKKWAGPDPTLAXELAAAXTPCR

SEQ ID NO: 50833 - DNA, 697 bp, Zea mays
  misc_feature: Ceres CLONE 1464411-F
  misc_feature: Encodes the peptide sequence at SEQ ID NO. 50834
  misc_feature (245)..(245): n is a, c, t, g, unknown, or other
  misc_feature (249)..(249): n is a, c, t, g, unknown, or other
  misc_feature (250)..(250): n is a, c, t, g, unknown, or other
  misc_feature (333)..(333): n is a, c, t, g, unknown, or other
  misc_feature (334)..(334): n is a, c, t, g, unknown, or other
  misc_feature (384)..(384): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
aaagctggagctccccgcggtggcggccgctctagaactagtggatcccccgggctgcaggaattcgcacgagaccattacctagaacatcctaatcgaaaaattttatttatcgtttatccacggaacttccggtgccggcggcgaccacttgtggcgatccatccctcaccatgtcgtcggagaaggaggcggcgctcgccgccgtgctcgatgacagcccaaccatatttgacaagatcatncaannaaaggaaataccttctactgtggtttatgaggacgagaaggtactggctttcagggacataaacccctcaagctccaacacannccaattctcatcatcccccaaaagtcaaaggaatggggaactaacttggnccctggggccaaaaagggcttgggaaaaagaaaaagggaccctaggaaaataacctttgggcccttatcctcccccccccaaatgtttgccccaaagggtttttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 50834 - protein, 87 aa, Zea mays
  misc_feature: Ceres CLONE 1464411-F
  misc_feature (24)..(24): Xaa is any aa, unknown, or other
  misc_feature (26)..(26): Xaa is any aa, unknown, or other
  misc_feature (54)..(54): Xaa is any aa, unknown, or other
  misc_feature (71)..(71): Xaa is any aa, unknown, or other
MSSEKEAALAAVLDDSPTIFDKIXQXKEIPSTVVYEDEKVLAFRDINPSSSNTXQFSSSPKSQRNGELTWXLGPKRAWEKEKGTLGK

SEQ ID NO: 50835 - DNA, 747 bp, Zea mays
  misc_feature: Ceres CLONE 1464412-F
  misc_feature: SWISSPROT Homolog: EC 3.6.3.14 H(+)-transporting two-sector ATPase
  misc_feature (680)..(680): n is a, c, t, g, unknown, or other
tccccgcggtggcggccgctcttgaactagtggatcccccgggctgcaggaattcgcacgagaccattacctagaacatcctaatcgaaaactctaatgattagaaactaaaaacgagatctcgaagtaattcgaacgatttcgattatcatttatttgtacttattagttacttctacccgatagagcttagaagttggaagtaataatttcttggttgattgtatccttaaccatttctttttttttgacacgaggaactcatcatgaatccactaattgctgctgcttccgttattgctgctggattggccgtagggcttgcttctattgggcccggagttggtcaaggtactgctgcaggacaagctgtagaaggtattgcgagacagccagaagcagaaggtaaaataagaggtactttattgcttagtctagcttttatggaagctttaacaatttatggactggttgtggcactagcgcttttatttgcgaacccttttgtttaatcctaaaaaagaaaatgagtcctttagattagatacttttttctttttttagtacattggcatttgcttatgtaattctaagtatatcaatactttactttactcctatttattatattatttcttttttatattattccggaaattttgtatttatcgggacagacnataccctaggaaccccaagaagggctgatttgagcatgatcaatttagaggatatgctcgccctctt

SEQ ID NO: 50836 - DNA, 762 bp, Zea mays
  misc_feature: Ceres CLONE 1464415-F
  misc_feature: Encodes the peptide sequence at SEQ ID NO. 50837
aaagctggagctccccgcggtggcggccgctctagaactagtggatcccccgggctgcaggaattcgcacgagaccattacctagaacatcctaatcgaaaagttattccatcaccagttcaccaccgtcttcctcaattcttcctctcctctctcttctgcaccatctggtgtgtgtgcgcgttactcgccgcgtcgatcgaagaaagaggcgcacgggagcgagctacgcgaagcaaggcaatggcgaagggcgggctgtccaagcttcggtgcatgatcaagaggtggcactcgtccagccgcatcgcccgcgcgccgccgtctcccggccccggtgaggacgaccgctgcgccgcgcgcggcgcgtcgttccacggcgcggacgaggtgcccgagggcctgcacccggtgtacgtcggcaagtcgcgccgccggtacctcgtcgccgaggagctggtgggccacccgctgttccagaccctcttcgaccgcatcggcggcggcggcaccggggcagcggcggcgggtaccgtcgtcggctgcgaggtcgtgctgttcgagcacctgctgtggatgctggagaacgcggacccgccgccggagtccctcgacgagctcgtcgagtactacgcgtgctgagacagagtcatagagcctcgccccacgccgccagctcggccgtgacgcagcgcggcccgacggtggtggaagtggaatggaagctagcttagcacggagctgctgtatcatttcgttcgg

SEQ ID NO: 50837 - protein, 132 aa, Zea mays; identical to SEQ ID NO: 50365
  misc_feature: Ceres CLONE 1464415-F
  misc_feature (12)..(114): Pfam Name: Auxin_inducible Pfam Description: Auxin responsive protein

SEQ ID NO: 50838 - DNA, 779 bp, Zea mays
  misc_feature: Ceres CLONE 1464417-F
  misc_feature: Encodes the peptide sequence at SEQ ID NO. 50839
  misc_feature (606)..(606): n is a, c, t, g, unknown, or other
ggagctccccgcggtggcggccgctctagaactagtggatcccccgggctgcaggaattcgcacgagaccattacctagaacatcctaatcgaaaaactgggtctctttaggctagctctgccagtcttgctctccacactcgctctgctactagctactagcagtagagcagtagaggagagagcatctacctagcgccgtcggacggatcggagctacctcaccgccgaccgcgcgcgaagagatcgatggctcatgctgctacgctcgctgctgcagccgcggtcgtcgtcctcatcgtcgtctgctgctgctcctcttcggaggccgccagccacagcgccaacgcgaggcagccgccgctggcgcccggcctgtccttggacttctacaagcggagctgccccagggcggagtccgtcgtgcggaggttcgtgcaggacgccgtgcgcagggacgccggcctcgccgccggcctcctccgcctccacttccacgactgcttcgtccagagctgcgacgcgtccgtgctcctggacggctcagccaccggcccgggcgagcagcaggcgccgcccaacctcacgctgcgccccaccgcgttncaggcccatcacgacatccacgacccgcctcagaaggagtgcggtggcgcagtcgtgtcttgctccgacgtcctcgcgctcgcccgcagggactcagtcgtcgtgtccgggagtcccagctacaaggtgccgctgggtcggcgcgacagcgcgagcttcgcgacgcgagaggg

SEQ ID NO: 50839 - protein, 176 aa, Zea mays
  misc_feature: Ceres CLONE 1464417-F
  misc_feature (59)..(176): Pfam Name: peroxidase Pfam Description: Peroxidase
  misc_feature: SWISSPROT Homolog: EC 1.11.1.7 Peroxidase
  misc_feature (119)..(119): Xaa is any aa, unknown, or other
MAHAATLAAAAAVVVLIVVCCCSSSEAASHSANARQPPLAPGLSLDFYKRSCPRAESVVRRFVQDAVRRDAGLAAGLLRLHFHDCFVQSCDASVLLDGSATGPGEQQAPPNLTLRPTAXQAHHDIHDPPQKECGGAVVSCSDVLALARRDSVVVSGSPSYKVPLGRRDSASFATRE

SEQ ID NO: 50840 - DNA, 740 bp, Zea mays
  misc_feature: Ceres CLONE 1464423-F
  misc_feature: Encodes the peptide sequence at SEQ ID NO. 50841
ctccccgcggtggcggccgctctagaactagtggatcccccgggctgcaggaattcgcacgagaccattacctagaacatcctaatcgaaaaaagtcgaagtctcgaaggttccagcgagcgactgtgtcgagcaggagagagcgcgatggggaagatgcggcagctgatctgcctcgtggccgccgtcgccgccgcggccatcctcctgacagcgtcggccaagaagtccggcgacgtcaccgagcttcagatcggcgtcaagtacaagcctgagtcatgtacgctgcaagcacacaaaggagacaaaattaaggttcactatcgtgggacactgactgatggatcagttttcgattctagctatgacagaggtgacccgtttgaattcacccttggaaatggccaagtgataaaaggttgggaccaaggattgctcggtatgtgcgtgggtgaaaagaggaagctaaagatacctgcaaagatgggttatggtgagcgaggctccccaccaaagattccaggtggagcaactctgatcttccacacgtagcttatcgccgtcaactggaagacatccggcggtgcaaagcagaaaagggatactgagctctgatacatgcattggagaagttccaagctcggagagtattattgccgccgccacatattcattaggggaaagggttgctggttcccccccaagcgtttttgcttcagaatgtaacaaaacaattctgg

SEQ ID NO: 50841 - protein, 134 aa, Zea mays
  misc_feature: Ceres CLONE 1464423-F
  misc_feature (43)..(133): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGKMRQLICLVAAVAAAAILLTASAKKSGDVTELQIGVKYKPESCTLQAHKGDKIKVHYRGTLTDGSVFDSSYDRGDPFEFTLGNGQVIKGWDQGLLGMCVGEKRKLKIPAKMGYGERGSPPKIPGGATLIFHT

SEQ ID NO: 50842 - DNA, 767 bp, Zea mays
  misc_feature: Ceres CLONE 1464429-F
  misc_feature: Encodes the peptide sequence at SEQ ID NO. 50843
  misc_feature (379)..(379): n is a, c, t, g, unknown, or other
  misc_feature (382)..(382): n is a, c, t, g, unknown, or other
  misc_feature (399)..(399): n is a, c, t, g, unknown, or other
aagctggagctccccgcggtggcggccgctctagaactagtggatcccccgggctgcaggaattcgcacgagaccattacctagaacatcctaatcgaaaagtttgttgtgtagccgccactagtacgaagccctcagtcctccctcacacaccgaaccgagcgcaccatgtcgtcggcggctggaggagtggaggagacggtgcgggcgtcgcacatcctcatcaagcacgagggttcccgccgcaaggcctcctggaaggaccctgacggccgcatcatctccgccaccacgcgcggcgacgccgcagcgcgcctcctggacctccgcaaccagattctctccggccaggccaacttcgccgacctcgccgctgggnacnccgactgctcgcccccnccactcggtggggacttacccaccttcgccaggaggcagatgcagaaacccttcgaggacgccacatatgccctcaaggttggtgagctcagcgacatcgtggacactgacagtggggttcacatcatcctgcggactgcctgaggaggggatcacactgtcctctcaggctttcagttagtgcttatggcgttcctgtacaacctgaatttgtattcctgctgggagcctgaatcccattccgtgcaaagataactcatgtgtgaagacacgtttgcaacccgctttattgccttaactggaataaagatagatgcccgcagctccaaaaaacaaaaaaaaaagctttttcgatcccgccgaccctg

SEQ ID NO: 50843 - protein, 124 aa, Zea mays
  misc_feature: Ceres CLONE 1464429-F
  misc_feature (16)..(124): Pfam Name: Rotamase Pfam Description: PPIC-type PPIASE domain
  misc_feature: SWISSPROT Homolog: EC 5.2.1.8 Peptidylprolyl isomerase
  misc_feature (71)..(71): Xaa is any aa, unknown, or other
  misc_feature (72)..(72): Xaa is any aa, unknown, or other
MSSAAGGVEETVRASHILIKHEGSRRKASWKDPDGRIISATTRGDAAARLLDLRNQILSGQANFADLAAGXXDCSPPPLGGDLPTFARRQMQKPFEDATYALKVGELSDIVDTDSGVHIILRTA

SEQ ID NO: 50844 - DNA, 741 bp, Zea mays
  misc_feature: Ceres CLONE 1464431-F
  misc_feature (238)..(238): n is a, c, t, g, unknown, or other
  misc_feature (239)..(239): n is a, c, t, g, unknown, or other
  misc_feature (246)..(246): n is a, c, t, g, unknown, or other
  misc_feature (247)..(247): n is a, c, t, g, unknown, or other
  misc_feature (256)..(256): n is a, c, t, g, unknown, or other
  misc_feature (257)..(257): n is a, c, t, g, unknown, or other
  misc_feature (263)..(263): n is a, c, t, g, unknown, or other
  misc_feature (264)..(264): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (366)..(366): n is a, c, t, g, unknown, or other
  misc_feature (410)..(410): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (535)..(535): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (588)..(588): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (633)..(633): n is a, c, t, g, unknown, or other
  misc_feature (634)..(634): n is a, c, t, g, unknown, or other
  misc_feature (665)..(665): n is a, c, t, g, unknown, or other
  misc_feature (675)..(675): n is a, c, t, g, unknown, or other
  misc_feature (681)..(681): n is a, c, t, g, unknown, or other
  misc_feature (688)..(688): n is a, c, t, g, unknown, or other
  misc_feature (689)..(689): n is a, c, t, g, unknown, or other
  misc_feature (694)..(694): n is a, c, t, g, unknown, or other
  misc_feature (704)..(704): n is a, c, t, g, unknown, or other
  misc_feature (709)..(709): n is a, c, t, g, unknown, or other
  misc_feature (718)..(718): n is a, c, t, g, unknown, or other
tggagctccccgcggtggcggccgctctataactagtggatcccccgggctgcaggaattcgcacgagaccattacctagaacatcctaatcgaaaaatgtttcccccaaatctaaggcgtcgccagccctggcaaagcgcttgccgctgctcccctcttccgtttccagcgccgccgccctccttcctgttcctgttctccagcaccgccgttgaacctcctcccctctccctcgtnngcttccnnctctcttannatcccnntctcnnntgccgcttccccgctctccccaaactactctgtgccccgtcagatcgacctggaccttggccggaattactttctttccaaagggggggccgggnaaaaaaccccaaagggaaaaaaccccggggacacagaggccccntttttttatttgggggttgcccccccccttttttgcccccaaaaaaaaaactgaaaaaaacaaannnngacgaaaaaccaccaaaaagaagaaannnnnnnnncagaacaatnnnntgaagtagnagggagagaagaaaannnnacgaaagagagaacccccgcgggggttgtggccncccccccccccaccccccccagccnnnccccccccgcctcccccnngggggccaccacccccacaaaatataagggnccagaccccncacaanataaatnnatttntaactaaaanatttntcctccccnccccccccccccccaccccaccc

SEQ ID NO: 50845 - DNA, 877 bp, Zea mays
  misc_feature: Ceres CLONE 1464433-F
  misc_feature: Encodes the peptide sequence at SEQ ID NO. 50846
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (312)..(312): n is a, c, t, g, unknown, or other
  misc_feature (313)..(313): n is a, c, t, g, unknown, or other
  misc_feature (423)..(423): n is a, c, t, g, unknown, or other
aaagaggccaaacacacatcaaaaaaanncnnncccgacgaccccaaaaatggagctccaccgcggtggcggccgctctttaatagtggatcccccgggctgcgggggttcccacgagaacattacctagaacatcctaatctcaaaaaaacaaaccgagggggggccgtgcgcctcccttttgggccctgaatttttctacaagctgattgttacacccccgatctcgggaggagccgaagcatgtcctggtggcggattctcgagcggcccgtctccccgataggcccgatcgggggggggggggcccanncgcacaggctcctggccaactcgaaattggacggtggaactgtcctcctggggcggggctacatatccgtcgcctcccacattctgagcaaggtgattgggttgtgttanaaacagcccttgtgagctcgaaatggggggcgtaaggtgcccccacacaccctcaccacgattgggactagcagtgcctcatgtaaaagcacgagcactctctacatcaatccgccgaagaaactgtcacattcgtgccaaatggggctacctatccgatgccggcccgcgttaaggacccccaatctggggttctagggccgcgaaatacattttttcaatggggggtacctatagagggaaaacaatctatccgacctcctcgttttcgggtgggctccagtgcaatcaggctttggaaaagtctcctttggtaaaaaaagcaacagggaagggaagaatttcccgggtaatttggagataaaagaaccttcccccaataggggagctcaaactcttcccgcgcgatttacttgaaatggtttctatgggcggcggctccctttgtgcattg

SEQ ID NO: 50846 - protein, 64 aa, Zea mays
  misc_feature: Ceres CLONE 1464433-F
  misc_feature (23)..(23): Xaa is any aa, unknown, or other
  misc_feature (24)..(24): Xaa is any aa, unknown, or other
  misc_feature (60)..(60): Xaa is any aa, unknown, or other
MSWWRILERPVSPIGPIGGGGAXXHRLLANSKLDGGTVLLGRGYISVASHILSKVIGLCXKQPL

SEQ ID NO: 50847 - DNA, 833 bp, Zea mays
  misc_feature: Ceres CLONE 1464434-F
  misc_feature: Encodes the peptide sequence at SEQ ID NO. 50848
aaaaacttggaaacggcaccaaacaccatcacatatcctccccaaaaggaggtccccccggtgggcggccgtctataataatggatccccccggctggcaggatttcacgagacacttacctctaaactcccaatccaaaagttcccgcacacactctcgctttcttcggtcctccctcctggagcagccactaccgtctctacccctacacggacaacaagagcgaggccctgaaggggaagaagccggtcaaggagctcaagctcaccgtgccggcgcaggagaccccggaagacaagtccctgacggcaagtggcccgtccaaggatggcgagctgagggctcaatcatagcggcttgcggcttatctctgaggaaaacggggatgaagatgaatctacaaagctgagggacccacacgtgcagttatcaatggatgatcttgagaagaatcaacccccccgccaaaagaaacgagtggcgatgtccccctagtgagccacaaaaagccggaaacattatttgtctttaagggtgttcaaatgaacaatcccgaggtcgtttcgttaacaatagggcaggagctcaaaataaacccagctacacacagcaccctcatagtagttgtagtgtgtattcaatcttttcacacccaacggggcagtaatatccgtgctcttcgagaacatggagcccgaggagcgcctggcggaaagtagctcgagctaggggaaaactatttcatggagccaaaacctttgcggtatcttaggaagtaggatcgtgggaagcgtctaagttggaaccttcatcctgtcagaagggccctggg

SEQ ID NO: 50848 - protein, 58 aa, Zea mays
  misc_feature: Ceres CLONE 1464434-F
MNNPEVVSLTIGQELKINPATHSTLIVVVVCIQSFHTQRGSNIRALREHGARGAPGGK

SEQ ID NO: 50849 - DNA, 717 bp, Zea mays
  misc_feature: Ceres CLONE 1464440-F
  misc_feature: Encodes the peptide sequence at SEQ ID NO. 50850
  misc_feature (201)..(201): n is a, c, t, g, unknown, or other
  misc_feature (206)..(206): n is a, c, t, g, unknown, or other
  misc_feature (213)..(213): n is a, c, t, g, unknown, or other
  misc_feature (237)..(237): n is a, c, t, g, unknown, or other
ctggagctccccgcggtggcggccgctctagaactagtggatcccccgggctgcaggaattcgcacgagaccattacctagaacatcctaatcgaaaaaagtgcagatcacactagcctacacacaccgagcgccgtctaaactgacagcaggtcagcagcctagcgaagccaagacatccgccgatctcagatggccggnagaanggtgcgngcgcagagtgccgtgggcgtggcngccgtcccgctgctggcgctgctcctcccggcgagcgaagccaacgggacctgcaacctccaacggggcacggtgcttaaggaatgtgccttcctgtctcaaagggcgccccagccaagggtgctgccaccccctctaggaaaacccaattttggtgcctcctttaaaactacttggaaaaaggttaaaaaaaccccttattccgcttgtgcccaaggcatcccctttccccggggacctccccacaaacccataggggtgtttaatagagacattcgagggggtgttccccccaaaacaaaaagggggctttttgacaacaaaaaaaaaaacccccttctttaccccgttgttccccccccgagagagggtaatctcttctctcttaaccccctcccccaatttgaaggggcccccttgaaaccggggggaatttttttatatgtgtcttttgcaaaaaaaaaaaaaaagcttatcgat

SEQ ID NO: 50850 - protein, 175 aa, Zea mays
  misc_feature: Ceres CLONE 1464440-F
  misc_feature (5)..(5): Xaa is any aa, unknown, or other
MAGRXVRAQSAVGVAAVPLLALLLPASEANGTCNLQRGTVLKECAFLSQRAPQPRVLPPPLGKPNFGASFKTTWKKVKKTPYSACAQGIPFPRGPPHKPIGVFNRDIRGGVPPKTKRGLFDNKKKNPLLYPVVPPPREGNLFSLNPLPQFEGAPLKPGGIFLYVSFAKKKKKLID

SEQ ID NO: 50851 - DNA, 775 bp, Zea mays
  misc_feature: Ceres CLONE 1464441-F
  misc_feature: Encodes the peptide sequence at SEQ ID NO. 50852
  misc_feature (207)..(207): n is a, c, t, g, unknown, or other
  misc_feature (378)..(378): n is a, c, t, g, unknown, or other
  misc_feature (379)..(379): n is a, c, t, g, unknown, or other
aaagctggagctccccgcggtggcggccgctctagattagtggatcccccgggctgcaggaattctcacgagaccattacctataacatcctagtcgaaaacccatttcgaagcccaccgaattccctgcgattcctctcccatcgtgtcctcgtctccccctaagggatcgtcagagaggaataggaaagaggggcgtatcatccnacttaaagaagccatgaagcacacggaggcggggcgccaggatgcagaggagaccatcctctgcctcaataactgtggcttcttcgacaacgcggagaccatgaacatgtgctccccgtgccacaaggagatcataacgaagtcagatcgagccgagctggatgccttatnnaaccaccgcttcgtgaacggcacctatcctgtaatggagtcccccgctgccggcaggtaatcgggagcaactgctccccaatttgatttgcaaacaatgaacgtgtagcagaccggtgatgttgccggatccgccgagggggtggtggttatctccaagggggggaaggtagggccaaaccagcgcacctcctgcagggagagggtcggactgaccgaattcaactgccggggtgggaacttgtactgcgtactccaccgcttctccgacaagcacgacttgcagttcgtctacgggactggcgaccgggacgggcggtgccaaggccaatccgggggtggaagggagacaaacttcgacaagatcttagggggggttccttaacgatggggtatc

SEQ ID NO: 50852 - protein, 72 aa, Zea mays
  misc_feature: Ceres CLONE 1464441-F
  misc_feature (14)..(38): Pfam Name: zf-A20 Pfam Description: A20-like zinc finger
  misc_feature (53)..(53): Xaa is any aa, unknown, or other
MKHTEAGRQDAEETILCLNNCGFFDNAETMNMCSPCHKEIITKSDRAELDALXNHRFVNGTYPVMESPAAGR

SEQ ID NO: 50853 - DNA, 788 bp, Zea mays
  misc_feature: Ceres CLONE 1464446-F
  misc_feature: Encodes the peptide sequence at SEQ ID NO. 50854
  misc_feature (428)..(428): n is a, c, t, g, unknown, or other
  misc_feature (431)..(431): n is a, c, t, g, unknown, or other
  misc_feature (432)..(432): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaaaacgcgcacctccctttccccaactcaatctagcatctacggtttcaagctcatggctctcctcctccgctatgatgcccaacaacatgggtaaggaaggcaagaaccggaagccaggaaagaaccaggctgacgacgaccagcgcgagctcctcttcatggaagacggacatgagaacgcgcaggtgacccggatgctcgccaacgggcggtgcgaggccatctgcgtcgatggcacgcgccgcctctgccatatccggggtaagatgctcgagaaggactgaatctcggatggtgacatcatgatcttcccccccggcccccancannacaacaaggccaacgttcccctccactacatgaacaacaaggcacgcctgctcaatgcctacggagagcttcctgacaccctcaggctcaacgagggcgtcaacttcgatggaccctacgaaagcgaggagggcagcgactacatccagttcgaggacgaagacntcgaccagatctaaaaaaatctgttcgtggcttacagctacctgtgattggtccctgcccggattcttcggaatactggttggccgtttcccttcatccctaccacgaccttgaactcgcttttgcctagacaccgctttaaccctgagtctatgttgtaaaaagggacctgaacctggttatatttattg

SEQ ID NO: 50854 - protein, 69 aa, Zea mays
  misc_feature: Ceres CLONE 1464446-F
MPNNMGKEGKNRKPGKNQADDDQRELLFMEDGHENAQVTRMLANGRCEAICVDGTRRLCHIRGKMLEKD

SEQ ID NO: 50855 - DNA, 790 bp, Zea mays
  misc_feature: Ceres CLONE 1464447-F
  misc_feature: Encodes the peptide sequence at SEQ ID NO. 50856
ctggagctccccgcggtggcggccgctctagaactagtggatcccccgggctgcaggaattcgcacgagaccattacctacaacatcctgatcgaaaaagtcctctccctccctcactcactaagccaaagctgacagcagcatacaagcaccagcagagctcttgccgatggcggtggccaagcccccgcttcagacggccgcggtcctcctcctcctcctcctggtcgtcgcggccgcgtcgtggctccagaccgtcaacgccgcttcagggttctgctcgagcaagtgcatcgtccggtgcgggcgtgcggctagcgcacgggcgcgaggcgcgtgcatgaggtcctgcggcctctgctgcgaggagtgcaactgcgtgcccacgctgacgtcgcgcgacgtcgacgagtgcccctgctaccgcgacatgttcaccgcgggcccaggtagaagccctagtgccccatgagacggctcacaccgggcgcacccaatgaccgtgctccatgggactgccacttgcttgcctggaactgcaatccgatccaagctgatggggcaggaaccctgttatgccttccctaccctaatacaagaaattggggacgtacgatttcttgaaggcctccccggcccccggggtcctaaaaatttactccgctcccccgcccccacaaattccttgttctgtaaaacccacccccctagggggcgccattccccctttgttaaaaagccgcctccccccacaagggggagagaaagaacccccggcaaaaaaaagaaa

SEQ ID NO: 50856 - protein, 100 aa, Zea mays
  misc_feature: Ceres CLONE 1464447-F
  misc_feature (8)..(97): Pfam Name: GASA Pfam Description: Gibberellin regulated protein
MAVAKPPLQTAAVLLLLLLVVAAASWLQTVNAASGFCSSKCIVRCGRAASARARGACMRSCGLCCEECNCVPTLTSRDVDECPCYRDMFTAGPGRSPSAP

SEQ ID NO: 50857 - DNA, 790 bp, Zea mays
  misc_feature: Ceres CLONE 1464452-F
  misc_feature: Encodes the peptide sequence at SEQ ID NO. 50858
  misc_feature (588)..(588): n is a, c, t, g, unknown, or other
aaagctggagctccccgcggtggcggccgctctagaactagtggatcccccgggctgcaggaattcgcacgagaccattacctagaacatcctaatcgaaaaaacaggaaaaaaggcccagaggcagtgccgtgaccgattcgagacgcaagagaaggatcgagacgaggcggcggttttccggggcagcatcgtctcggccacgaagatgtcttactcaaggggctcaagtgaaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggattgagatctggagaagcacttctccactgagggtgaggtgattgaccacccccccgtgtatgatccttggacaagggaatcacgggggtttggttttgttaccatggctgctggtaaggatgcagatcgctgcatcaaaatctggaccgttcctgtgttgcagggcgggccatacctgttgaaaagggctctggccatttgaagattttgttgacaacaacngggtaaaatggtggtagctgcttctgcagcaaattgatcagcttaaaccccgaccctgcccaacctccgcccaagggccaaagagaagcggagggttaacccccaaacccggggagaggatctttgtccaaaatctctcccgtgggacgggggttcccccgaaagcctctccccctggacgggggggccgctaacagtcccc

SEQ ID NO: 50858 - protein, 53 aa, Zea mays
  misc_feature: Ceres CLONE 1464452-F
MSYSRGSSERYGSRSPYSRSTRYRSRSRSVDSSDAENPGNNLYVTGLSARVTD

SEQ ID NO: 50859 - DNA, 781 bp, Zea mays
  misc_feature: Ceres CLONE 1464462-F
  misc_feature: Encodes the peptide sequence at SEQ ID NO. 50860
  misc_feature (288)..(288): n is a, c, t, g, unknown, or other
  misc_feature (581)..(581): n is a, c, t, g, unknown, or other
atagctggagctccccgcggtggcggccgctctagaactagtggatcccccgggctgcaggaattcgcacgagaccattacctagaacatcctaatcgaaaaatgaagaagaccagttcccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggnagcgaacagaaagccagggacgcagtgctctaccactacaagaacgccggcagcggcttctccgcgaagctcaccccccagcaggtcaaggatctccagggagcacccacgggttctcccagttgcgcccaaccaaacttacaaactaaatgggtcttgggtttggcacctccccagggcccgaaccaaccctttggggcctttattggaaggcgtttcgaaaatccaaaaaaaaatgtggttttgaataggcccggttggcgcaccggccccaccaaaagggtttaaaaccnggtccctttttaaaaaaaaggggacggtttccccccaaaatactgggtttggcccttgtttcaccccccggctaaaaagctttgttaaacgcccaaagcgccttttgtttttctctgccgaagggccggggggcgcccacaaaaaaaaaaaaaaaaaaatctttttttaattcccccccccccccctgcgggggggggcc

SEQ ID NO: 50860 - protein, 157 aa, Zea mays
  misc_feature: Ceres CLONE 1464462-F
  misc_feature (35)..(112): Pfam Name: Subtilisin_N Pfam Description: Subtilisin N-terminal Region
MKKTSSPLLIVLFLTAAAMAAEPEKQAAPAAQETAVHIVYVDRPEDADPEEFHIRTLTPVLGSEQKARDAVLYHYKNAGSGFSAKLTPQQVKDLQGAPTGSPSCAQPNLQTKWVLGLAPPQGPNQPFGAFIGRRFENPKKNVVLNRPGWRTGPTKRV

SEQ ID NO: 50861 - DNA, 749 bp, Zea mays
  misc_feature: Ceres CLONE 1464463-F
  misc_feature: Encodes the peptide sequence at SEQ ID NO. 50862
  misc_feature (412)..(412): n is a, c, t, g, unknown, or other
  misc_feature (417)..(417): n is a, c, t, g, unknown, or other
  misc_feature (423)..(423): n is a, c, t, g, unknown, or other
  misc_feature (426)..(426): n is a, c, t, g, unknown, or other
aagctggagctccccgcggtggcggccgctctagaactagtggatcccccgggctgcaggaattcgcacgagaccattacctagaacatcctaatcgaaaactccttcgtttgcccatcctcgtgacggctcctcgccagtcgcctcgtctctccctgccgcgtcgcctcgtctctccctgccgcgtcgcctccagttccgacgccagcgcgcctcccgcctccgccgcgcctgacgaacgcagtgactgtgcaggtagagaggaggagggtccggcgagatggggatgcgagataagaagcggaaccagaagcgagtgctcgcgcgccgtaccgcggtaccgcgcccaggcgagggcaaggacttcctgccgctggaaggaggccccggtaagaagctccggaaggtgcgnccctnctcaanagncccgaaacacagccacagtcgtctacattgggcatatcccccatggtttctacgaggacgagatgaaagggttctttaagcagtttggggatattaagaggcttaggatcgctcgtaaccgcaagacaggaaagtccaagcactatggattcattgagtttgagaaccctgctgtggcaaaggtcgtagcagatgagatgaataactatctcttgtttgagcgcacctttgcagttgcacttgttgagccagagaaagtttctcctaaattatggaaaggggtgcgaaggggatttatacctgttggtccgagtaccatttga

SEQ ID NO: 50862 - protein, 248 aa, Zea mays
  misc_feature: Ceres CLONE 1464463-F
  misc_feature (149)..(220): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (137)..(137): Xaa is any aa, unknown, or other
  misc_feature (139)..(139): Xaa is any aa, unknown, or other
  misc_feature (141)..(141): Xaa is any aa, unknown, or other
  misc_feature (142)..(142): Xaa is any aa, unknown, or other
AGAPRGGGRSRTSGSPGLQEFARDHYLEHPNRKLLRLPILVTAPRQSPRLSLPRRLVSPCRVASSSDASAPPASAAPDERSDCAGREEEGPARWGCEIRSGTRSECSRAVPRYRAQARARTSCRWKEAPVRSSGRCXPXQXXRNTATVVYIGHIPHGFYEDEMKGFFKQFGDIKRLRIARNRKTGKSKHYGFIEFENPAVAKVVADEMNNYLLFERTFAVALVEPEKVSPKLWKGVRRGFIPVGPSTI

SEQ ID NO: 50863 - DNA, 863 bp, Zea mays
  misc_feature: Ceres CLONE 1464467-F
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (9)..(9): n is a, c, t, g, unknown, or other
  misc_feature (77)..(77): n is a, c, t, g, unknown, or other
  misc_feature (220)..(220): n is a, c, t, g, unknown, or other
  misc_feature (414)..(414): n is a, c, t, g, unknown, or other
  misc_feature (416)..(416): n is a, c, t, g, unknown, or other
  misc_feature (424)..(424): n is a, c, t, g, unknown, or other
  misc_feature (476)..(476): n is a, c, t, g, unknown, or other
nnaaattnnaaccaagctgggacaactgcggtggcggccgctctagactagtggatcccctgggctgcaggaattcncacgagaccattacctagaacatcctaatcgaaaaacccaactccgtgccctctctcccgggccaaatagatctttcccccgtcctccctcgcctttgcctagggcgggaggagatttccaccaccaccgccgaaccgccccnaccctcctcctctgttgggatatggctgaactgtcgtcttcaagggtggactgtccgggacccgactgggtgggagctttttctcccgccgagggaaggaggaaatgttttaattctttcttgctcaggtatgttgcccataaggtttcgggagtatttttttgtggatgttttatgagggggggagggggagncncccccaanaccccccccccccccccccccggtgagtgggggtccccaccccccccccccncaaacccggctccgagggtccaatccttatatgggggggggctgattgttaatatctctcacaccgcccctgagaccccgtctaccgtcgctggcgctccccacccgcgccgcctcctggtcttatggtctaccagaaactctgagcgcccagggtcgtcgcccacccacagcactaatgcacccgtccgcgcgcaaactaccggtcgggctgcctccccccctctggcgccccactcaccttcacaatcccaaccgccacgcgatcacctcgccacaccaccgttaaaaccggaccccccccacaaactcgttccaacccatccctatgtaccacgttcgcgcatgtcttagacctgctggcttcgatatggacccctctgcgctc

SEQ ID NO: 50864 - DNA, 718 bp, Zea mays
  misc_feature: Ceres CLONE 1464472-F
  misc_feature: Encodes the peptide sequence at SEQ ID NO. 50865
ggagctccccgcggtggcggccgctctagaactagtggatcccccgggctgcaggaattcgcacgagaccattacctagaacatcctaatcgaaaactctcttcttgcccttccttcccccaacccacacagcctcactaggggtctaccggcggcggcaacgagatggtgcagcgcctcacctaccgaaagcgtcacagctacgcgacaaaatccaatcagacccgggtcgtgaaaaccccaggtgggaagcttgtgtaccaatacaccaagaagagggcgagcggtcccaagtgccccgtcaccgggaagaagatccaggggatcccccacttgagacctgccgagtacaagaggtccaggttgtctagaaaccacacgactgttaaccgtccttatggcggagcactcctctggaattgctgttagaggagagaattatccgtgctttcttggttgaggagcagaagattgtcaagaaggtcctgaaaatacagaaaaccaaggacaagacagctgcaaagtagagctccaggaatggaagcctagacactgcgagaagtaattttggtggatggaaaatatgtttgccttgtgtcgagcatttagcatgtgagacatgcctgttgaagtgtttgagtttagagaccgcgatccctttcacctttgaattgccgctatgccgggacatctgcccccctaattgctttgttaagaa

SEQ ID NO: 50865 - protein, 87 aa, Zea mays
  misc_feature: Ceres CLONE 1464472-F
  misc_feature (5)..(86): Pfam Name: Ribosomal_L34e Pfam Description: Ribosomal protein L34e
MVQRLTYRKRHSYATKSNQTRVVKTPGGKLVYQYTKKRASGPKCPVTGKKIQGIPHLRPAEYKRSRLSRNHTTVNRPYGGALLWNCC

SEQ ID NO: 50866 - DNA, 755 bp, Zea mays
  misc_feature: Ceres CLONE 1464475-F
  misc_feature: Encodes the peptide sequence at SEQ ID NO. 50867
ctggagctccccgcggtggcggccgctctagaactagtggatcccccgggctgcaggaattcgcacgagaccattacctagaacatcctaatcgaaaaatttgaacctgtcgccggagatcgcaaatgaaatcaagcaagcggaagcacagataaagcgaagaatgggcattggaagccacatatctgagcgacggctgattgatggactaaacaggatgggaatgaacgaatccattgtgagaagagctcttctgattatgcatcaaagagacgaggtggagtacaagagagagcgccatgtgatcgtccggaaggcttgatgtggagagtccagtcagactcattcatggcatacaacgaacgttcatggcgtcctctcctcagacgcgtccataccttcactgagactgcacatctgtccgtcctgaggggacgagacacgccttagttggtctctgacatgactgactgttgtaatcagcaaacggcttgagcatgtaggctctgtttttgaagtgaccaaaggttctgattgaacctgtagtgtgccgtgtaactggtcaaatcattctgaaatgcaaaattttggttccttccccaaaaaaaaaaaaaaaaaaattttttttcccccccccccccccgggggggggggggggcgcccccccccccccccccaagagaaaaaaaaacccccccccccgcccccgcccttttttttttttttttgggggggggggaggggggggggggggg

SEQ ID NO: 50867 - protein, 52 aa, Zea mays
  misc_feature: Ceres CLONE 1464475-F
MGIGSHISERRLIDGLNRMGMNESIVRRALLIMHQRDEVEYKRERHVIVRKA

SEQ ID NO: 50868 - DNA, 765 bp, Zea mays
  misc_feature: Ceres CLONE 1464477-F
  misc_feature: Encodes the peptide sequence at SEQ ID NO. 50869
aagctggagctccccgcggtggcggccgctctagaactagtggatcccccgggctgcaggaattcgcacgagaccattacctagaacatcctaatcgaaaaaattttcgaagaaacaacgaatcccgcctcaagaccacgcgagtgcgcaaggggaagcaggaatacatccgttcccggcctccgcgagtgcgcaaggggaagcaggaatacatccgttcccggcctccgctcagccgtcgatcgatcgttcgtctggtccaggggcgtctcagttggccggggcgatggaggaggacccgctcatccagctggtgcacgtctggagcaacgccgcctgagacaacgccgccgcctcatcctccgtgtgtcacgcccattccccggcgcccgcgagcgcccgcgagggaagagggggacaaagagaacctccggcccgagcccgacgttgacgcggagatcggccacatcgaggcggagatcctgcgcttgtcctcccagctccaccacctccgcacctcccagcagctgcagccgcctaaatgcgcagaggtcgcacccgcgcccccaacgaaggcggaggcagcgcgcccgcggccccgggggcgcaccctgggaccgcttcaaatcgtcgctgccgtccacccctacctgctcaccaatgacaaacagcagccgccgcgacccgtcgaaggggtgtaagcctatctagcaggcccccgccgggggcacaaagggaagggcttcctcccttccgccccctcgg

SEQ ID NO: 50869 - protein, 232 aa, Zea mays
  misc_feature: Ceres CLONE 1464477-F
AGAPRGGGRSRTSGSPGLQEFARDHYLEHPNRKNFRRNNESRLKTTRVRKGKQEYIRSRPPRVRKGKQEYIRSRPPLSRRSIVRLVQGRLSWPGRWRRTRSSSWCTSGATPPETTPPPHPPCVTPIPRRPRAPAREEGDKENLRPEPDVDAEIGHIEAEILRLSSQLHHLRTSQQLQPPKCAEVAPAPPTKAEAARPRPRGRTLGPLQIVAAVHPYLLTNDKQQPPRPVEGV

SEQ ID NO: 50870 - DNA, 735 bp, Zea mays
  misc_feature: Ceres CLONE 1464483-F
  misc_feature: Encodes the peptide sequence at SEQ ID NO. 50871
ggagctccccgcggtggcggccgctctataactagtggatcccccgggctgcaggaattcgcacgagaccattacctagaacatcctaatcgaaaaacatttccactccaccgtttcagcagcaccagcaacacagccaaagcccaaagaggcggcagcagcagcccggcctgttcccatggctcctctgctgttcagggacatgaaggggctgtcgtgctcgtccccggcgtccacggcgatatgcccgagcctggagcggcagccgatggtccggccacacaaggccattgccagtgccagccccctgtctcacgtccctgccgcgcccaggacacaccggcacgacggcaagaaagggcggcagtatgaagagctgcagcagcgaaaggctgtcgttgtcggaaacccccctcgcctcctcagtccggctggctcgtcccgctacttgctgagcggccgcttcgccgccaccgaggagatccaggaggtggagtctgccccggccgtcgacgtcaagcccaagcgggaggaagcaggtgaagctgctgatgcaaaaagcgcccaggcgcaagagcaggtggttgtgctcaaggtatccctgcactgcaaagcatgccccgggaaagtgaagaagcacctctccaagatggaaggcgtgaacgtctttaacatcgactttcccgccaataaggtgaccgggggtcggcaacgtcacgcccgctggcggaccta

SEQ ID NO: 50871 - protein, 185 aa, Zea mays
  misc_feature: Ceres CLONE 1464483-F
MAPLLFRDMKGLSCSSPASTAICPSLERQPMVRPHKAIASASPLSHVPAAPRTHRHDGKKGRQYEELQQRKAVVVGNPPRLLSPAGSSRYLLSGRFAATEEIQEVESAPAVDVKPKREEAGEAADAKSAQAQEQVVVLKVSLHCKACPGKVKKHLSKMEGVNVFNIDFPANKVTGGRQRHARWRT

SEQ ID NO: 50872 - DNA, 793 bp, Zea mays
  misc_feature: Ceres CLONE 1464484-F
  misc_feature: Encodes the peptide sequence at SEQ ID NO. 50873
  misc_feature (373)..(373): n is a, c, t, g, unknown, or other
  misc_feature (374)..(374): n is a, c, t, g, unknown, or other
  misc_feature (428)..(428): n is a, c, t, g, unknown, or other
aagctggagctccccgcggtggcggccgctctttactagtggatcccccgggctgcaggatttcgcacgagacctttacctagaacatcctaatcgaaaaataagcacactgtgcattgcgccgacatctctccactccccaagaactggcccagtcacccggacctagtcactcccaagcaggcaagcggcctcgccaaaaacttactccggtaaaatatggtcatccgaggccaggacctggatattgccctaccccaccacccccgtcgcatctccgacttccccctgtaggccttggtgtcccccgaccaagccccggagccagatctgccgcggtaccactaccttccggtccacgagcggaggaaanncaagccgactgatgcgctcctctgggaggtgggcgccccttcctgtggcctagnagccaccaagccagacaaggccgggcggggccccactattttgttccagaaggagaacggacaggagggccgctagtagtgccccctcatcgtccaccgccacccgatccgtcgggtgttctaccacccccggatggctttcttgcaccacaggcagaagaagccaccaggtttggccataacatgcatgggcatggcgaacgcgatcggagggcgtggccccctctctccttgaggagtgtgactgtgttcaaagcgctatgtgacgaactagccggatattccaattggttttataccttccttcgtttaagttgtggtttgttagaaatctaacggctccgtcaggaatgtcgcttggggaa

SEQ ID NO: 50873 - protein, 33 aa, Zea mays
  misc_feature: Ceres CLONE 1464484-F
MAFLHHRQKKPPGLAITCMGMANAIGGRGPLSP

SEQ ID NO: 50874 - DNA, 768 bp, Zea mays
  misc_feature: Ceres CLONE 1464490-F
  misc_feature: Encodes the peptide sequence at SEQ ID NO. 50875
  misc_feature (369)..(369): n is a, c, t, g, unknown, or other
  misc_feature (373)..(373): n is a, c, t, g, unknown, or other
aaagctggagctccccgcggtggcggccgctctataactagtggatcccccgggctgcaggaattcgcacgagaccattacctagaacatcctaatcgaaaaaccccgcgtcccaccaacttccattccctaccgcccgcccaccccactccactccgctcctcccactcgagccatcatggccctcgcctcccgcgccgccgcagccgccgtggcgtgcgtcctcctggcgctcgccgcctccgccgcgggggcgggctccaactcccctgcaccggcgccggcggtggactgtatctcccaggccgccagcctgatcgactgcatcgactacgtccagaaggggagcagcgcgcgccgtccgtccgntgantgctgcggcgaggtcaagaccgcagtggccagccccgtcatcgtgggctgcctctgctccctcgccggctccaactccagtaacctgggctttcccatcgacatgaagcgcgtgctggcgctccccggcgcgtgcggcgcgtccaacgccgccttcaggaagtgcaacatttccgcgcttcccccaaccgaagcacctgcaccgtccgccgccggggggtcatccagcggtggcgcggcggcatcttcacccgccgccgcggcggggagctctccctccatgacggcgaacgccctgtttgctggccggggccggctcccctgctcccctactactgctgctacctcttctgagggtttcctttcggtggctgcctgccgctctaacttaataaa

SEQ ID NO: 50875 - protein, 196 aa, Zea mays
  misc_feature: Ceres CLONE 1464490-F
  misc_feature (64)..(64): Xaa is any aa, unknown, or other
  misc_feature (65)..(65): Xaa is any aa, unknown, or other
MALASRAAAAAVACVLLALAASAAGAGSNSPAPAPAVDCISQAASLIDCIDYVQKGSSARRPSXXCCGEVKTAVASPVIVGCLCSLAGSNSSNLGFPIDMKRVLALPGACGASNAAFRKCNISALPPTEAPAPSAAGGSSSGGAAASSPAAAAGSSPSMTANALFAGRGRLPCSPTTAATSSEGFLSVAACRSNLI

SEQ ID NO: 50876 - DNA, 751 bp, Zea mays
  misc_feature: Ceres CLONE 1464492-F
  misc_feature: Encodes the peptide sequence at SEQ ID NO. 50877
ctggagctcaccgcggtggcggccgctctagaactagtggatcccccgggctgcaggaattcgcacgagaccattacctagaacatcctaaccgaaaaccggtcgttcccgtctccctcctcgcgtcgcgtccaccattgttcctgtcgacgctgcgccgcacggctcgcaccgccgacagtgcctcagtcctatcgagcctccctcttcccagatcaggccctagctgggctacagccgccgccgccgctgccgcatccgtcaccttcacaccgcgtgcgcgcgcgctctctctctctctctctctttgcgacgactggacgggctaccgcagtcgccaccataggcaccacgcccttcgctgatctattcgctggcgaagaacgctctcaataagatcgatggagtgcgccgcgcagggaatcatcgagaaccagcatgtcgatgctcttgaggttctactccagggactctctggtgtcccgaaagagcgttttagggtgcatgagctctgccttaaaagtgggcccaatctaggtgttgtcccatcggaggttcgtttgttgtgtgacttagctcagcccacaccatcctggtaaccgagacaagctgctgaaagtctaccttttgttatgtttatcattaattgcgacaagattgtaggaccataagacatgttggtggtgccatgagaggtgctggtgcggagcaaatctcagctctggttcgtacagttgtggagagcaaagct

SEQ ID NO: 50877 - protein, 65 aa, Zea mays
  misc_feature: Ceres CLONE 1464492-F
MECAAQGIIENQHVDALEVLLQGLSGVPKERFRVHELCLKSGPNLGVVPSEVRLLCDLAQPTPSW

SEQ ID NO: 50878 - DNA, 733 bp, Zea mays
  misc_feature: Ceres CLONE 1464494-F
  misc_feature: Encodes the peptide sequence at SEQ ID NO. 50879
aaagctggagctccccgcggtggcggccgctctagaactagtggatcccccgggctgcaggaattcgcacgagaccattacctagaacatcctaatcgaaaagttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcggatggcacccctgtggtcaagacctctattggtgggactacaccaccccgccgactttgtgttggaaacaagaatggacttctattgccacatactacaaccgaccaagagcttcagcatctgaggaattgcttgcctgatcaagtggtggttcagcgcattgatgagaggttatctgcccttgcgcattgcatagcctgcaatgaccatgttgcgcttactctccctgaccttgactaggagactgaggagttcattgcagatgtggcttggggtcgaggtgtctaggcagactattgctggaaatagccttggtggggagttactgcgccttctctaacaggggtgggtttggtcctccccatt

SEQ ID NO: 50879 - protein, 122 aa, Zea mays
  misc_feature: Ceres CLONE 1464494-F
  misc_feature (3)..(122): Pfam Name: eIF-6 Pfam Description: eIF-6 family
MATRIQFENNCEIGVFSKLTNAYCLVAIGGSENFYSAFEAELADGTPVVKTSIGGTTPPRRLCVGNKNGLLLPHTTTDQELQHLRNCLPDQVVVQRIDERLSALAHCIACNDHVALTLPDLD

SEQ ID NO: 50880 - DNA, 731 bp, Zea mays
  misc_feature: Ceres CLONE 1464495-F
  misc_feature: Encodes the peptide sequence at SEQ ID NO. 50881
ggagctccccgcggtggcggccgctctagaactagtggatcccccgggctgcaggaattcgcacgagaccattacctagaacatcctaatcgaaaaccatgcttcacaacaccaggatctgggtgagtcgcgtggcgcgctctatatacaagtgcggttctccactgcaggactctccctctccctcttcttcctcctcctcctcttcctctgttttgcttttgtgttgctgttaggttcttggatagtttgatgaatgatactgtgcagcagcagcagcagtagtaattcatagtgggcggtgtgatagcagcagtgagatcgaggagaggatggaggtgttcatccacgaggactacgtgaacaagcgcaacgagctgaggagggagcagaggcgccgggaactccacacgctgcaggtggagagcaaccccgacgcgtccagggaggcgctggcaagccgggagagcccgaggacgccggcccagtgcctgacgccgaccggcgcgtcgccgtccagcttcagatccccgacttcgaggagcacgctgcagtcgccggccgcagcggcggggcaggctgccggttggccgtcggagcatcgccgcctctacgactgcctcaagccgtactagtaggtaggcggacgtggagtggcctcaatccggctgcatacacggccagacgtggcatggcatggcatgtcgtccaaccgaataaagcgtggagac

SEQ ID NO: 50881 - protein, 100 aa, Zea mays
  misc_feature: Ceres CLONE 1464495-F
MEVFIHEDYVNKRNELRREQRRRELHTLQVESNPDASREALASRESPRTPAQCLTPTGASPSSFRSPTSRSTLQSPAAAAGQAAGWPSEHRRLYDCLKPY

SEQ ID NO: 50882 - DNA, 864 bp, Zea mays
  misc_feature: Ceres CLONE 1464497-F
  misc_feature: Encodes the peptide sequence at SEQ ID NO. 50883
ggagctccccgcggtggcggccgctctagaactagtggatcccccgggctgcaggaattcgcacgagaccattacctagaacatcctaatcgaaaagtgccattgccattcacctccagccaggctacggaaccttatcaccaaaatcctcgtcccctacccgaggcgagcatcatggcggccgcgctcttctccagctcgctctcgccccgcttcctcgccctatcctccccgaagccggccgcgcccgcggccacagccttcctccccttcaggctgccgccgcgcgctgtctcggcgccgggtaggcgggtcttcaagcccgtggccctcgcggtgtcgtcggaataccagacggagggcccggaacccgaaggggggagaatggatcccaaggagttcttcggtgccacacccccccgttccgtcgggaaaccataccatttttaccttttaacaacccctaaacctcggagggggctcattcaaggagggggcgggtcccccccccacaatgggtaggagggttggaaaattgaaccaaaatggccttggggccgggaaccccagggagattgagtatcccggagaaaatgggtttttcgcgcgcaaaaataaaccccaaactcggttttgtggggcgtttttacacgggttttttcttttctcggaaaaaaaccctctggggtagaaatttgtggggcccccccccccttgggagtaatctctcccccacataaccacctgggggtgttggtgtgtgggtccccccctcttcttctctaacaccaccaaagggtccgcccggcacacgtgggtgggggggtagccaccaccctggataaagcacttcccgcggggggt

SEQ ID NO: 50883 - protein, 115 aa, Zea mays
  misc_feature: Ceres CLONE 1464497-F
MAAALFSSSLSPRFLALSSPKPAAPAATAFLPFRLPPRAVSAPGRRVFKPVALAVSSEYQTEGPEPEGGRMDPKEFFGATPPRSVGKPYHFYLLTTPKPRRGLIQGGGGSPPHNG

SEQ ID NO: 50884 - DNA, 768 bp, Zea mays
  misc_feature: Ceres CLONE 1464498-F
  misc_feature: Encodes the peptide sequence at SEQ ID NO. 50885
  misc_feature (764)..(764): n is a, c, t, g, unknown, or other
  misc_feature (768)..(768): n is a, c, t, g, unknown, or other
aagctggagctccccgcggtggcggccgctctagaactagtggatcccccgggctgcaggaattcgcacgagaccattacctagaacatcctaatcgaaaaaagacacacacgcgcgcgaacacgaacagggacacgagacagcggcggccatggcgagaggcggcggcgatcggagtcgggaggatgaccccttctccgacggcggcaccaccggaaccgactcggacgagtcctctccgcgtggggtgggggccctcggccccggctccacctccaacccgatcctgacacgcctcgcggtgtcgcggaacccgagcccgctggctgcggccaccgcggccccaggggtctgcctcctccgcttcgcctgggagtccgccgcgggctccctcgtcggcgccgccgttggctacccccaaggtttggttacgatgaaggggattaaaggctcatttgctgatgctgcgtcatctgctaagatatttgctgttcttgctggtgttcaaagtttagtagcctgctctttgagaaaactacgtggaaaagatgatggaatcaatgcaggagtcgcaggctgttgcactggccttgctctgagctttccaggtgcaccacaaactctgattcagagctgcctgacctttgggactttctcttacatcattgagaagctaaacaagcagcaacctgcgctggcgctcccacctgcgacaggtgtgatggatccgaaggctggacaaagcgttcttcctcccctcacanctcn

SEQ ID NO: 50885 - protein, 204 aa, Zea mays
  misc_feature: Ceres CLONE 1464498-F
  misc_feature (61)..(179): Pfam Name: Tim17 Pfam Description: Tim17/Tim22/Tim23 family
MARGGGDRSREDDPFSDGGTTGTDSDESSPRGVGALGPGSTSNPILTRLAVSRNPSPLAAATAAPGVCLLRFAWESAAGSLVGAAVGYPQGLVTMKGIKGSFADAASSAKIFAVLAGVQSLVACSLRKLRGKDDGINAGVAGCCTGLALSFPGAPQTLIQSCLTFGTFSYIIEKLNKQQPALALPPATGVMDPKAGQSVLPPLT

SEQ ID NO: 50886 - DNA, 768 bp, Zea mays
  misc_feature: Ceres CLONE 1464501-F
  misc_feature: Encodes the peptide sequence at SEQ ID NO. 50887
  misc_feature (642)..(642): n is a, c, t, g, unknown, or other
  misc_feature (711)..(711): n is a, c, t, g, unknown, or other
  misc_feature (712)..(712): n is a, c, t, g, unknown, or other
  misc_feature (757)..(757): n is a, c, t, g, unknown, or other
aaagctggagctccccgcggtggcggccgctctagaactagtggatcccccgggctgcaggaattcgcacgagaccattacctagaacatcctaatcgaaaagaccatgaaactcagttgaaggcatctcgcgacgtaaggtggcaaacatgtgtcactagatatgttgcttcagtgctccattttgaatgtttgaatccatagttgcaaatgccatggctgcaaaagcaaagttgctattgcgggagctgaaaactgtgaaggcagatttagcttttgcaaaggaacgatgtgctcagcttgaagaagagaataaaatgttgcgtgagagttatgacaagggtgataatccagaagatgatgatctgatccgcctccagttggaaacactactagctgagaaagcacggcttgcgcatgagaactcagtatatgcacgagaaaacagattcctgcgggaaatagttgagtatcaccagctcactatgcaggatgtcatatatgtagacgaaggcatcgaagaggtcaccgaggtgtaccctacacaagtactacctcgcactgggtcgagcgtcagtcgtgcagccactgcagctacaccgaaatctgctccgacgtcaacataatcttgccctgtcgtancagctttctacaatacacttttttcgcggtcatctctgagcaatagatcaaagcgcccacctccaaccnntcacgaagagtaaggtggttgtttggttgtgacgggaccacatangttatgctgct

SEQ ID NO: 50887 - protein, 145 aa, Zea mays
  misc_feature: Ceres CLONE 1464501-F
MFESIVANAMAAKAKLLLRELKTVKADLAFAKERCAQLEEENKMLRESYDKGDNPEDDDLIRLQLETLLAEKARLAHENSVYARENRFLREIVEYHQLTMQDVIYVDEGIEEVTEVYPTQVLPRTGSSVSRAATAATPKSAPTST

SEQ ID NO: 50888 - DNA, 503 bp, Zea mays
  misc_feature: Ceres CLONE 1464508-F
  misc_feature: Encodes the peptide sequence at SEQ ID NO. 50889
  misc_feature (213)..(213): n is a, c, t, g, unknown, or other
aactggagctccccgcggtggcggccgctctagactagtggatcccccgggctgcaggaattcgcacgagaccattacctagaacatcctaatcgaaaaacccacccgccgacgagcaaaccctagcgagcgagagagcccggagccgagagaccgccagccatggcgctgcgtgcctgtacacgagatccggacatgaggtcgcgactgccngcttacctgagcgccttgactgggacacgtcaaaaagcgcaaccagccgctcacgctactcgaaaggaatcgaccaagtcccggacctcccaaccggtgggtggagggagaactttccttttccccccggccgggggggggcccttgccccttgaccccaggaaggccgggggaaaacctaaccccgccccccccccccgcgagggggggggggggggttttttggggccttttagccaagcttcttttttctcgtggggggtcccccacctgtttttcttgttcgtggt

SEQ ID NO: 50889 - protein, 113 aa, Zea mays
  misc_feature: Ceres CLONE 1464508-F
MALRACTRDPDMRSRLPAYLSALTGTRQKAQPAAHATRKESTKSRTSQPVGGGRTFLFPPAGGGPLPLDPRKAGGKPNPAPPPREGGGGGFLGPFSQASFFSWGVPHLFFLFV

SEQ ID NO: 50890 - DNA, 784 bp, Zea mays
  misc_feature: Ceres CLONE 1464512-F
  misc_feature: Encodes the peptide sequence at SEQ ID NO. 50891
  misc_feature (390)..(390): n is a, c, t, g, unknown, or other
  misc_feature (441)..(441): n is a, c, t, g, unknown, or other
  misc_feature (453)..(453): n is a, c, t, g, unknown, or other
  misc_feature (472)..(472): n is a, c, t, g, unknown, or other
  misc_feature (475)..(475): n is a, c, t, g, unknown, or other
ggagctccccgcggtggcggccgctctagaactagtggatcccccgggctgcaggaattcgcacgagaccattacctagaacatcctaatcgaaaagaacgacccacaaccagaagccacccattggcgtacgcgaggcgatcggagcatcccgtcccaagaggagaaactcccggccggcgacgcgggggaaaatggggaagaacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcangagaagccttcccacagatactaaatgggatgtcctccccagttgctgccngcttgtcccagntgaattttccatgatgggntgnataaatctggcaatgccattcctttgccccgttttagttccacccattttcccctttcccaaggctataaccggaaccgggcctgggaaaacatattttgaggctaccaaaaatagaaaccttttgccccttaaagttgtaaaaaaaagccaattttccggcaaaaaaaaaaaaaaaactttttccttcccccccaccccgggggggggcccgggccccatttccccttaaagaggggaaaaaacccccccccccgggccccttttttaaaccccgggggggggaaacacctgtgggttcccctttttc

SEQ ID NO: 50891 - protein, 65 aa, Zea mays
  misc_feature: Ceres CLONE 1464512-F
  misc_feature (58)..(58): Xaa is any aa, unknown, or other
MKAVVYALSPFQQKVMPGLWKDITTKIHHKVTENWISATLLLTPVVGTYQYAMWYKEXEKPSHRY

SEQ ID NO: 50892 - DNA, 714 bp, Zea mays
  misc_feature: Ceres CLONE 1464514-F
  misc_feature: Encodes the peptide sequence at SEQ ID NO. 50893
caccgcggtggcggccgttctataactagtggatcccccgggctgcaggaattcgcacgagaccattacctagaacatcctaatcgaaaagaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtctcctcgccggtcgctggcgccgcgtgcagggccgcgggcaaggggaaggaggtgctcagcggggtcgtgttccagcccttcgaggagatcaagggggagctcgccctcgtgccccagtccccagacaagtgggtcgcgcgccacaagttcgtcaatgactgcgaggccgccctcaacgagcacatcaacgtggagtacaacgcctcgtatgcataccactccctcttcgcctacttcaaccgcgacaacgtggctctcaaaggatttgccaagttcttcaaggaatccagcgacgaggagagggagcacgctgaaaagctcatggagtaccataacaaacgtggaggcagggtgaggctccaatcgattgtgacgcctttaaccgagtttgaccactctgaaaaaggagatgctctgtacgctatggagctggctctggccctgcgaaagctggccaatgaaaagctgcacaacctgcatggtgg

SEQ ID NO: 50893 - protein, 197 aa, Zea mays
  misc_feature: Ceres CLONE 1464514-F
  misc_feature (91)..(197): Pfam Name: Ferritin Pfam Description: Ferritin-like domain
  misc_feature: SWISSPROT Homolog: EC 1.16.3.1 Ferroxidase
MMLRVSPSPAAAVPTQLSGAPATPAPVVRVAAPRGVSSPVAGAACRAAGKGKEVLSGVVFQPFEEIKGELALVPQSPDKWVARHKFVNDCEAALNEHINVEYNASYAYHSLFAYFNRDNVALKGFAKFFKESSDEEREHAEKLMEYHNKRGGRVRLQSIVTPLTEFDHSEKGDALYAMELALALRKLANEKLHNLHG

SEQ ID NO: 50894 - DNA, 794 bp, Zea mays
  misc_feature: Ceres CLONE 1464518-F
  misc_feature: Encodes the peptide sequence at SEQ ID NO. 50895
  misc_feature (55)..(55): n is a, c, t, g, unknown, or other
aaagctggagctccaccgcggtgggcggccgctctagaactagtgggatcccccngggctgcaggaattcgcacgagaccattacctagaacatcctaatcgaaaacgccgcacccccaagacttccgtccgagtctgagctcatctccgcgcgctgccgccgccgccgccgccgctcgacgcccaccgcgcagccatggcggaacagactgagaaggctttcctcaagcagcctaaggtgttcctcagctcaaagaaatctggcaagggaaagaagccagggcagggtgggcatcgattttggaagagcattggccttgtttcaagactcccagggaagcaatttgaggcacctacattgacaagaaatgtccattcactggaaccgtttctatcaaaggccaatttattggctgaacattgccccgggcttaaatgacccaaaccctcctttgttccaaggacctttttcccctttttttaaaaatcccaaaaggtggaaaagaggggctccaaatttcccgcttccattccccccggttttcggggggaagagagggaaattgtttttttggccgcggggcgcccccataaaaagtggggggggcctgggtgtaaaaatctcccccgggatttcccggcggggagaaaaaattttcccccccccccggaaaacaaactttccccgggaaatataaaaggagtgtttttttttttaaaaaaaacccccccggggggtgcgcccccaagggggggagaggggcccctccccaaaaaacacccccaaaaaaaaa

SEQ ID NO: 50895 - protein, 80 aa, Zea mays
  misc_feature: Ceres CLONE 1464518-F
MAEQTEKAFLKQPKVFLSSKKSGKGKKPGQGGHRFWKSIGLVSRLPGKQFEAPTLTRNVHSLEPFLSKANLLAEHCPGLK

SEQ ID NO: 50896 - DNA, 753 bp, Zea mays
  misc_feature: Ceres CLONE 1464520-F
  misc_feature: Encodes the peptide sequence at SEQ ID NO. 50897
  misc_feature (685)..(685): n is a, c, t, g, unknown, or other
  misc_feature (753)..(753): n is a, c, t, g, unknown, or other
ggagctccccgcggtggcggccgctctatactagtggatcccccgggctgcaggaattcgcacgagaccattacatagaacatcctaatcgaaaaaaaaaaaaatatttgtttggtgagccacgctcccatccggatccgcgggggaggacggcgatttcgtccccagcctcatgaggtcgggaaggggttcccgcacccacatttgtgaacctcgccggcgcccatcccctgccttcacgaacccgccgccgcccgtcccctactcttcctcgtgcacccaccgtcgctcgtcccctcgtcttccttgcgcactcgccgtcgcctcctcctcaccctcacgcacttgaggccagctgcagaacgaggtcggacggcggagacgaggtcgaggtctacgacctcctcaacttgcgcaagactgccgagactgcagggacaagctctttgctgcctcgtcagctgctagctgacttctcgtttgtagtatgtgaatatcttatttgacaaagtgatacacaagggtttttcatcaacaagtggtcgccagaagaactgaaacatcaagatggcgtttgcttttaggtcatgccattcaggagatgatgctaagctaaataatcacatctatgtgtacactgagactgttttattatgagactatgttttattatgatgcaccgaanaaaaaaaaaaaaaaacttatcgataccgtcgacctcgagggggggcccggtacccaattcgccctatn

SEQ ID NO: 50897 - protein, 58 aa, Zea mays; identical to SEQ ID NO: 46606
  misc_feature: Ceres CLONE 1464520-F

SEQ ID NO: 50898 - DNA, 738 bp, Zea mays
  misc_feature: Ceres CLONE 1464529-F
  misc_feature: Encodes the peptide sequence at SEQ ID NO. 50899
  misc_feature (738)..(738): n is a, c, t, g, unknown, or other
aagctggagctccccgcggtggcggccgctcttcactagtggatcccccgggctgcaggtattcgcacgagaccattacctagaacatcctaatcgaaaagatgcgatcaccagtcaaatggacggcgcggatatcccctcccactccgccgccgatggcgaccggcctccggagaacgcggatgacggcggcgtggaggacgagcgtgccgccgcgccccctccggagcggtgcgaggcgttggcttccgcgatcgcaggggtgctgtccggcgcgctgcgggagcacgaggagcgggcggccgccaccgcccggagccaggacgaggtcgccgctgccatcgaccgcctcaacggagagctagacaggctattagagaatgcacccacaatggtaataatgcatcattccccgaggatttccagcatccgcaagaggatttcagcaatgaacatgctgctcaagtccatacagcgacgcatagatagcatggatagaattatttctactgaccattcgtctcctgtacagaaagccagtaatgaagttggaacaaggttctagcagaattctggtggtgtcccatcaattgcgcaccatttctgttttggtagagctgccatccagcaatcacacggggctgtgcgtagaagtgagacgccatagtgtcgattttttccccagagacgtgtcatcaaatatttcactcctttttgagcatattggagtggggaaan

SEQ ID NO: 50899 - protein, 148 aa, Zea mays
  misc_feature: Ceres CLONE 1464529-F
MDGADIPSHSAADGDRPPENADDGGVEDERAAAPPPERCEALASAIAGVLSGALREHEERAAATARSQDEVAAAIDRLNGELDRLLENAPTMVIMHHSPRISSIRKRISAMNMLLKSIQRRIDSMDRIISTDHSSPVQKASNEVGTRF

SEQ ID NO: 50900 - DNA, 751 bp, Zea mays
  misc_feature: Ceres CLONE 1464531-F
  misc_feature: Encodes the peptide sequence at SEQ ID NO. 50901
  misc_feature (523)..(523): n is a, c, t, g, unknown, or other
  misc_feature (612)..(612): n is a, c, t, g, unknown, or other
ggagctccccgcggtggcggccgctctataactagtggatcccccgggctgcaggaattcgcacgagaccattacctagaacatcctaatcgaaaacatcagcactgggatcaaccccaaggccaagccatactacctctttgacggctatgcccacctgtcgtctggccttgcctgtggtcttgctgggcttgctgcaggcatggccattggcatcgttggtgatgctggtgtcagggcgaacgctcagcacccgaagttgtttgttggcatgatcctcatccttatttttgctgaagcacttgccctctatggtctcatcgtcggcattatcctctcgtctcgtgccggccagtcccgcgcagattaaaggcacgtttcagatgtcaacaccgtgccgccgacacttgcctggtcgtagctgggtcatgttctatatccctgaaacaagaagctggagcactttgactctttgagaggcttacttttatgcctgtctagttttccatcttctgttgagtcnagaaaacaaaaaaggctgtgtaacccaaagggatgactttttaccttgtgccattctttttcctgtcctggtgcggggtggtttgcggntgatgcctatttatgcccagtttttgctatgatccgggctggggctgggaccttggggaaaggggtgaaaaagcaaggggacgcaccccattggaactaaaaactttttggtaaaaacccttccaaaaaaaaaaaaaaa

SEQ ID NO: 50901 - protein, 55 aa, Zea mays
  misc_feature: Ceres CLONE 1464531-F
  misc_feature (1)..(48): Pfam Name: ATP-synt_C Pfam Description: ATP synthase subunit C
  misc_feature: SWISSPROT Homolog: EC 3.6.3.14 H(+)-transporting two-sector ATPase
MAIGIVGDAGVRANAQHPKLFVGMILILIFAEALALYGLIVGIILSSRAGQSRAD

SEQ ID NO: 50902 - DNA, 745 bp, Zea mays
  misc_feature: Ceres CLONE 1464532-F
  misc_feature: Encodes the peptide sequence at SEQ ID NO. 50903
  misc_feature (642)..(642): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaaataccaaaaccatcctattcctcccaaggcaagaaaccaagaccatggctggcacggccaaaacccccgtcctcggcttcctccttgctcttgctcttgaggccacctcgacgccggctgcggccacacacactgaccctccacaacctgtgtccgtaccccgtgtggccgctggtgagcccgaacaccgggttccccgccgtctccgaaaacacgggccgcctctacggtggcgggcgcgggctggtctcattccgcttcccggacagcttctgggcaggccgcgtgctgccgcgcacgggatgcatctccagacattcccggtgcgagacagggagcgcaccaccggcgactgtggtgcacctggtgctgcacgcctagggacaagaccaggcgtcctacagcgagaacctggtggacggattcaacgtgcccgccatggtgaccccgcatgcggtgggctgctggcattgcccggccctggggtgcgcggctgacctcaacgccgggtgcccgccctcgcagccgtgcgcgggcgngnnntnnttttttttttttttttcttaaaaccacaggggaaaaccaaattggattctgaccctgaaaagggccaatcacccacaaactcctatgaaggtttgc

SEQ ID NO: 50903 - protein, 42 aa, Zea mays
  misc_feature: Ceres CLONE 1464532-F
  misc_feature (34)..(34): Xaa is any aa, unknown, or other
  misc_feature (35)..(35): Xaa is any aa, unknown, or other
  misc_feature (36)..(36): Xaa is any aa, unknown, or other
MVTPHAVGCWHCPALGCAADLNAGCPPSQPCAGXXXFFFFFS

SEQ ID NO: 50904 - DNA, 805 bp, Zea mays
  misc_feature: Ceres CLONE 1464533-F
  misc_feature: Encodes the peptide sequence at SEQ ID NO. 50905
  misc_feature (27)..(27): n is a, c, t, g, unknown, or other
ggggggcgctgggagacaaaaaagaanaactttgtatactttctttaaagctggagctccccgcggtggcggccgctctttactagtggatcccccgggctgcaggatttcgcacgagaccattacctagaacatcctaatcgaaaataaaagagcttgccatcacgaatctcacaaactacctcacaaaagagaacagagctgaagacctcaggaaccttttgacccagctcaggcccttttttgcattgatccccaaggcgaagactgcgaagattgtgcgtggcatcattgatgccgttgccaaggtgcctggaacatctcagcttcacatctcactgtgccaggagatggtagaatggacccgtgcagagaagcgaaccttcctcaggcagcgtgtggaagcaaggctggtagaccttctgttggagaatcacgaccatactgaggctcttaccctcctttctggactcatcaaggaagttaggaggctggatgacaagttgcttcttgtggacatcgaccttttggagagaaagctccatttctctctgagaaaccttccaaaggccaaagcttctctgactgctgtcagaactgcagccaatgccatttatgtgccgtcatcttcatcacgccacaattgatctgcagaggtgggatccttcatgcctgaagagaaaggattacaagatttgctcacgtgctactttcttccaaagcaattttggaagcttttcaagttcaactgggaaggatccccaagcgcctatcttatcagctttggaagatacaatgccttccg

SEQ ID NO: 50905 - protein, 98 aa, Zea mays
  misc_feature: Ceres CLONE 1464533-F
MVEWTRAEKRTFLRQRVEARLVDLLLENHDHTEALTLLSGLIKEVRRLDDKLLLVDIDLLERKLHFSLRNLPKAKASLTAVRTAANAIYVPSSSSRHN

SEQ ID NO: 50906 - DNA, 775 bp, Zea mays
  misc_feature: Ceres CLONE 1464536-F
  misc_feature: Encodes the peptide sequence at SEQ ID NO. 50907
  misc_feature (775)..(775): n is a, c, t, g, unknown, or other
aaagctggagctccccgcggtggcggccgctctagaactagtggatcccccgggctgcaggaattcgcacgagaccattacctagaacatcctaatcgaaaacaattttgcttgggtatgcatctatctgccgctcgcctccgtcgtcgccgccgcttcggttcgctcgtacgcccgtgtccttcgagtcccatccgataccgcctcatcggccgggagggcacataagacgacgtctgccccgatgtatacgacgaggaaatccgctgccgccgctgccgcggccatctccaggacgggcctaggtgcggcatttgtgggctgcgatgcggactacaggcggatcaaagggttcctctcgcggatgtgttgttcgactgtccaaggcggtgattacgaaatgcactctgcgaggctcgcgcccgcgacatcagcatgcgggtgctcttcttccagatgtaccgaatgcggatactgtgtcaacattatcgagcacatggcaatagtttggatggagaaagcgtcgatatatccgtctacagtatggaaagttagcattatacgtccagggtacactgtcagtgactgtgactcacgtacatatgatgctaacgaaacatgcgaatatgagaatttgtagatttgacattaatgtgcgggagctgccacccattgggtacaatatgtgctgctgcattgacttgacgttcagatatctatatgccaacggatcgatttgtgctcactcccccacccccggtctatatggcatgan

SEQ ID NO: 50907 - protein, 131 aa, Zea mays
  misc_feature: Ceres CLONE 1464536-F
MYTTRKSAAAAAAAISRTGLGAAFVGCDADYRRIKGFLSRMCCSTVQGGDYEMHSARLAPATSACGCSSSRCTECGYCVNIIEHMAIVWMEKASIYPSTVWKVSIIRPGYTVSDCDSRTYDANETCEYENL

SEQ ID NO: 50908 - DNA, 757 bp, Zea mays
  misc_feature: Ceres CLONE 1464540-F
  misc_feature (298)..(298): n is a, c, t, g, unknown, or other
  misc_feature (374)..(374): n is a, c, t, g, unknown, or other
  misc_feature (426)..(426): n is a, c, t, g, unknown, or other
  misc_feature (429)..(429): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (445)..(445): n is a, c, t, g, unknown, or other
  misc_feature (456)..(456): n is a, c, t, g, unknown, or other
  misc_feature (457)..(457): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (473)..(473): n is a, c, t, g, unknown, or other
  misc_feature (475)..(475): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (484)..(484): n is a, c, t, g, unknown, or other
  misc_feature (487)..(487): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (504)..(504): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (514)..(514): n is a, c, t, g, unknown, or other
  misc_feature (515)..(515): n is a, c, t, g, unknown, or other
  misc_feature (520)..(520): n is a, c, t, g, unknown, or other
  misc_feature (522)..(522): n is a, c, t, g, unknown, or other
  misc_feature (553)..(553): n is a, c, t, g, unknown, or other
  misc_feature (569)..(569): n is a, c, t, g, unknown, or other
  misc_feature (579)..(579): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (591)..(591): n is a, c, t, g, unknown, or other
  misc_feature (593)..(593): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (605)..(605): n is a, c, t, g, unknown, or other
  misc_feature (606)..(606): n is a, c, t, g, unknown, or other
  misc_feature (611)..(611): n is a, c, t, g, unknown, or other
  misc_feature (612)..(612): n is a, c, t, g, unknown, or other
aaagctggagctccccgcggtggcggccgctctataactagtggatcccccgggctgcaggaattcgcacgagaccattacctagaacatcctaatcgaaaaaccctcaccactatccattttcattcaatgcgtccgcgccgcgcgcctccattcctctcgattgcctccctcgttccttgttcaaggacctccgtgaccgtggccgagggattgacgacggaaagcgaaaatgatgctgacacgggcttcgatggggcgtgatggatgcggcggcggtggacgaggtggtgcgtcncctcttcaagggtggtcgcgggggccggcgggggaagatgtccaagggcgatatccgccagctctgggttgagggngaaaaggggggtgctgtttgcagattatgtttttttcccaccccgggcggcntcnaaannnggggggaaangaatggaacannggttgannnnnngganantctnnnnantgnggggggcgatnnnncanatnnnnattnnttttncngggggggatttgtggtttccggcgaacgaangggtacgaaccactgnaaatgcttcncgtcgnnncttntngagnnnnncggnncaatnntgcccctccaacccccccaccacggagaatcccccaatttatgagagtttaaggatttcttgtgatgaaatgataaagcagatttccatgcctcacctctcgcaacaaattctcggaaaagagagcaacgtttttccccaaagac

SEQ ID NO: 50909 - DNA, 771 bp, Zea mays
  misc_feature: Ceres CLONE 1464541-F
  misc_feature: Encodes the peptide sequence at SEQ ID NO. 50910
  misc_feature (1)..(1): n is a, c, t, g, unknown, or other
  misc_feature (667)..(667): n is a, c, t, g, unknown, or other
naaagctggagctccccgcggtggcggccgctctagaactagtggatcccccgggctgcaggaattcgcacgagaccattacctagaacatcctaatcgaaaatcctgccccacagggcgacaagtatcagtacacacccttcgcacacaaaataaacagcttcgacacggcacctaagaagctgttggcatctgattcacggctgaggcctgatacatatgccctcgagaagggtgacatgtctaagtccggggcagagaacagcaggctcgaggaacaacagagagctgagaaacgaactcgagaggccaagggcgagcaatttactcctagatggttcaacctgacagatgtggtctcccctacaccgtggggtgacctggaaatttatgaatacaacggcaaatacacagagcaccgggctgccataaaccgctccgatgtcaccgacgagacagatgtcacttcagtcaagttcagcccatggcaatatggtagctcatcttcccaatgattctccgtggccagaagccgccatgcctacgcgcattgtgtaacacacttccaggcctggctttgctggtttgttgtgccatcagcggtttccttgcccttgtagtattgtggccttcccccttttttcccttaaatgctacagttattcangaaatggtgtaagtccgtgtactgtcgcaagtctagcagagattgcaaagttttgttgaacaacaaaaaaaaaaaaactttatcgataccccccgacctcaagg

SEQ ID NO: 50910 - protein, 91 aa, Zea mays
  misc_feature: Ceres CLONE 1464541-F
MSKSGAENSRLEEQQRAEKRTREAKGEQFTPRWFNLTDVVSPTPWGDLEIYEYNGKYTEHRAAINRSDVTDETDVTSVKFSPWQYGSSSSQ

SEQ ID NO: 50911 - DNA, 766 bp, Zea mays
  misc_feature: Ceres CLONE 1464543-F
  misc_feature: Encodes the peptide sequence at SEQ ID NO. 50912
  misc_feature (579)..(579): n is a, c, t, g, unknown, or other
  misc_feature (737)..(737): n is a, c, t, g, unknown, or other
aaagctggagctccccgcggtggcggccgctctagaactagtggatcccccgggctgcaggaattcgcacgagaccattacctagaacatcctaatcgaaaaaaaccctaataaacccatctccgcctctggttcgtcctccatctcctcccaaatggcggcaccaagcacccaaccgctttccgcatggcttcccacatcgacttccgctgcttggatgagggcctcggcggcgagcgcggcaagcgcaagcgccgcgaggatgccgaggcggcggccgcggattccatggacctcgatgccgacgcgcaccggccgtctaagctccgcgccatgccttccctctccgacccctcgaagccggcctccttcggccagcccacctacgacggcgtcatcgcagggcggttgtcgggacggcggtggaaggaggcccgcacccggcgagcgtcggccgtggcgatgtcgcggaagccgaccccgctggagcagcgcgtccgggagaagtcgctgaagcgcgcgtaccacgcccgcaaggcggagctcaaggaagagatccggcataacaaggtggccaancgaaaagcccgcgagtatcgtgagaatcggaaccaggagaacgtgctccgcacgggcacccaactgcagaaggtcaccaacccgaagacgatccagaagatctgccaggtcaataagcgcaagcagctcaaggtcgtccccgaacaagtcctcggcgncaagaagtctgtggccaaccggggcatgc

SEQ ID NO: 50912 - protein, 193 aa, Zea mays
  misc_feature: Ceres CLONE 1464543-F
  misc_feature (131)..(131): Xaa is any aa, unknown, or other
  misc_feature (184)..(184): Xaa is any aa, unknown, or other
MASHIDFRCLDEGLGGERGKRKRREDAEAAAADSMDLDADAHRPSKLRAMPSLSDPSKPASFGQPTYDGVIAGRLSGRRWKEARTRRASAVAMSRKPTPLEQRVREKSLKRAYHARKAELKEEIRHNKVAXRKAREYRENRNQENVLRTGTQLQKVTNPKTIQKICQVNKRKQLKVVPEQVLGXKKSVANRGM

SEQ ID NO: 50913 - DNA, 747 bp, Zea mays
  misc_feature: Ceres CLONE 1464548-F
  misc_feature: Encodes the peptide sequence at SEQ ID NO. 50914
ctccccgcggtggcggccgctctagaactagtggatcccccgggctgcaggaattcgtctcacccctaatcgaaaaccatcattacctacagaacaacgccctagggcctctcagcagcaagcttatcctgatccagctaatctctatgccttccaacaagctggagcttcatatgcacagatggggagggctgcaatgattgctgccgcatttggaggaactttacctcatggagtgactggtaccaatgaacggtgcacactcatagtcagtaatctgaataatgataaaattgatgaggataagctcttcaatctgttttccttgtacggaaacatagttcgtatcaaggtactgcgtaataaaccagatcatgctcttgttgagatggctgacggcccgcacgctgagctagctgtgcattatttgaagggagctatactatttgggaagaagctggaagttaactactcaaagtaccctaacattacacctgccccagatgcccacgactacttgaactcgagcctaaaccgattcaacagcaacatggtaaagaactaccgacattgctgctctccaacaaagatgatccacatctctgccctcccccaatagatctctgaggaagcaatcctgaaccatttgtctgagcacggtactgttgtcaacacaagctatttgaagtgaatggcaagagcacgctctcagtttatttgagactgaagagcagcgaccgatgcctc

SEQ ID NO: 50914 - protein, 145 aa, Zea mays
  misc_feature: Ceres CLONE 1464548-F
  misc_feature (28)..(95): Pfam Name: RRM_1 Pfam Description: RNA recognition motif. (a.k.a. RRM, RBD, or RNP domain)
MGRAAMIAAAFGGTLPHGVTGTNERCTLIVSNLNNDKIDEDKLFNLFSLYGNIVRIKVLRNKPDHALVEMADGPHAELAVHYLKGAILFGKKLEVNYSKYPNITPAPDAHDYLNSSLNRFNSNMVKNYRHCCSPTKMIHISALPQ

SEQ ID NO: 50915 - DNA, 739 bp, Zea mays
  misc_feature: Ceres CLONE 1464550-F
  misc_feature: Encodes the peptide sequence at SEQ ID NO. 50916
  misc_feature (501)..(501): n is a, c, t, g, unknown, or other
  misc_feature (678)..(678): n is a, c, t, g, unknown, or other
ctccccgcggtggcggccgctctagaactagtggatcccccgggctgcaggaattcgtctcacccctaatcgaaaaatagcactgccgcatgagaagatagcagtatagcaccgcccgctgcaatgaaccgcgcttcttggttgctccttgttctggtgcagctctcttgcttgcactgctactcagccacccaccatggcggcggccggaagcacggacgcccactactacccgcgcccgccaacgtcgtcgtcggctccgttgtcgtcgtccactccggcagctccgaggctaccaccaccgccgtttcttcaggcaccctggtcggggtccgctgccacgacgggaacggccggacggtgttccggaaggacggcgtcgtgacggaccgcagcggcaggttccgcgtgcacctcgcgcacgggccaagcagcggcagcagcagcagccaccagctccggtccgtcacgtcctgctcggtggcggtgcacctcccgcangcgtcgctgccgtgcgtcgccaccgccagctccgctcgcgggctccacctcgtcgcccaccacaacaagcacgaccacggcggcggcgctcgcgtcttctccgccggcgccttctccgtccgcccggagctctgcagcaaacagggcctgttcttcccgcgggtcccgctcgtgccngagccacccaacgtcggcggcgtgcccatcccgcccacccggtcacgcccgccccgcgttc

SEQ ID NO: 50916 - protein, 205 aa, Zea mays
  misc_feature: Ceres CLONE 1464550-F
  misc_feature (126)..(126): Xaa is any aa, unknown, or other
MNRASWLLLVLVQLSCLHCYSATHHGGGRKHGRPLLPAPANVVVGSVVVVHSGSSEATTTAVSSGTLVGVRCHDGNGRTVFRKDGVVTDRSGRFRVHLAHGPSSGSSSSHQLRSVTSCSVAVHLPXASLPCVATASSARGLHLVAHHNKHDHGGGARVFSAGAFSVRPELCSKQGLFFPRVPLVPEPPNVGGVPIPPTRSRPPRV

SEQ ID NO: 50917 - DNA, 778 bp, Zea mays
  misc_feature: Ceres CLONE 1464552-F
  misc_feature: Encodes the peptide sequence at SEQ ID NO. 50918
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
aattatttcttttttttacttatttnnntnnnnnccttaannnnnaaaagctggagctccccgcggtggcggccgctctagaactagtggatcccccgggctgcaggaattcgtctcacccctaatcgaaaaattccactagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacggtgcatttgatccgtcccggccgcctacacgatgtccaagtcgggagcgctggatcttgcttctggcctcggagggaagatcaacaaggtggaagtcaagtcggccgtcgatgagtatgagaaatgtcatggatactatggagggaaggaggaagcaaggaagtccaactatactgagatggttaataaatactatgatcttgccactagcttctatgagtatggttggggtgaatccttccactttgctcacggatggaatggagaatccttacgtgagagcatcaagcgacatgagcattttcttgccctgcaactaggctggaaaccaagaatgaacgtcttagatgggggctgtggaaatagggggacccctgaagagatattgcaggatttaccctccacttcagtaaccggagtggagtagcccgaataccagataaccccggggaaaaggacgctcacccgtttatccagg

SEQ ID NO: 50918 - protein, 131 aa, Zea mays
  misc_feature: Ceres CLONE 1464552-F
  misc_feature: SWISSPROT Homolog: EC 2.1.1.41 Sterol 24-C-methyltransferase
MSKSGALDLASGLGGKINKVEVKSAVDEYEKCHGYYGGKEEARKSNYTEMVNKYYDLATSFYEYGWGESFHFAHGWNGESLRESIKRHEHFLALQLGWKPRMNVLDGGCGNRGTPEEILQDLPSTSVTGVE

SEQ ID NO: 50919 - DNA, 743 bp, Zea mays
  misc_feature: Ceres CLONE 1464557-F
  misc_feature: Encodes the peptide sequence at SEQ ID NO. 50920
ggagctccccgcggtggcggccgctctagaactagtggatcccccgggctgcaggaattcgtctcacccctaatcgaaaagtgtgtgcgtgcctcgatcgtgtctctctgtctctgcagctccggagaagaggcagcgcgtgccgtcggcgtacaaccgcttcatcaaggacgaaatccaacgcatcaaggctggcaatcccgacatctcgcacagggaggccttcagcgcggcggccaagaactgggcgcactttccacacatccactttggactcatgccagatcaccaggggcccaagaagacaagcctgctacctcaggatcaccagagaagcgacggcggcgggctactaaaggaagggctgtacgctgcggcagccaacatgggggttgctccatactaatattagagtagcaaagctgctacgtactgttagggctctatggactactacgaagctatggacgtgtttggtaggctgcatatgggccggccaggctggtaagatacagcgtacgcttgtttggttgcttgtctctgtatctggtgggctgaggggcggtgtttggttgcctgtatgtctgtgctcacctgcactgcgggatgcaacatctcgctgtgagccaggctgtggaagaacgagtttcatttctgtatctcgggagccaggccctggctagcctgtttggagcgggcaggctccactgcgaaacgaacaaacacgccctatatgtatctac

SEQ ID NO: 50920 - protein, 42 aa, Zea mays; identical to SEQ ID NO: 48472
  misc_feature: Ceres CLONE 1464557-F

SEQ ID NO: 50921 - DNA, 721 bp, Zea mays
  misc_feature: Ceres CLONE 1464558-F
  misc_feature: Encodes the peptide sequence at SEQ ID NO. 50922
ggagctccccgcggtggcggccgctctagaactagtggatcccccgggctgcaggaattcgtctcacccctaatcgaaaactcatacctcaatcatcatcttctttaatcaacattgcgagagcctccctcctcgttcggttcggacttttgcttcggcgactttacgcggtaggccaccgtaaaccctagccccagaccgcgggtcatagccaacgagatgcagatcttcgtcttgacgctgacggggaagaccatcacgctcgacgtcgagagcagcgacaccatcgataatgtcaaggccaagatccaggacaaggagggcatttcgcgtgaccagcagaggctgatttttgctggcaagcaattggaggatgggaggacattagctgattacaacattcagaaggagtcaacactcccttcggtcttgaggctcaagggtggaactatgatcaaggtgaagacactaactgggaaggaaatcgagattaacatcgagcccaatgacacaattgataggatcaaggagcatgttgaggagagagaaggcatcccacctgttcagcagaggctcatttatgctgggaagcaacttgctgatgacaaaactgtcaaggattcacacattgaaggtggttcagtgctccatcttattcttgctctgaggggtggttgctagattaaaaagtcttgtactttctgcttatgctatctggtac

SEQ ID NO: 50922 - protein, 153 aa, Zea mays
  misc_feature: Ceres CLONE 1464558-F
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVLTLTGKTITLDVESSDTIDNVKAKIQDKEGISRDQQRLIFAGKQLEDGRTLADYNIQKESTLPSVLRLKGGTMIKVKTLTGKEIEINIEPNDTIDRIKEHVEEREGIPPVQQRLIYAGKQLADDKTVKDSHIEGGSVLHLILALRGGC

SEQ ID NO: 50923 - DNA, 725 bp, Zea mays
  misc_feature: Ceres CLONE 1464561-F
  misc_feature: Encodes the peptide sequence at SEQ ID NO. 50924
  misc_feature (564)..(564): n is a, c, t, g, unknown, or other
  misc_feature (725)..(725): n is a, c, t, g, unknown, or other
aagctggagctccccgcggtggcggccgctctagaactagtggatcccccgggctgcaggaattcgtctcacccctaatcgaaaaatcgcttcagctcggcgtcttcacaaacgccggcgcaaactctcgcccgagcccgacagatctctaattccccataccgtccaccggtcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccaggtgcgaccggctcgtattctcttccttgaaaagcatcaccatcttcgatcgttttctgatctgttgtcaaggagtgctgcaatttgcagttgcagggcgttagtactcgaatcgggatgaagtactgaagtggtttaggctagggttttttttcgtcagatctgttgatagtactactaggatctgaaatttcctgcacgatttaagctgccaccatcctgtgttttangtgtatcgggaatttcgtctgttaatactttgcggcagaataacaagatgttccgatcgaatttggcatctcgtaaaaaaaaaaaaaacgagacgctcaaggtacccaattcgccctatagtgagtcgtattacgcgcgctcactggccgtcgttttccan

SEQ ID NO: 50924 - protein, 70 aa, Zea mays
  misc_feature: Ceres CLONE 1464561-F
MRECISVHIGQAGIQVGNACWELYCLEHGIQVRPARILFLEKHHHLRSFSDLLSRSAAICSCRALVLESG

SEQ ID NO: 50925 - DNA, 918 bp, Zea mays
  misc_feature: Ceres CLONE 1464563-F
  misc_feature (31)..(31): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (427)..(427): n is a, c, t, g, unknown, or other
atgcaccatgcaggtagccaaagtacaaacnacaccaanttnntcaaaactggagctccccgcggtggcggccgctctagaatagtggatcccccgggctgcaggaattcgtctcacccctaatcgaaaaacgtccaaaaaccaaccaaagcacacacacactctgccggccaccatgccctcctctgcctccgctgacgcctagggcgcccgcagcaaacgcaaaagaggctcgtcggccgcatgcccatccgacggcagcgaccagcagggcccgtcgtcccactggctgacgccgcgcgcgcagcagggatactcctcaaagctcctccaggcgctgcgcctcgtgcgcggaggcactggcacaccgacttgctccgcctcctccacggctgtgcgccatcctggccctaatgtgtttttaaantgaaaggaaagaaaccaatggaataggcagacacccaaattaatgcgctccaaccacccctggcccagggtgactcccccctcccccgggccaaccttcaaccccacgatcacgaacaacatctcttctttttttcagcaaccattaattcttttcattaaaaaggctctccacgcaacaaccagggcctaagcactctaaaaggcaacccagggcgctttgcgccggtttttcctccacccccgaaccctcggaaacttgtccccctgacccccgaacaccctatataaatatttgccccaaaccaactcttcaacattccaccaaagaaatggtcggttgaccaccccacaaggtacccctccctctctccccgaaacctacccaacactacaattctctccttctctccaaacaaaacaacccttgacaagaaggacttttctcccccccacctggcttatatttccaccccctactccattgttccc

SEQ ID NO: 50926 - DNA, 737 bp, Zea mays
  misc_feature: Ceres CLONE 1464566-F
  misc_feature: Encodes the peptide sequence at SEQ ID NO. 50927
aagctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagttgtaaataaagaaattatct

SEQ ID NO: 50927 - protein, 72 aa, Zea mays; identical to SEQ ID NO: 46899
  misc_feature: Ceres CLONE 1464566-F

SEQ ID NO: 50928 - DNA, 762 bp, Zea mays
  misc_feature: Ceres CLONE 1464569-F
  misc_feature: Encodes the peptide sequence at SEQ ID NO. 50929
  misc_feature (480)..(480): n is a, c, t, g, unknown, or other
  misc_feature (616)..(616): n is a, c, t, g, unknown, or other
  misc_feature (754)..(754): n is a, c, t, g, unknown, or other
aagctggagctccccgcggtggcggccgctctagaactagtggatcccccgggctgcaggaattcgtctcacccctaatcgaaaattagccatggcggcggtggatctgtccaagctggtgaaggagaagcgcttctgggtggcctccttcctcgtcgtatgggcagcagcgctgcagggccacatgatgtggatgcagcgccaggacaccttcaagcacaagtttggtatcgaccaagcagacggacccgatgctcaggattcctcatcttcgtcttcgtcttcctcttcttagtcagttaccttgtatcgtctgaagcggtttgttcggaacaaatgagacatccatcctttaataaagcgggcgggagagaaggcagatgacaagacaagtgcagtgtgtgtaaccactaccaggcgttcctttgatgaatgtcatttttcttctctttagtcctgaataaattctgataccatatncttttgggtgtgggatgcaaaactctgctagcttatcattgccacaaactcatgtatttgagttgtgttttatagattgaagtgcactttccagcaggtttcatagactggacagtggactgccgttggttgtctnctcgtgagtgtgaacccactttcatcaaaaaaaaaaaaaaaacgagacgctcgaggtacccaattcgccctatagggagccgtatacgcgcgctcactgggcgtcgtttttacacgtcgtgactgggaaaaccctggncgtaccaa

SEQ ID NO: 50929 - protein, 67 aa, Zea mays; identical to SEQ ID NO: 47667
  misc_feature: Ceres CLONE 1464569-F

SEQ ID NO: 50930 - DNA, 795 bp, Zea mays
  misc_feature: Ceres CLONE 1464572-F
  misc_feature: Encodes the peptide sequence at SEQ ID NO. 50931
  misc_feature (367)..(367): n is a, c, t, g, unknown, or other
aaagctggagctccccgcggtggcggccgctctagaactagtggatcccccgggctgcaggaattcgtctcacccctaatcgaaaaacacattttcaatttcgtactgggcgactgggcgtagggcgagctgagctcccaagtcgacgtggcggggatggctgcgacggccggcgtcggcggtggtggaggggctaacgcggcggtggcagagcagatagcacaggcagtgcggtccacctccaatctcctccagctcatggagcagtcctcccccgttcaggttcacttggcaaaactacccaagaacctgttggaaaaagcatcctttgcaaagaacacggagcatgtactgcaccagctacctncagtattttcatccttgcatgcttatatggacaggagtttgcaaagtgcatcctcaattaagactgtcccacagctctttgtcaaacatgaagaggacccagctgaaggtcatggtcgccttcttcccgagggaaggaagatcccaagagtcctgaccccttaagagcctccgggttggattgacgccccccgagactagggggagggagaacctttttgccgctttttggttagaaaactcaaaaaaaaagggtttggggaaatggccccttgccccccccccgaaaaaaggaacccccccccccccccgttggcccccatttaaaaattgtgggggagaacccttttttggggcaaaaaaaaaaaagaaagccccggggggcccaatcccccaaatgggggcttttcccccgcccccggggcgttt

SEQ ID NO: 50931 - protein, 124 aa, Zea mays
  misc_feature: Ceres CLONE 1464572-F
  misc_feature (71)..(71): Xaa is any aa, unknown, or other
MAATAGVGGGGGANAAVAEQIAQAVRSTSNLLQLMEQSSPVQVHLAKLPKNLLEKASFAKNTEHVLHQLPXVFSSLHAYMDRSLQSASSIKTVPQLFVKHEEDPAEGHGRLLPEGRKIPRVLTP

SEQ ID NO: 50932 - DNA, 762 bp, Zea mays
  misc_feature: Ceres CLONE 1464574-F
  misc_feature: Encodes the peptide sequence at SEQ ID NO. 50933
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (548)..(548): n is a, c, t, g, unknown, or other
nactcccnnnatcaagctggagctccccgcggtggcggccgctctagaactagtggatcccccgggctgcaggaattcgtctcacccctaatcgaaaataatattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcagatctaaccctacaaaccattgcaacgcaacaacaacaacaacagtttctgccatcactgagccacctagccgtggtgaaccctgtcacctacttgcaacagcagctgcttgcatccaacccacttgctctggcgaacgtagctgcataccancaacaacaacagctgcaacagtttatgccagtgctcagtcaactagccctggtgaaccctgcctctacctacaactactttcatctagcccgctcgcggggggcatggacctacgtacctacaaaacggttgctgcacaaattgaaccaccccgactcacctagcgggggaaaaccgggtgccaattaaaaagtggtttccttccaccaattgg

SEQ ID NO: 50933 - protein, 192 aa, Zea mays
  misc_feature: Ceres CLONE 1464574-F
  misc_feature (1)..(193): Pfam Name: Zein Pfam Description: Zein seed storage protein
  misc_feature (130)..(130): Xaa is any aa, unknown, or other
MATKILALLALLALLVSATNAFIIPQCSLAPSASIPQFLPPVTSMGFEHPAVQAYRLQLALAASALQQPIAQLQQQSLADLTLQTIATQQQQQQFLPSLSHLAVVNPVTYLQQQLLASNPLALANVAAYXQQQQLQQFMPVLSQLALVNPASTYNYFHLARSRGAWTYVPTKRLLHKLNHPDSPSGGKPGAN

SEQ ID NO: 50934 - DNA, 724 bp, Zea mays
  misc_feature: Ceres CLONE 1464581-F
ggagctccccgcggtggcggccgctctagaactagtggatcccccgggctgcaggaattcgtctcacccctaatcgaaaattttttggttcgataaacccaaagccacagtctgacagtcggtcgcgtcactagggtttctctcctcctgctcctcgccgccgcgatgagcgccaccaggccggaccaccggcggcaccagtcgccgttcctgcgggacctctcgtccccgatatcctcgtccttccgcatgcccccggcgtccgtgcgccgcgaggcccatgcctccaccccgccgccgcctcccccgctgctctccctcgatgacctgtcccgccactccccctcgccgccgccctacacgcctccgcaggcagccatgtccccttcgcctcctccccctcgggggggcctcttctccaccccgcaacgctccaacggctccccctccccggcggtgtggtggtccccctcgagggaggagaaggcgagggatggttccccggtcgacggagtcgtgcatcatcagcagtccccggggacggcctccgcacagcagccgcagcagcgtcagcagcaggtggcgctgatcacgctgcctccgcccagagaggtcacgcgcccggagatgccgagggattccgtgctctccactggccgggtcgacgaggaggaatgggtcaccgctttttgagccctcatgatgcgcagtaagcgctgggcag

SEQ ID NO: 50935 - DNA, 742 bp, Zea mays
  misc_feature: Ceres CLONE 1464583-F
  misc_feature: Encodes the peptide sequence at SEQ ID NO. 50936
  misc_feature (64)..(64): n is a, c, t, g, unknown, or other
  misc_feature (683)..(683): n is a, c, t, g, unknown, or other
  misc_feature (716)..(716): n is a, c, t, g, unknown, or other
  misc_feature (725)..(725): n is a, c, t, g, unknown, or other
  misc_feature (726)..(726): n is a, c, t, g, unknown, or other
acatctggagctcaccgcggtggcggccgctctagaactagtggaacccccgggctgcaggaantcgtctcacccctaatcgaaaaataattgcatcacctgcctgcttcagcaatcaggaaaggagatcaccacttcactcaagaaggcaccctcccttgccactccttttccttgagacgacgacgatgaagaagaagcagcagcagcagctcctcctcctttctctcatgtttctcgttgctgtcacagcagccgctgttgctgccgatccacatccacagcagcaggtgcaggtgcaggtgcagcagcagcagcagcaagcacagatgaggattaacagggccaccagatcccttcttcctcagccgccgccgaaactaggtactactgaaaactgtagacaacaagatacaagatctcatttcattgacgcctgtttctcacgcaatgcagactgcccgtccacctgctccgtgcgctgcggcaacaactggaagaaccagatgtgcaacaagatgtgcaacgtctgctgcaacaagtgcagctgcgtgccgccggggaccggccaggacacccgccacctctgcctctgctacgacaccatgctcaatccacacaccggcaagcttaagtgcccctaggccgtcgccactcatgtaacaatgtactatcatcacttncataataataaatataaacttctggttcttggnaaaaaaaannaattaaaaaaaaaaaa

SEQ ID NO: 50936 - protein, 151 aa, Zea mays; identical to SEQ ID NO: 47676
  misc_feature: Ceres CLONE 1464583-F
  misc_feature (68)..(151): Pfam Name: GASA Pfam Description: Gibberellin regulated protein

SEQ ID NO: 50937 - DNA, 708 bp, Zea mays
  misc_feature: Ceres CLONE 1464585-F
  misc_feature: Encodes the peptide sequence at SEQ ID NO. 50938
  misc_feature (306)..(306): n is a, c, t, g, unknown, or other
  misc_feature (379)..(379): n is a, c, t, g, unknown, or other
  misc_feature (381)..(381): n is a, c, t, g, unknown, or other
  misc_feature (384)..(384): n is a, c, t, g, unknown, or other
  misc_feature (386)..(386): n is a, c, t, g, unknown, or other
  misc_feature (387)..(387): n is a, c, t, g, unknown, or other
  misc_feature (390)..(390): n is a, c, t, g, unknown, or other
  misc_feature (391)..(391): n is a, c, t, g, unknown, or other
  misc_feature (596)..(596): n is a, c, t, g, unknown, or other
  misc_feature (651)..(651): n is a, c, t, g, unknown, or other
  misc_feature (675)..(675): n is a, c, t, g, unknown, or other
tccccgcggtggcggccgctctagactagtggatcccgtgggctgcaggaattcgtctcacccctaatcgaaaatcgccacaaggccctctcacgctcacgcggtcacgcccccggacccttctccccgcgccgccgctcgccggagctccgcgtctccgcccgcgccacaccctgtagaatcctcaatggctgccgcaaggggcattaaccagctcctgaagagaactctctacaaccagtctgttggttcctcgccgcttttctcatttctgggaaagcatgaagaatcgtctgctggactganatcattggctcttcttggagttggtgcctctggtcttttgttttttcccacccacggggggaagaagggggcnancangnnttnncacccccccataatccctggaaacaaactaacaatttgagctcgaatgatccccctccatttcccctgggcatcaattttacccccaggtttggcccccttgcgccccctcgccttaaattccgacccggcacctcgttcgggccggccacacccagaaaaaaaaccaaaccccggccccccccccaacaccgccaatttagcgnctcaagggggggggccaaaaagtctagccccgccgcataaccacggcaagaatcntgcccccacacccgacgcacaccncccaacccccgcgccggcgaaagccgggtcccc

SEQ ID NO: 50938 - protein, 80 aa, Zea mays
  misc_feature: Ceres CLONE 1464585-F
  misc_feature (40)..(40): Xaa is any aa, unknown, or other
  misc_feature (65)..(65): Xaa is any aa, unknown, or other
  misc_feature (66)..(66): Xaa is any aa, unknown, or other
  misc_feature (67)..(67): Xaa is any aa, unknown, or other
  misc_feature (68)..(68): Xaa is any aa, unknown, or other
MAAARGINQLLKRTLYNQSVGSSPLFSFLGKHEESSAGLXSLALLGVGASGLLFFPTHGGKKGAXXXXHPPIIPGNKLTI

SEQ ID NO: 50939 - DNA, 748 bp, Zea mays
  misc_feature: Ceres CLONE 1464586-F
  misc_feature: Encodes the peptide sequence at SEQ ID NO. 50940
  misc_feature (714)..(714): n is a, c, t, g, unknown, or other
tggagctccccgcggtggcggccgctctagaactagtggatcccccgggctgcaggaattcgtctcacccctaatcgaaaacaagtgggagaggtacaggtttgggcttcagggtgggtttgtcacaaacccattagccgagacataacatttcatctgcggggaaaacaatggttactcttgaacgcatgaagaaggataaaactttacaaaagtgaagggcgggttaggtatgatgaagacattctgttccaagcgtgaactgctcgagttggcttattatcatggaggcggctggacttctctttacaactcgacttcttattttcataagagcgtacatggcttgtttggcagctcttaaaacatgcctgccccggactagtaccgatgatcactcccaccccaactgtttaataataggaaaacccaagagttcctttctttttttggtgaacgagggagggcttcttttagaaaaactttatataaaaaagcttgggccccccccaaacaagaacccggggttcgctttgaaaaaaacacccgtgtttttccttttttttccaaaaaaaaaagattttttaaaaggggtccccccccaaaatattttgttttgttttaaacgccccaccccccttttaaaaaaaaaaaaagagggggggggggggccccccccctctgggggagacacccccccgcccggggtgtttntaaaaaggggggggggggctccctctctctattt

SEQ ID NO: 50940 - protein, 48 aa, Zea mays
  misc_feature: Ceres CLONE 1464586-F
GAPRGGGRSRTSGSPGLQEFVSPLIENKWERYRFGLQGGFVTNPLAET

SEQ ID NO: 50941 - DNA, 789 bp, Zea mays
  misc_feature: Ceres CLONE 1464591-F
  misc_feature: Encodes the peptide sequence at SEQ ID NO. 50942
  misc_feature (222)..(222): n is a, c, t, g, unknown, or other
  misc_feature (387)..(387): n is a, c, t, g, unknown, or other
  misc_feature (770)..(770): n is a, c, t, g, unknown, or other
  misc_feature (773)..(773): n is a, c, t, g, unknown, or other
gctctagaactagtggatcccccgggctgcaggaattcttctcacccctcaacgaaaaatttctctcccccttctctctctctgcgacgactgggtaggctgccgccgccgccctacgccaggtcccgaggaccaagggattcgtattcttcagtctcttccccgggcgacgccagtttggttggaacttggagtgtaaagggaagatttggtgatgagcanccgcaccccgccgcccaaggaccccatgatgcgtactgcacccacctctgaccggggctcaccatatcggagggatcaccgccctggtccaacgcagtttcggaatgatttgtttaacaccccgccccgggggggggggggggctaaaaaatgcccccaaccccncccgcctggggttacgtgggggggttcgggggcacaattgcacctgaaatgtccttccaaaggtcccctgcgggaaactccaaagaacgctcgcccccatggtgtccccctggccccatccgaagtggattgcgccaaatgacggcacgagccggcactctttgggcagaaaatataggccggacctaaccagtggtcgcccgagaagaaatgtctttctttggcgagctaacgttagtttccgcccccggtgcattttgcttctgggcaagcgccccctatagacaagaggggcgcacaacattcggcatgcgtgaaaactatccgagattggcccgcctaacggagctcccatctctccgcactcctcccgccgccccgcncgntaaatacgccccccgg

SEQ ID NO: 50942 - protein, 104 aa, Zea mays
  misc_feature: Ceres CLONE 1464591-F
  misc_feature (3)..(3): Xaa is any aa, unknown, or other
  misc_feature (58)..(58): Xaa is any aa, unknown, or other
MSXRTPPPKDPMMRTAPTSDRGSPYRRDHRPGPTQFRNDLFNTPPRGGGGAKKCPQPXPPGVTWGGSGAQLHLKCPSKGPLRETPKNARPHGVPLAPSEVDCAK

SEQ ID NO: 50943 - DNA, 747 bp, Zea mays
  misc_feature: Ceres CLONE 1464593-F
  misc_feature: Encodes the peptide sequence at SEQ ID NO. 50944
  misc_feature (744)..(744): n is a, c, t, g, unknown, or other
ctggagctccccgcggtggcggccgctctagaactagtggatcccccgggctgcaggaattcgtctcacccctaatcgaaaagttttcgcggcgacttggaccaggctcccctcctctcaaatttgggctggtatcctcacaaacggcccgataaggccttcctctctcctttctttcccgttcgcccttggtccgcctcgcttcttctcgagccgcctccccctgtttccacgagctggggttttagcggcgaaaagagggaaaacaaagccaacaagatagacggaaaggggaagatgagccggagcctgaggatcccggtgaagttgctccatgaggcagcgggtcacgtggtgacggtgaagctcaagaccggcgaagtgtaccgggggtcattggtcaagtgccaggataactggaattgccagatctagaacataaccttcactgccaaggatgggaaggtttcgcagctggagcacgtcttcatcagaggaagcagagtgagatttatgattatacctgatatgctcaagaacgctcccatgttcaagcgcttgaaatctaggattaggggcaaaggatcagctattggagttggtcgtggacgtgctgttgcaatgcgtgctcgggctgctgctggtcatgctggtggtcctgttggacaagtatcgcgcctcctgtgaagaggagcatctaaatggcggcttttctcatctggctgaagttgctgactgatctangaa

SEQ ID NO: 50944 - protein, 45 aa, Zea mays
  misc_feature: Ceres CLONE 1464593-F
MSRSLRIPVKLLHEAAGHVVTVKLKTGEVYRGSLVKCQDNWNCQI

SEQ ID NO: 50945 - DNA, 713 bp, Zea mays
  misc_feature: Ceres CLONE 1464597-F
  misc_feature: Encodes the peptide sequence at SEQ ID NO. 50946
aaagctggagctccccgcggtggcggccgctctagaactagtggatcccccgggctgcaggaattcgtctcacccctaatcgaaaaccaccttttcctcctctccgactccaccgccgtcacgccatctcgccgggggcggaaccccgaccgcgagtatggggaacatcttcgtgaagaagcccaagatcactgacgtcgatagggccatcctcaccctcaagacgcagcgacgcatgctcgaccagttttcacagcagcttgagaaggctatcgtagcataatagcagctgcacgcagttggttccacatcagaagagagaccgatctttgcatgctctgaagaaaaagaaagctcaggagaagctttgaaactagttgacacctggcaaatgatgtttgacaccccctggcacaattttgactgcaagtaaacaaaagctgtattttaaaaccctaaagcgtgaaatgctgccctgaaacttaccgaagggaaaaacattgtgaagtcccaaactgagggatcacaacccaggggcaggcgttccaaggaaataatgggttctggggcaggctttttcatttaaaaaaaaaactgtgcagggccattttaaattttggaatccaccttgcctttaatttttgccaaacttcgggttacaaattaggcctggaaagaaacgaagctccggctgaccagtagctgctcctgag

SEQ ID NO: 50946 - protein, 41 aa, Zea mays
  misc_feature: Ceres CLONE 1464597-F
MGNIFVKKPKITDVDRAILTLKTQRRMLDQFSQQLEKAIVA

SEQ ID NO: 50947 - DNA, 766 bp, Zea mays
  misc_feature: Ceres CLONE 1464603-F
  misc_feature: Encodes the peptide sequence at SEQ ID NO. 50948
ggagctccccgcggtggcggccgctctagaactagtggatcccccgggctgcaggaattcgtctcacccctaatcgaaaaatccatcgatcactgcaccggccggcggcaccgcgctcgcaggggctagccaacgagacggcagcaatggcggaccgtgaccgcagcggcatctacggcggcgcccacgccacctacgggcatcaacagcagcagggaggaggcgggcgcccaatgggagagcatgtgaagggcatgctccgctacaaggggccgacggcgtcgcaggcgctgacggtggccactctgttcccgctgggcgggctgctgctggtgctgtcggggctggcgctgacagcctccgtggtggggctggccgtggccactccggtgttcctgatcttcacccccgtgctggtccccgccgcgctgctcatcgggacggccgtcatggacgtcctcacgtcgagcgcgctggagctcgcgggcctgtcctcgctcacgtgcctcgccaacactgagcggcaggcgttccagctgaacccggactacgtggagtatgcgcaccgaacgatggcggagtccgccatacactctgtccacaataccgcgcaggcaagccatgtcatcccgagcagggcgcatgatgccgaactcctggagacgtgcaggtgccggcgctagcagccgctgctgggcttcctcgtaagcaactcatccctgcatggatcatggatagactgcgcgcgtgcgtgtctatcagcacc

SEQ ID NO: 50948 - protein, 178 aa, Zea mays
  misc_feature: Ceres CLONE 1464603-F
  misc_feature (44)..(161): Pfam Name: Oleosin Pfam Description: Oleosin
MADRDRSGIYGGAHATYGHQQQQGGGGRPMGEHVKGMLRYKGPTASQALTVATLFPLGGLLLVLSGLALTASVVGLAVATPVFLIFTPVLVPAALLIGTAVMDVLTSSALELAGLSSLTCLANTERQAFQLNPDYVEYAHRTMAESAIHSVHNTAQASHVIPSRAHDAELLETCRCRR

SEQ ID NO: 50949 - DNA, 778 bp, Zea mays
  misc_feature: Ceres CLONE 1464606-F
  misc_feature: Encodes the peptide sequence at SEQ ID NO. 50950
  misc_feature (408)..(408): n is a, c, t, g, unknown, or other
ctccccgcggtggcggccgctctagaactagtggatcccccgggctgcaggaattcgtctcacccctaatcgaaaaactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggagggatttcttatcaaactgatgatcacagtctcagggacgagtttgccaaatatgggcaagtcattgaagctaggattatcattgaccgtgaatctgggaggtctagaggttttggctttgtaacttacacgtcatctgaggaggcttcanctgccattactgcccttggatggaaagactctcgatggaccgagcatacgtgttaatcatgcttacgagaaaacagtggctttccgtggcggcggtgggctatggtggccgccggctacggggggtggtgaagaatatggggggtggtggccgtggcaaatgtggggggtgaaagcataagtggggggttgccccccccgggaaaatacgggggggggaaatattgggggaaccccaaaaggggggggggggggaaaaattaaaattctcggggaaaaggagaaacccctttttctcggtgggagagaagaagttttttacaaaaaaaaattttttgtttcaaaaaatttttttgggaaaaatacgcctg

SEQ ID NO: 50950 - protein, 103 aa, Zea mays
  misc_feature: Ceres CLONE 1464606-F
  misc_feature (32)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (86)..(86): Xaa is any aa, unknown, or other
MALANKLGGLLKKATSSNLSVYQAIRCMSSKLFVGGISYQTDDHSLRDEFAKYGQVIEARIIIDRESGRSRGFGFVTYTSSEEASXAITALGWKDSRWTEHTC

SEQ ID NO: 50951 - DNA, 762 bp, Zea mays
  misc_feature: Ceres CLONE 1464607-F
  misc_feature: Encodes the peptide sequence at SEQ ID NO. 50952
tggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactcccaagctaaactgtttgagtactatgctaagctgaagagctgcattcacatcatgtggtggagcgcgagggaggcttctttatcggacagccctcacttgtcaccgacgcaatcaggcacccccccaagccgtggactacgctgggtttggctttggcatgagaacgaccgctgtgtttgtcataagtcatatcgaaccagaagaacaagtagctttatgatcacaatgtatcaccatcctacagaactaatgatgcctccttgtacatacgccggaataaagcccttcttaaaaaaaaaaaaaaaaacgagaaccttcgaggtacccaaattccccctaaagtggaggcgtat

SEQ ID NO: 50952 - protein, 71 aa, Zea mays; identical to SEQ ID NO: 46198
  misc_feature: Ceres CLONE 1464607-F

SEQ ID NO: 50953 - DNA, 839 bp, Zea mays
  misc_feature: Ceres CLONE 1464608-F
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (205)..(205): n is a, c, t, g, unknown, or other
  misc_feature (260)..(260): n is a, c, t, g, unknown, or other
  misc_feature (270)..(270): n is a, c, t, g, unknown, or other
  misc_feature (282)..(282): n is a, c, t, g, unknown, or other
  misc_feature (368)..(368): n is a, c, t, g, unknown, or other
  misc_feature (407)..(407): n is a, c, t, g, unknown, or other
  misc_feature (408)..(408): n is a, c, t, g, unknown, or other
  misc_feature (410)..(410): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (421)..(421): n is a, c, t, g, unknown, or other
  misc_feature (422)..(422): n is a, c, t, g, unknown, or other
  misc_feature (499)..(499): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (512)..(512): n is a, c, t, g, unknown, or other
  misc_feature (513)..(513): n is a, c, t, g, unknown, or other
  misc_feature (515)..(515): n is a, c, t, g, unknown, or other
  misc_feature (526)..(526): n is a, c, t, g, unknown, or other
  misc_feature (527)..(527): n is a, c, t, g, unknown, or other
  misc_feature (536)..(536): n is a, c, t, g, unknown, or other
  misc_feature (565)..(565): n is a, c, t, g, unknown, or other
  misc_feature (577)..(577): n is a, c, t, g, unknown, or other
  misc_feature (599)..(599): n is a, c, t, g, unknown, or other
  misc_feature (613)..(613): n is a, c, t, g, unknown, or other
  misc_feature (614)..(614): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (639)..(639): n is a, c, t, g, unknown, or other
  misc_feature (640)..(640): n is a, c, t, g, unknown, or other
  misc_feature (653)..(653): n is a, c, t, g, unknown, or other
  misc_feature (654)..(654): n is a, c, t, g, unknown, or other
  misc_feature (658)..(658): n is a, c, t, g, unknown, or other
  misc_feature (683)..(683): n is a, c, t, g, unknown, or other
  misc_feature (701)..(701): n is a, c, t, g, unknown, or other
  misc_feature (708)..(708): n is a, c, t, g, unknown, or other
  misc_feature (721)..(721): n is a, c, t, g, unknown, or other
  misc_feature (753)..(753): n is a, c, t, g, unknown, or other
  misc_feature (756)..(756): n is a, c, t, g, unknown, or other
  misc_feature (763)..(763): n is a, c, t, g, unknown, or other
  misc_feature (800)..(800): n is a, c, t, g, unknown, or other
nnaatccannnnnnaaccacaaaaaccaccnnagnngggggccgctctaaaatagtggatcccccgggctgcaggaattcgtctcacccctaatcgaaaaaaatattttcagcattcaaaaaccaccaagcgaagcgcactagcaacgacctaacaccaatggctaccaatatattagccctgggtgcgcttcttgcccttttantgaccgcaacaaatgccttcattattccacagtgctcccttgctcctagtgccantattccacanttcctcccaccntttactttcatggtttttcccccccccgggagaggaagcctacccgctattttttttttttttcgacaaaggactttaaaaagacnttttttttttttccccccccccagggaaagaaagggaanncncnnnncctctnnccccccctttttgtgttctaaaaaaaaaaaaaaaaacactggggggggggagaggcggggggggacacccgaaacanannncaccacccnncnacctccccggnngggagacanccaaccgcgccggcccgtgtgttaatttnagtctcacgccncacctccaagttcctctactgncagctccacccccnngnnnntgcgatctccacccacagcnngatcttcccgtgnnctcncgttccgcaggccgccaccctcggngtgctcggcttcctcgcnccgcggnctcccatcggcgnggacaggaatctgctaccactctctcccttcnaanccactcnccgctcttctccccactcccctcgtcccctcttttcncatactccctccctcactctcctccaaacacgctccaac

SEQ ID NO: 50954 - DNA, 710 bp, Zea mays
  misc_feature: Ceres CLONE 1464613-F
ctccccgcggtggcggccgctctagaatagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaagctaaactgtttgagtactatgctaagctgaggagctgcattcacatcatgtggtggagcgcgagggaggcttctttatcggacagcctcacttgtcaccgacgcaatcatgcaccccccccaagcgtggactaacctgggtttgggcttttgcatgagaacgaccgctgtgtttgtcctaaatcctatccgtacctgaaaaaacaagtagctttttaatcaccatgtatccccatcccaccaaaatattggaggcgtcttgtacatagcccggataaaacccttctaaaaaaaaaaaaaaaaa

SEQ ID NO: 50955 - DNA, 747 bp, Zea mays
  misc_feature: Ceres CLONE 1464617-F
  misc_feature: Encodes the peptide sequence at SEQ ID NO. 50956
  misc_feature (368)..(368): n is a, c, t, g, unknown, or other
ggagctccccgcggtggcggccgctctagaactagtggatcccccgggctgcaggaattcgtctcacccctaatcgaaaagcagtttctcgcgccatctgaagtcagctggggcgacgaagaaatgtcctctagcgatcaaaacccagctgccacacccgcgtcgtcgggccccgccgagccctcgccgccgggcaggccaacggcggtgtcctcgcgtgtcctcgacatgggcgcgcagctggcgcaggcgctgaagccggtgcggcagatgaagcagcacgcgtgcagcttcgcgctgtacgcccacgacttgcaccgccaggtggaggtcccacacttcgtcgcccggctcaaccaggacgtccntcagtggcgcgtctacgactccgacaagccctcggcccgcctcatcggcgtggagtacatcgtcttaaaacccatctttcaagggcttgccccggaaaaagcaaggctggggcactccccccctaacaagggaagggccgggttgggaaccaactccgcgtgcccgaaggccttccaaaatttcaaaaggggaacccccccagggactaccggaaatttttggggcccctggaggggaaacgggggaaaccctttcccttggggcccggggctttaggggtgttccaagggccccaaaacccggccttgtgcgcaaaaattggggcgcgcccctaaaaaaatgttggatttacccctccccggggggggtcaaaggggg

SEQ ID NO: 50956 - protein, 173 aa, Zea mays
  misc_feature: Ceres CLONE 1464617-F
  misc_feature (23)..(173): Pfam Name: DUF1264 Pfam Description: Protein of unknown function (DUF1264)
  misc_feature (82)..(82): Xaa is any aa, unknown, or other
MSSSDQNPAATPASSGPAEPSPPGRPTAVSSRVLDMGAQLAQALKPVRQMKQHACSFALYAHDLHRQVEVPHFVARLNQDVXQWRVYDSDKPSARLIGVEYIVLKPIFQGLAPEKARLGHSPPNKGRAGLGTNSACPKAFQNFKRGTPPGTTGNFWGPWRGNGGNPFPWGPGL

SEQ ID NO: 50957 - DNA, 713 bp, Zea mays
  misc_feature: Ceres CLONE 1464618-F
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (299)..(299): n is a, c, t, g, unknown, or other
  misc_feature (300)..(300): n is a, c, t, g, unknown, or other
  misc_feature (335)..(335): n is a, c, t, g, unknown, or other
  misc_feature (357)..(357): n is a, c, t, g, unknown, or other
  misc_feature (387)..(387): n is a, c, t, g, unknown, or other
  misc_feature (405)..(405): n is a, c, t, g, unknown, or other
  misc_feature (446)..(446): n is a, c, t, g, unknown, or other
  misc_feature (447)..(447): n is a, c, t, g, unknown, or other
  misc_feature (467)..(467): n is a, c, t, g, unknown, or other
  misc_feature (509)..(509): n is a, c, t, g, unknown, or other
  misc_feature (513)..(513): n is a, c, t, g, unknown, or other
  misc_feature (588)..(588): n is a, c, t, g, unknown, or other
  misc_feature (624)..(624): n is a, c, t, g, unknown, or other
  misc_feature (625)..(625): n is a, c, t, g, unknown, or other
ggagctccccgcggtggcggccgctctagaactagtggatcccccgggctgcaggaattcgtctcacccctaatcgaaaactcttcggtcaaaaatatccttgtacctgcatctcgacctcaccggcgtccgggggtggtatcaccatggtggcgttgctgggcccgcgggatatacagggtggatgcggcagctgccgcgttcattccccctccctgggcgttcggatcccacctcctcctcnnnncaagtcccatctttgcccatctcgaaccgcccctgacccccaagnnncccgnntcttctacccaagtcctaactgcccgactgcaaanaaatcaaaggccgtggtttaanggacttgattgaagaaggcacccatattgntgttgaagctggatccancaaaggatggctcaaagattcagatgccttacttgagaagnntggcagcctactggtccccncaagttttgtccatgaaagcacccctggtggttctgacatanctgntgactcctacaaagtggaaactgctagactctaaactcgagtcaagaccaactttgatgactgctaatcggtcancctgttctttggtttcaaccgaccggttcaacactnncaaatggtttgtctccatgatacagctcacgtctaaagctatttatcgaacaaaatccaacgtccctgttgagtaccagggattttgt

SEQ ID NO: 50958 - DNA, 773 bp, Zea mays
  misc_feature: Ceres CLONE 1464621-F
  misc_feature: Encodes the peptide sequence at SEQ ID NO. 50959
  misc_feature (754)..(754): n is a, c, t, g, unknown, or other
ggagctccccgcggtggcggccgctctagaactagtggatcccccgggctgcaggaattcgtctcacccctaatcgaaaaccattctctctctttctcctgttccccgcgagagtcgctcaaggccgcggcgaggagaagcggcagcgcgtcacctctccaatggcatccccgtccttcctccgtgcaacctgtgcaccctcatgaggactagttcactccctgctgtcattgaggcttctggcaatgatgactggaagaaacgaaaggaagcacagagcctgaagaggctcgaggttaagaagaagaggattgagaggaggaactctctcacctgcaacacttcaaaagaagctgctgggcagagtccagaagagatgaatgcaaacactgacaaattagtaagttctgatgaaactattgccagcgctaacgaaagccatagcagtggcaagcatctggtgaaggggcttccaccaaagtaccaggctacaattacatcacaagacagttcgtcagcaatgcgaaagaagccaaactcggccttcaaaggaacagccatcactgaggagcagaactcgtcatcgtctgttccttcctccggtgaaagctatagtagcgtgacggcaccaagtctgcctgcgttgtctttggtcccataacagcaacccttggttccagggaagaccaagcattttaggcagggctggtgcaagggcaacggcatgggggacgtggaaagggagatgatgcangaaatgccgggcgtgttcc

SEQ ID NO: 50959 - protein, 152 aa, Zea mays
  misc_feature: Ceres CLONE 1464621-F
MRTSSLPAVIEASGNDDWKKRKEAQSLKRLEVKKKRIERRNSLTCNTSKEAAGQSPEEMNANTDKLVSSDETIASANESHSSGKHLVKGLPPKYQATITSQDSSSAMRKKPNSAFKGTAITEEQNSSSSVPSSGESYSSVTAPSLPALSLVP

SEQ ID NO: 50960 - DNA, 777 bp, Zea mays
  misc_feature: Ceres CLONE 1464629-F
ggagctccccgcggtggcggccgctctagaactagtggatcccccgggctgcaggaattcgtctcacccctaatcgaaaacaattgggagaggcagacgtttgggctatggggtgggtttgtcacagacccattatccgagacgagcatttcatctgcttggaaaacttgggttactcatgaaggtcggatcaacgataaaagtttacaaaactgaagggtggggtaggtatgatgaaaaccttctgttccgagcatgaactgctccagtttgcttattatcatgaaggcggctgattttctcttttccaccgagacctcttttttttcctaagagaacgaacattgtgcattgtttggaatcttctgaaatcttggctggcccgtgaactatgaatgtttgaggccctccgaatctcaactgtttgagtactatactatcttgaggaggtgcattctacatcttgtggcggagctcaagcggaagcttctttatctaacagcctaatttgtcggcgatgacttctggaaccctcccaaaaccctgcactactctgggattggactatgcatgacaacgaccgctgtgtttattctaaatcatgtctctctatgaaaccttgcagatatataagcaccttgactcacacttctacggaactctggatgcgtcttgcacataagtctgataaactgtttctaagagagaagctaatataccagacgctctaagtaccctcttcagcctacagtagatccgatgacgcagtgtaaatgc

SEQ ID NO: 50961 - DNA, 723 bp, Zea mays
  misc_feature: Ceres CLONE 1464632-F
  misc_feature (491)..(491): n is a, c, t, g, unknown, or other
tggagctccccgcggtggcggccgctctagaactagtggatcccccgggctgcaggaattcgtctcacccctaatcgaaaaaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgacagcatggcgtgcgcgtgaactatgaatgtatgagtcactccaaagctaaactgtttgagtactatgctaagctgaggagctgcattcacatcatgtggtggagcgcgagggatgcttctttatncgacagcctcacttgtcaccgacgcaatcaggcacccccccaagccgtgaactacgctggggtttggctttggcatgagaacgaccgctgtgtttgtcataagtcataccgtaactagagaaacaagtagctttattatccacatgtatcaccatcctaccataactatggatgcgtcttggacataggccgggataaagcgctttctaaaaaaaaaaaagaaaacgaggcc

SEQ ID NO: 50962 - DNA, 771 bp, Zea mays
  misc_feature: Ceres CLONE 1464633-F
  misc_feature: Encodes the peptide sequence at SEQ ID NO. 50963
tccccgcggtggcggccgctctagaactagtggatcccccgggctgcaggaattcgtctcacccctaatcgaaaagaccaaaagattcccacgggctcgccgctcgcatctcgccagcgcgaacgcagcctccgtgcatatcaccagcctcctcgcgcacccggtcccgcttgcctttccccacctactcgccgtcgcggtgccgtgcgccggtgctgttcagtctagggtttcggccctcgcccgccgatccgtccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaagaaaagtggaaagaaatgagcattgcccacccacccatctccaaaacacctaagagaacgataagacagctgcttatctgtgttgcgcttcactatatgatatatgtggctgtgagacaatgttgcctcttgtattccgtgtttcgcggtgttccagttggtttgctggatccgaagatgtttcagcctctcatctgctagctgtgatacacgagttatttgctattatgatattcatttgaagtggattcttcggccaaaaaaaaaaaaaaaaacgagacgctcgaggtacccaattcgccctatagtgagtcgtattacgcgccgctcctg

SEQ ID NO: 50963 - protein, 62 aa, Zea mays; identical to SEQ ID NO: 43286
  misc_feature: Ceres CLONE 1464633-F
  misc_feature (1)..(62): Pfam Name: TMA7 Pfam Description: Translation machinery associated TMA7

SEQ ID NO: 50964 - DNA, 754 bp, Zea mays
  misc_feature: Ceres CLONE 1464636-F
  misc_feature: Encodes the peptide sequence at SEQ ID NO. 50965
ggagctccccgcggtggcggccgctctagaactagtggatcccccgggctgcaggaattcgtctcaccccctaatcgaaaaacacaaacctccatgccccttcttcctctcctccccgtcatggcttccaccttctcccccacttccgccgcgagggccctcctcccgggctccacctcccgcccactcttcctcgccgcttcagcttcctcagggcgcattcaaccatccaggaagggactggacttccgccgcggccgattcaccgtctgcaatgtcgccgctcccaccgccgccgaacaggtacgcccccgttctccaatcccgcagcccgcaggaaccggtcggtaatccttcctccgcaaccccgcattttcgatgcctgcttctgcttccgcgcaggaggcgacggcgtcggccgcgaaggagacccagcgccccgtgtacccgttcgcggccatcgtggggcaggacgagatgaagctctgcctgctgctcaacgtcatcgaccccaagatcggcggcgtcatgatcatgggcgacaggggcacggggaagtccaccaccgtccgctccctcgtcgacctgctcccggacatccgcgtcgtcgtcggcgacccctttcactccgaaccggacgaccccgaggtcatgggcccccgagtccgccagcgggtcctgcagggggacaccgtgcctcccgtcaccacgcccagatcaccatggtcgaactgcccctcggcgccaccgagga

SEQ ID NO: 50965 - protein, 125 aa, Zea mays
  misc_feature: Ceres CLONE 1464636-F
  misc_feature: SWISSPROT Homolog: EC 6.6.1.1 Magnesium chelatase
MPASASAQEATASAAKETQRPVYPFAAIVGQDEMKLCLLLNVIDPKIGGVMIMGDRGTGKSTTVRSLVDLLPDIRVVVGDPFHSEPDDPEVMGPRVRQRVLQGDTVPPVTTPRSPWSNCPSAPPR

SEQ ID NO: 50966 - DNA, 755 bp, Zea mays
  misc_feature: Ceres CLONE 1464638-F
  misc_feature: Translation starting site: 271
ctggagctccccgcggtggcggccgctctagaactagtggatcccccgggctgcaggaattcgtctcacccctaatcgaaaaatcacttatcatccccatcctcacgctctgtccatctagcgagctcgtccgacctcgttcttggtccgtgctagctacggatgaccatgttagactcggaggagcagcaattctaatcgtacgccgacgccggagcgtcttgtacctacccgcagcaggctggtaccggccataagaacggcttcgtcatgatcaagatccacccctggaaggttgcggagctttctacctcacacactggtgatgatgaccctgacggatgccacgtagtacccgttgatcttttcaaacggaaaaaggtccaagatattgttcattcctcacacaactgagatattcctcgctgttaacgatactgagtaccttgtgattgatctatgctaagatggattcgtgagccttcttacgtcgcatggacacacctctgatgatcttaacgtctcacatgatgatactattgtggatcacatcaatgatcggtgtgagagcaactagtatcttgttgtgactgcccagtctgctatggggcatgaagagatcttcgcgctgatggacgttcgtcactgggtgcttctgtgccctgaaagactgtatctcacaacgtagtccagaagctatctgtcgggcatcgcacacaggaatccgtctgtaatgcaccgcttattgcttggtt

SEQ ID NO: 50967 - DNA, 752 bp, Zea mays
  misc_feature: Ceres CLONE 1464639-F
  misc_feature: Encodes the peptide sequence at SEQ ID NO. 50968
ggagctccccgcggtggcggccgctctagaactagtggatcccccgggctgcaggaattcgtctcacccctaatcgaaaactctctcacacacacagtcacacacacaccgtcctccctccttggtccttggctccccttgctaccttgccttcacagatctcccgctccccaacagaactgtcacgtctcgacgcccgggggccgtggtattaccgctcttcacggctcggaggtggtggcgcgcagctgaccggatcgagcatcgcatggacggcggcggcgggctgggcggcctgcgttggaccgcgcaagaggcgtctacgatcggaggcatcgccacggtgtcactgctgcactccttcatccccacgcactggctccccttctccatcgtcgcgagagcacagcgctggccgctctcctgcacccttctcgtcactgcatttggaggtgctcttcatgttgcttccacggctcttcttgagataactgcacttactatggcaaatacatatgctggaccaatagacagtgcatagacttgcctcactgttgctgatttttctagaagcaagtaatatcctcatgtttgcctgaggaaaaagtggtaatacccgtgccccatatcatcccatggaaaaaatgtcactctgccggactggaacttgcacctgcataatacctttgtgcgacaactcttccaatttttacttgctggtgggcaactcttctcaatgatgattcttcgca

SEQ ID NO: 50968 - protein, 90 aa, Zea mays
  misc_feature: Ceres CLONE 1464639-F
MDGGGGLGGLRWTAQEASTIGGIATVSLLHSFIPTHWLPFSIVARAQRWPLSCTLLVTAFGGALHVASTALLEITALTMANTYAGPIDSA

SEQ ID NO: 50969 - DNA, 765 bp, Zea mays
  misc_feature: Ceres CLONE 1464640-F
  misc_feature: Encodes the peptide sequence at SEQ ID NO. 50970
  misc_feature (609)..(609): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (664)..(664): n is a, c, t, g, unknown, or other
aagctggagctccccgcggtggcggccgctctagaactagtggatcccccgggctgcaggaattcgtctcacccctaatcgaaaaatcagtctccccttccaaaaccggatttgcgaaccacacctagcagccgaggttagcacgcgtcctgcgtccatggaggacgaggagcacgaggtgtacggccaggagattcccgttgacggcgaggacgtcgacatggctgccggcgacgatgccaccaagctgcaggaacttgacgatatgaagcgccggctcaaggaaatggaggaggaggccgccacgctccgcgagatgcaggccaaggttgccaaggagatgcaaggtgtagatcccaatgcaaccacatctgaaaacaaagaggagatggattctcggtcagtattcattggaaatattgactatgcgtgcactccagaagaagtgcagcagcacttcaattcttgtggaactgtcaacagagttacaatcctgactgacaagtttgggcaaccaaaaggttttgcttacgtggaatttgtggaagttgaagctgttcaggaagctatcaagttgaacgagtcagagttgcacggtcgccaactcanggtggcaccgaagaggactaaacgtccctggatgaagcaacccgnnncgtcgagnttcaatcgttaccatgggcacccctacatgaggccgtatgggtatagtccttatggttatgggagattccccagattccgccgcccgcagagacctaattt

SEQ ID NO: 50970 - protein, 202 aa, Zea mays
  misc_feature: Ceres CLONE 1464640-F
  misc_feature (83)..(152): Pfam Name: RRM_1 Pfam Description: RNA recognition motif. (a.k.a. RRM, RBD, or RNP domain)
  misc_feature (151)..(151): Xaa is any aa, unknown, or other
  misc_feature (166)..(166): Xaa is any aa, unknown, or other
  misc_feature (167)..(167): Xaa is any aa, unknown, or other
  misc_feature (169)..(169): Xaa is any aa, unknown, or other
MEDEEHEVYGQEIPVDGEDVDMAAGDDATKLQELDDMKRRLKEMEEEAATLREMQAKVAKEMQGVDPNATTSENKEEMDSRSVFIGNIDYACTPEEVQQHFNSCGTVNRVTILTDKFGQPKGFAYVEFVEVEAVQEAIKLNESELHGRQLXVAPKRTKRPWMKQPXXSXFNRYHGHPYMRPYGYSPYGYGRFPRFRRPQRPN

SEQ ID NO: 50971 - DNA, 748 bp, Zea mays
  misc_feature: Ceres CLONE 1464641-F
  misc_feature: Encodes the peptide sequence at SEQ ID NO. 50972
ggagctccccgcggtggcggccgctctagaactagtggatcccccgggctgcaggaattcgtctcacccctaatcgaaaaaatgcggtttcgtatttttttgctgcgaattgcgaatgaccaactctttctaagggaaattatatctcaggtgcttaggagtctgccatggccagcgagaataagggatttacgttcgaggaagtccccaagcacaacgtcaccaaggactgctggatcatcatcgccggcaacgtgtatgatgtcactccttttatggatgatcatcctggtggatatgaggttttgctagctgtaactggcaaagatgctacacctgattttgaagatattggccacactgattccgcaaggaacatgatggagaactaccacatcgggcagatagatgctacaacaatcccatcaaagcgaacttatgtgcacccccagcaagcgcccagccactcagacaagaataatgatctcctcatcaagatcctgcagttccttgtgcccattatgatcctgggccttgcatttggtatacgtcagtacaccaaatcagagtactactgttcttgaagacttgcctttggagtctgttttatggtaatggtttggatgagaacagttcagataatgcttagtgtatttgtcaggtggatgtcatctcattggtcatatactatgtattatgcacatccatgtgctgccgagaaagacaaatacgatacgctcgaagtacc

SEQ ID NO: 50972 - protein, 138 aa, Zea mays
  misc_feature: Ceres CLONE 1464641-F
  misc_feature (7)..(81): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MASENKGFTFEEVPKHNVTKDCWIIIAGNVYDVTPFMDDHPGGYEVLLAVTGKDATPDFEDIGHTDSARNMMENYHIGQIDATTIPSKRTYVHPQQAPSHSDKNNDLLIKILQFLVPIMILGLAFGIRQYTKSEYYCS

SEQ ID NO: 50973 - DNA, 802 bp, Zea mays
  misc_feature: Ceres CLONE 1464643-F
  misc_feature: Encodes the peptide sequence at SEQ ID NO. 50974
  misc_feature (302)..(302): n is a, c, t, g, unknown, or other
tggagctccccgcggtggcggccgctctagaactagtggatcccccgggctgcaggaattcgtctcacccctaatcgaaaaccattctctctctttctcctgttccccgcgagagtcgctcaaggccgcggcgaggagaagcggcagcgcgtcacctctccaatggcatccccgtccttcctccgtgcaacctgtgcaccctcatgaggactagttcactccctgctgtcattgaggcttctggcaatgatgactggaagaaacgaaaggaagcacagagcctgaagaagctcgaggtttanaagaaagagattgagaaggagaactcttctcactgcaacacttcaaaggaagctgctgggccaagtccaaaaaaaatgaatgcaaaccctgtccaattagtaattccgaaaaaaaatattggccacggctaaacaaaacccttaacatggcaaaactctggggagaggggctccaccaaaacccccggttaatttacctccaaaaaaattttctccccaaagaaaaaaaaaccaaacctcccctcttaaggagaaccccccccttaggagagaaaaaacccccaccggttttctcccccccgggaaaattataaagggggggggggcccatttgggccgggttttttttttcgcccccaaaaaaccccttttttgtgggagagaaaaaaaaatttttttttggcgggggggcggccaacccccccttggggaaaaaaaaaaaaaataaaaaaaaaaaaaaagggttttttcctccccacccccccccacagccaaaggaa

SEQ ID NO: 50974 - protein, 76 aa, Zea mays
  misc_feature: Ceres CLONE 1464643-F
  misc_feature (33)..(33): Xaa is any aa, unknown, or other
MRTSSLPAVIEASGNDDWKKRKEAQSLKKLEVXKKEIEKENSSHCNTSKEAAGPSPKKMNANPVQLVIPKKNIGHG

SEQ ID NO: 50975 - DNA, 897 bp, Zea mays
  misc_feature: Ceres CLONE 1464648-F
  misc_feature: Encodes the peptide sequence at SEQ ID NO. 50976
  misc_feature (1)..(1): n is a, c, t, g, unknown, or other
  misc_feature (65)..(65): n is a, c, t, g, unknown, or other
  misc_feature (614)..(614): n is a, c, t, g, unknown, or other
  misc_feature (723)..(723): n is a, c, t, g, unknown, or other
  misc_feature (750)..(750): n is a, c, t, g, unknown, or other
  misc_feature (760)..(760): n is a, c, t, g, unknown, or other
  misc_feature (794)..(794): n is a, c, t, g, unknown, or other
  misc_feature (828)..(828): n is a, c, t, g, unknown, or other
naactggagctccccgcggtggcggccgctctagactagtggatcccccgggctgcaggaattcntctcacccctaatcgaaaacttcccctcgcgcaccgctcctgtccaccctgccaccgccgacgccgcgccgccgcagcaactgtgaccgtcgctatggcccgtatcaaggtgcacgagctccgggggaagagaaagacggacttgcaggggcagctcaaggacctgaatcctgacctctccctcctccgcgtagccacggtcaccggcggcgcaccccaccttctcctccagatcaaggaggcagcgcacgtctatctcgcgcgggctcacagtgagtgctgcctaagccagaagttctgggttgggggggaggcggacaaacaagaagagatttgctacccatgtgagatcttttatttgaaaccccaccccggccattgcgtggttagggtgtggtccagggggcgcctcgtcttcccccgcgcccacccccgcgccgacccagtcacccgcccccgcgacgggcctccccccccaggagcctagaggacaccttatcttttgggggccttgggagccccaggcggggcccccccccagtcgcggcntgcaccctttgacgtatcccgcccttgtggcgcagatctggagttggtctccgggccagtggtacatttcgcgcgccatggttggcgaacgactagtaattagagaggntccgctcggggcttcgacctacagggngggagacgcntgtcccttgtcactcggtgagacttgtcgtgtcntctcgccctgcgacgcgacgggcgagaagtctcngctcctctcgcaaggagaccctccgccgcacccgagcagtggcgcgtgacttgccgcgcgcccccgagg

SEQ ID NO: 50976 - protein, 130 aa, Zea mays
  misc_feature: Ceres CLONE 1464648-F
MARIKVHELRGKRKTDLQGQLKDLNPDLSLLRVATVTGGAPHLLLQIKEAAHVYLARAHSECCLSQKFWVGGEADKQEEICYPCEIFYLKPHPGHCVVRVWSRGRLVFPRAHPRADPVTRPRDGPPPPGA

SEQ ID NO: 50977 - DNA, 771 bp, Zea mays
  misc_feature: Ceres CLONE 1464649-F
  misc_feature: Encodes the peptide sequence at SEQ ID NO. 50978
  misc_feature (370)..(370): n is a, c, t, g, unknown, or other
  misc_feature (411)..(411): n is a, c, t, g, unknown, or other
  misc_feature (491)..(491): n is a, c, t, g, unknown, or other
ggagctccccgcggtggcggccgctctagaactagtggatcccccgggctgcaggaattcgtctcacccctaatcgaaaacctttgccctctccgcgcaccttccaccacgctctggaagctgtttcccctttctcgagagtttagaaagctggtgcagagatggccggggagagctgcgtccccaagcccctgttcggcggcgccatcttcaccaccttccccgaccgcttccaggacgtgagcaacatccgggaggtccccgaccatcaggaggttctcgttgatccatcccgcgacgagagcctcattttcgagctacttgacctcaagggcgaggtggacgacgccggcagcgcgctctggttccntgcagacatcgccaacgagcaagacgccgggggacacttgntggtagagcattctgggacacttgaactggctgctttgcatctcggagaagctcctgcagtggctgcaactgcagttggncagctgggcgttctcaaagggaggcggccaaaaagccccaaactttgttcgatttacctggcaacatccccttaaggatggggcaccgatgttctttcccccctttgagccttttttaaaacccccccgaggaaaatgcttcgggaatttaacttgtgccgaaaattccggtaaaacaaagagggtgtgcccatgttagaggctccaatttggggggagaaatttaggggggcggggggaaccctttaagggggcccccttaaccagggtaacttccccc

SEQ ID NO: 50978 - protein, 134 aa, Zea mays
  misc_feature: Ceres CLONE 1464649-F
  misc_feature (8)..(135): Pfam Name: Mog1 Pfam Description: Ran-interacting Mog1 protein
  misc_feature (70)..(70): Xaa is any aa, unknown, or other
  misc_feature (84)..(84): Xaa is any aa, unknown, or other
MAGESCVPKPLFGGAIFTTFPDRFQDVSNIREVPDHQEVLVDPSRDESLIFELLDLKGEVDDAGSALWFXADIANEQDAGGHLXVEHSGTLELAALHLGEAPAVAATAVGQLGVLKGRRPKSPKLCSIYLATSP

SEQ ID NO: 50979 - DNA, 618 bp, Zea mays
  misc_feature: Ceres CLONE 1464653-F
  misc_feature: Encodes the peptide sequence at SEQ ID NO. 50980
  misc_feature (225)..(225): n is a, c, t, g, unknown, or other
  misc_feature (228)..(228): n is a, c, t, g, unknown, or other
  misc_feature (235)..(235): n is a, c, t, g, unknown, or other
  misc_feature (236)..(236): n is a, c, t, g, unknown, or other
  misc_feature (241)..(241): n is a, c, t, g, unknown, or other
  misc_feature (253)..(253): n is a, c, t, g, unknown, or other
  misc_feature (287)..(287): n is a, c, t, g, unknown, or other
  misc_feature (293)..(293): n is a, c, t, g, unknown, or other
cgattgggtacgggccccccctcgagccctgcagtggtaaaggggcgggggaggggacccctggctcgccgactcggctgacccgggccgggtgttcgtcgccggcgactcagcgggcgggaacatcgtccaccacgtcgccgtccgccgccctcggctcgcggccttcggcgagctcgaccccgtacgcgtcgccgggcacgtcatgctctgcccgtttcttcngcngggcaannagacngcgtccgaagcngaatttcccgcccggcccgtttctgaacgctgcntggacnaacaagcttggcggcttgcgctgcccccggcccccacaagaacaaccgttctcggaaccgtttcggccggaaagcccccggctgtggggctgggggaaattcccttccccccaaactcttttgggcccggggaaagacctgtgttccaaccccaaggggaaaattcccccgggttaggggttgggaaacacctggagatttttaattttagggtccacccccggttttttttccgggaagccgcgccccaaccccccaagaagatgtgcccccttcctcaacgcgtttttgggtgggggaaaggggaaagcgaattccttccttt

SEQ ID NO: 50980 - protein, 137 aa, Zea mays
  misc_feature: Ceres CLONE 1464653-F
  misc_feature (7)..(7): Xaa is any aa, unknown, or other
  misc_feature (8)..(8): Xaa is any aa, unknown, or other
  misc_feature (10)..(10): Xaa is any aa, unknown, or other
  misc_feature (11)..(11): Xaa is any aa, unknown, or other
  misc_feature (28)..(28): Xaa is any aa, unknown, or other
  misc_feature (30)..(30): Xaa is any aa, unknown, or other
MLCPFLXXGXXTASEAEFPARPVSERCXDXQAWRLALPPAPTRTTVLGTVSAGKPPAVGLGEIPFPPNSFGPGERPVFQPQGENSPGLGVGKHLEIFNFRVHPRFFFREAAPQPPKKMCPLPQRVFGWGKGESEFLP

SEQ ID NO: 50981 - DNA, 710 bp, Zea mays
  misc_feature: Ceres CLONE 1464658-F
  misc_feature: Encodes the peptide sequence at SEQ ID NO. 50982
  misc_feature (394)..(394): n is a, c, t, g, unknown, or other
  misc_feature (427)..(427): n is a, c, t, g, unknown, or other
  misc_feature (442)..(442): n is a, c, t, g, unknown, or other
  misc_feature (468)..(468): n is a, c, t, g, unknown, or other
  misc_feature (484)..(484): n is a, c, t, g, unknown, or other
  misc_feature (516)..(516): n is a, c, t, g, unknown, or other
  misc_feature (531)..(531): n is a, c, t, g, unknown, or other
  misc_feature (532)..(532): n is a, c, t, g, unknown, or other
  misc_feature (573)..(573): n is a, c, t, g, unknown, or other
cgattgggtaccgggccccccctcgagccactgcagtggtaaaggtcgcaccaccgccgcgccgcccaaatcacagccaccgccgccatggccgcctccagccgccctctcgtctccgtgaaagccctggagggcgacatggtcacggacgcccccggcatcgccttgccgcccgtcttcggggcaccgatccgcccggacgtggtccgcttcacccacaagctgctgtcctgcaacaagcgccagccttacgcagtctcccgccgcgctggccaccagacgtcggccgagtcctggggtacgggccgcgctgtgtcccgtatcccccgtgtccccggcggtggcacccaccgcgccgggcagggagtattcggttatatgtggtgtggtggantcatgttcccccccccccccgatgtggcgcagngtgggcgggagcganaacgtaatcttccgcccgcgccccgntgcctcggttctccgnggtcttcgcggatccgcccccttgtccctgtnaggcgttgctccganncgaggcctgctcctttaaattctggtggttttttttcttcnctttttgcgatgtactcacgatttcgcccccccccaagggggctccagtcgccttttaacccccggcttttgatactcctctctctacggcccccccgtgattctctcacgtattctctcttgttcttctttctcct

SEQ ID NO: 50982 - protein, 207 aa, Zea mays
  misc_feature: Ceres CLONE 1464658-F
  misc_feature (23)..(192): Pfam Name: Ribosomal_L4 Pfam Description: Ribosomal protein L4/L1 family
  misc_feature (103)..(103): Xaa is any aa, unknown, or other
  misc_feature (114)..(114): Xaa is any aa, unknown, or other
  misc_feature (119)..(119): Xaa is any aa, unknown, or other
  misc_feature (133)..(133): Xaa is any aa, unknown, or other
  misc_feature (148)..(148): Xaa is any aa, unknown, or other
  misc_feature (149)..(149): Xaa is any aa, unknown, or other
MAASSRPLVSVKALEGDMVTDAPGIALPPVFGAPIRPDVVRFTHKLLSCNKRQPYAVSRRAGHQTSAESWGTGRAVSRIPRVPGGGTHRAGQGVFGYMWCGGXMFPPPPDVAQXGRERXRNLPPAPRCLGSPXSSRIRPLVPVRRCSXXRPAPLNSGGFFSSLFAMYSRFRPPPRGLQSPFNPRLLILLSLRPPRDSLTYSLLFFFL

SEQ ID NO: 50983 - DNA, 730 bp, Zea mays
  misc_feature: Ceres CLONE 1464661-F
  misc_feature: Encodes the peptide sequence at SEQ ID NO. 50984
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
ggtgagtatttncannncccccatacaaaaagaagaagagcaaannntaaaacnnncccgattgggtacgggccccccctcgagccctgtttcaaaaaagggagtgaataccggctggtaaccaaaaaagtgggactacggcgagcagagcacagcacggcacagcagcgctacacgttgggcgtgcatccattcacgatcatggacgacggcgactggatcacagcgaggtccctcctctgctcgattcccgcgcggaccccgctggtggtggactacgtcgacgacgagtccttccccgtcgaccttcgactcccgcgtcgtcgtccgcgccaacatgctcgccgcgcgggccattcgcggcggctccgtgatcgcctgccgcgctgtccggcacggcgtcgccggtggtgactgcacagatcacggcgccggattcgttggcgcgcttgccctgggcggactggtaggactacggctggacgacgtcgtggcccgggatcccccccaccagccccacgagccaggactaagccgaggccgagggaacccgccgccgggaagtagggcatccgagcgcacccagccggcgtccagcgggggaccacctccggctttgactcgttcgttccttcacgctcaaaggcgggacccgccattacgagctcccccggcggctggcccgcttccccccgttgaaccccgcccccccaattatatatacaggaca

SEQ ID NO: 50984 - protein, 70 aa, Zea mays
  misc_feature: Ceres CLONE 1464661-F
MDDGDWITARSLLCSIPARTPLVVDYVDDESFPVDLRLPRRRPRQHARRAGHSRRLRDRLPRCPARRRRW

SEQ ID NO: 50985 - DNA, 668 bp, Zea mays
  misc_feature: Ceres CLONE 1464664-F
cgattgggtacgggccccccctcgagccactgcagtggtaaaggggggtgtaaagtaatgatatattggttttattgtgtacattgtagagtgctggaacagattcaactgtaaatttatggttggctaaagttagcaacaatgattctgaacctgataggtctctaattttttctccatgatttctcaaatttttttcttagtgttttcttcaaatttgtgatattgatgccgtggtcattttttacagcccttctggttcacccaatagacaagaagaaccattacttaactcatatactgactatgaagacagcatctatggtattgcatggagctcccatgatccatcattattcgcttctttgtcctatgatggaagggttgtcttggaatcagtgaagccctacttgcagagaaaatgaatcttgctggtctaacttttggattgtaaggtgtaggatatgattcctcatttcctttatcttgtccttattgccgaagttatctcatgtcctaataaactgttctctgtccctgcagcctacaggcttgcttgtttatatttgatgcgttatagttttgccttatattctgtaccctcttgacaaccatttatgtgatgatgtgttttactgttgtagcaatggcagacaaacataataagg

SEQ ID NO: 50986 - DNA, 1098 bp, Zea mays
  misc_feature: Ceres CLONE 1464670
  misc_feature: Encodes the peptide sequence at SEQ ID NO. 50987
catcttcggtcacgaccaccacgacccacagagtgacagataccatgtcaggtccgagagtccagccagttgtgaagcaatccgagtcgctcgaggccgcctggaagcgcaccgtcgcgcgtctggcacacattcaatcgcatctcgatgttgcgccgcgcagtgggaagcttaagggcaaagtatgcgtcgttacaggcgttggatctacgaagggcatcggaagagcgacatcgctgttgttcgcgcacgagggcgctgcacacctgtatctccttgactttgtaaaggataatcttcctgacctcaaatccactatcgagcagaaatatcccgatgtcaaggtcacggtcatacaagcagatgcggcggacgaagcggctatagagtccgtctgtcagcaggccatggatgaggaagggcgcctggatgtattctacgcaaacgccggtgtcgccacaggcaatacgcttgcagagacttcggcggctcagttcaccgagatcatgcgtattaacgcgctctcatgcttccttgccttaaagcacgcatcagctcggatgcagaaggcgaatccttcgagagggaaggaatacggagggggtagcatcataatgaccgcttcagtggccggtgtacgctccggggctggaggtcccgattatagcgcaagcaaggctgctgtgaacaatttggcacaaactggggcgtggcaactgcagcgcagcgacgtccgagtcaactcggtttgcccagggcttatcgagacaggcatgacagtgggcacgttcgattatgcgcggtctcggggcagcggcgcaaagattggacagctaaaccccatgggccgttacgctgtagcagaggagatcgcacaggttgtgctattcttggcctcagatgaatcgagctatgttaacggccagaattgggctgtcgacggtggactctcggccagtgtcccggttgtacctggcaaatttgcatgagcgtccgtacccttgctcgctgggtataatacagtcggactgctttggtttctccatgtaactttttaagctcggacaatgacgggttgtgtctcaaaaaaaaaaaaaa

SEQ ID NO: 50987 - protein, 314 aa, Zea mays
  misc_feature: Ceres CLONE 1464670
  misc_feature (46)..(226): Pfam Name: adh_short Pfam Description: short chain dehydrogenase
  misc_feature: SWISSPROT Homolog: EC 1.1.1.100 3-oxoacyl-[acyl-carrier-protein] reductase
MSGPRVQPVVKQSESLEAAWKRTVARLAHIQSHLDVAPRSGKLKGKVCVVTGVGSTKGIGRATSLLFAHEGAAHLYLLDFVKDNLPDLKSTIEQKYPDVKVTVIQADAADEAAIESVCQQAMDEEGRLDVFYANAGVATGNTLAETSAAQFTEIMRINALSCFLALKHASARMQKANPSRGKEYGGGSIIMTASVAGVRSGAGGPDYSASKAAVNNLAQTGAWQLQRSDVRVNSVCPGLIETGMTVGTFDYARSRGSGAKIGQLNPMGRYAVAEEIAQVVLFLASDESSYVNGQNWAVDGGLSASVPVVPGKFA

SEQ ID NO: 50988 - DNA, 660 bp, Zea mays
  misc_feature: Ceres CLONE 1464679-F
  misc_feature: Encodes the peptide sequence at SEQ ID NO. 50989
cgattgggaccgggcccccctcgagccactgagtggtaaaggtgtggcgctgtcgatcctaacagacgtcgatcgttccatcgaccggccggccggccagcctagctcttggcaggctcttgctccgatcggatcgagcgccggacaaggcaaggcagccgtacgtacgagtacgacgatggcgcagggcagccgcagcgctgccgtgcccgccgcagcgtccttcttcgcccttctcgccgtggcggccccgctgctcctgtgctgcgcgccggccgccgcggagctggccaggctggagcacccgcccaaggacggcggctcgctcagcctgctcgtcgtcggcgactggggccgaaagggcacgttcaaccagtccagggtcgcccatcagatgggcagggtcggggagcagctcagcatcgacttcgtcatatccaccggcgacaacttctacgagaacggcctgacgggcacggacgacgaggcgttcgagcagtctttcaccgatatctacacggcgaagagcctgcagaagccgtggtacctggtgctgggaaccatgactacaggggtgacgcgctcgcgcagctgagcccggtcctgcggaagatcgacagccggttcatctgcatgaaatccttcgtcgtcaacgcagaa

SEQ ID NO: 50989 - protein, 138 aa, Zea mays
  misc_feature: Ceres CLONE 1464679-F
  misc_feature: SWISSPROT Homolog: EC 3.1.3.2 Acid phosphatase
MAQGSRSAAVPAAASFFALLAVAAPLLLCCAPAAAELARLEHPPKDGGSLSLLVVGDWGRKGTFNQSRVAHQMGRVGEQLSIDFVISTGDNFYENGLTGTDDEAFEQSFTDIYTAKSLQKPWYLVLGTMTTGVTRSRS

SEQ ID NO: 50990 - DNA, 664 bp, Zea mays
  misc_feature: Ceres CLONE 1464687-F
  misc_feature: Encodes the peptide sequence at SEQ ID NO. 50991
cgattgggtaccgggccccccctcgagccctgcagtggtaaagggagatctccagggtacgagcgcattcgcgattttggccgcctccgccgccgtccgggaagatggcgggtctgggaaaggcgatgtacgcggtggggttctggatccgggagactggccaggccctcgaccgcctgggctgccgcctgcagggcaagtacttcttccacgagcagatttcaaggcatcgcaccatcatgaatatctttgacaaaacccctcatgtgcataaagacgcatttgttgctccaagtgcatcccttattggtgatgttcaagtcgggtcaggagcttccatttggtatgggtgcgtcgttagaggggatgcaaacatcatacaaattggatctgggacccatatacaagacaattctcttatacatgtggctaaatctaatctaagtgggaaggtctttccaacaaccattggtaataacgtcacagtaggtcatagtgctgtgttacaaggatgcacggttgaggatgaggctttttgttggcattggggcaaccctaatagatgggggtgttgttgaaaaccacggaatgggcgcctgctagacccctcgtaccggaaaaatactaggatccctttggggaaggggttggggaaggaaaccct

SEQ ID NO: 50991 - protein, 157 aa, Zea mays
  misc_feature: Ceres CLONE 1464687-F
  misc_feature: SWISSPROT Homolog: EC 4.2.1.1 Carbonate dehydratase
MAGLGKAMYAVGFWIRETGQALDRLGCRLQGKYFFHEQISRHRTIMNIFDKTPHVHKDAFVAPSASLIGDVQVGSGASIWYGCVVRGDANIIQIGSGTHIQDNSLIHVAKSNLSGKVFPTTIGNNVTVGHSAVLQGCTVEDEAFCWHWGNPNRWGCC

SEQ ID NO: 50992 - DNA, 635 bp, Zea mays
  misc_feature: Ceres CLONE 1464693-F
  misc_feature: Encodes the peptide sequence at SEQ ID NO. 50993
caattgggtccgggccccccctcgagccctgcagtggtaaaggcttgtgtggagcaggggtcgacagggttaccccagagcccccatgggagcgcggcgatcgagatgggggatctcatcaggagaactcgggcgtgacagtgatgtcaagggactccgacaagctcaggaggcgcggcggcggctcggcttcctcgtcggactccgacgaaaacatgctcttgggcgacggtcgccgtgaatcccaagatctaccgcatcttccggcgcgagacttcgtgcactccgtcctccgcggcttgagccggtcgatctgtttctatggatgcagctcaggatctctgtggggatgatctcaagcgcacctgccttctggctgctggttgacgtcatggattaccacctcctcacactgctaggccactgcctcatcctcacgatgcccatcatgttcctctggtcctgtgccacgacattcatcaccgagtatcctcctaccattcccacagtgatcatccttgatgacctggctgtgactgttgcgcgtaccctgtagtattccatcatccgggtgtttgctacgtagtcgtcattgtccatggggctgacctccgtaatttctgattgcgtccgcc

SEQ ID NO: 50993 - protein, 76 aa, Zea mays
  misc_feature: Ceres CLONE 1464693-F
MQLRISVGMISSAPAFWLLVDVMDYHLLTLLGHCLILTMPIMFLWSCATTFITEYPPTIPTVIILDDLAVTVARTL

SEQ ID NO: 50994 - DNA, 660 bp, Zea mays
  misc_feature: Ceres CLONE 1464701-F
  misc_feature: Encodes the peptide sequence at SEQ ID NO. 50995
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (651)..(651): n is a, c, t, g, unknown, or other
cgattgggtacgggccccccctcgagccctgcagtggtaaaggcataattaaaactgcatgtctgtctgtgtgtcatatgaacacacagggcctgagatctggaaggacactgccggcaaggtggacgtattcgtggccggttcaggctcgggaggcacggtgtctggcgtcggcaagtacctcaagacgcagaaccccagcgtcaaggtcatctgcgttgagcctgccgagagcccagttgtttcaggcggggaaccaggcagccacaagatccagggaatagggccgggattcataccggaagtgctggacacctcggtcatcgacgaggccgtcacggtgaccaccgaggaggcgatggcgggcgcccggaggctggccagggaggagggcctgctcgtcggcatctcttccggagccaacctggcggcctgcttgaaggttctgcactgcaccgcgacaccccccctaacaaaaaagctcgtcctgcatcagttgtcatttctctcgttctggatgagttttcttgaaaaatcatggatgtttatctaggtcgcggcgcgagaagaagcaaggggaagatgatcgtcaccgtgtttccgagcggggcgagaagtacatgacccctcgactgtnnncgcgcgcagagnagagtgatt

SEQ ID NO: 50995 - protein, 164 aa, Zea mays
  misc_feature: Ceres CLONE 1464701-F
  misc_feature (1)..(149): Pfam Name: PALP Pfam Description: Pyridoxal-phosphate dependent enzyme
  misc_feature: SWISSPROT Homolog: EC 2.5.1.47 Cysteine synthase
MSVCVSYEHTGPEIWKDTAGKVDVFVAGSGSGGTVSGVGKYLKTQNPSVKVICVEPAESPVVSGGEPGSHKIQGIGPGFIPEVLDTSVIDEAVTVTTEEAMAGARRLAREEGLLVGISSGANLAACLKVLHCTATPPLTKKLVLHQLSFLSFWMSFLEKSWMFI

SEQ ID NO: 50996 - DNA, 656 bp, Zea mays
  misc_feature: Ceres CLONE 1464707-F
  misc_feature: Encodes the peptide sequence at SEQ ID NO. 50997
cgattgggtaccgggccccccctcgagccactgcagtggtaaagggtggagcaaaagttgagaggtgaaattcgatcttgtaatcttgaagtaaaatctctcagacaagagaacattgcactcttaaatcgtttacaaggtgctggaaatggagcaagcttctcctcgattcgacttgatcaggagcttcaagctagggtggacaacctgcaaatgcaaggcttgtcactacttgataagattagccaactttgtaccaaattgctggatctgatgaaacataagagacatgaaaatgaatatttgtgtggcaatgatgtgtcaacattcagtgattacatatttgagtaccagagcatcaaaggaggaattgaaggtctgaagctaagtttgaaagcaataaattctatactagctgaaaagcaaaatgctaaagaaaaatctggtgaaattgtagctgaaggtagtccttccaaagatcaaacggatgattttggactcaagctgaaagaagaggctatgctgaatagagtactgaaggaggcagtcttgtcaaaagaagttgccattgaacaattgcaatctgatctggcatcttcacttcgcatccaagacgttatgagaaacgagatccagagggttcaggatgagctttc

SEQ ID NO: 50997 - protein, 147 aa, Zea mays
  misc_feature: Ceres CLONE 1464707-F
MQGLSLLDKISQLCTKLLDLMKHKRHENEYLCGNDVSTFSDYIFEYQSIKGGIEGLKLSLKAINSILAEKQNAKEKSGEIVAEGSPSKDQTDDFGLKLKEEAMLNRVLKEAVLSKEVAIEQLQSDLASSLRIQDVMRNEIQRVQDEL

SEQ ID NO: 50998 - DNA, 658 bp, Zea mays
  misc_feature: Ceres CLONE 1464709-F
  misc_feature: Encodes the peptide sequence at SEQ ID NO. 50999
cgattgggtaccgggccccccctcgagccctgcagtggtaaaggaacctcccttttcggagatctcgccgcctccgccgtcgacttccgtcgcccccctatcccgcgtccgggcttacccgatggcacggctgcactggcttgaggctgtcctgccgctggggatcatcggcggcatgctctgcatcatgggcaacgcccagtatttcatccacaaggccacgcacgggatgccgaagcacatcgggaacgatatgtgggacgtcgccatggagcgccgcgacaagaagctcgtggaacaatcctccggcaactagggtattgatcaacctcaaacttttctggatgttgacgaacctcgatcaaagcacaaaactactgctcttttgtttcctgtacaattggaaccaagacttgtttgttttgctttgaatatcaacactacggagaaattctgtatctgacatctgtttaattgaacacagccaaatactttgtcaattgtgtatgcacaattatttcccaccaccggggcagatccatgaacaccgaaaaaaacacgttttcgcaaaaaaaaaaaaaaaaaaacccacaagctcttggaaattcttggcaaccccggggggatccacttattttctagaagcggccccccaccg

SEQ ID NO: 50999 - protein, 64 aa, Zea mays
  misc_feature: Ceres CLONE 1464709-F
MARLHWLEAVLPLGIIGGMLCIMGNAQYFIHKATHGMPKHIGNDMWDVAMERRDKKLVEQSSGN

SEQ ID NO: 51000 - DNA, 692 bp, Zea mays
  misc_feature: Ceres CLONE 1464722-F
  misc_feature: Encodes the peptide sequence at SEQ ID NO. 51001
caaatgggtaccgggcttctttcgagcactgcagtggtaaggagcctgctccttatcgccggctgccgtgccgccgcgtcctgctccccgctcccgtgttcgtcgtccgaagcaccgccgagcgccgcggcctcgcgccagcgccaccgcccagaaaccatctttccctcccgcgccgctgagcccatagcccatatcggggcctcgttcgacttcgaccgaagcgcgctgtgtcaaatttctgcgaccttgccgccgccttcatcattctggagctcggattgatttcttcctttgctgagctgtcattaccgaactaaaaacagtttctgagagcaagcgtcacaattgccatggaagctgggagaatggatcagccttgcatggcttctatcaaaagccagcctttcgtgggtgaaactgaaccagtgaagaaagccagtggggacatgcctgcggcgccgacaggaagcgggtgcttcgactgcaacatctgccttgaatttgcaaccgaacccagtggttaccccccgggggtccatctctactgcttggccttggaaactacaaaagggctggcccccctggggtgggaagttcaacacccctgtcgaaaaccggcagttttcgggcaaggcgggccatgggccctggtaaggccgaggtaaaccacccctcaccgggaaaacatg

SEQ ID NO: 51001 - protein, 99 aa, Zea mays
  misc_feature: Ceres CLONE 1464722-F
MDQPCMASIKSQPFVGETEPVKKASGDMPAAPTGSGCFDCNICLEFATEPSGYPPGVHLYCLALETTKGLAPLGWEVQHPCRKPAVFGQGGPWALVRPR

SEQ ID NO: 51002 - DNA, 664 bp, Zea mays
  misc_feature: Ceres CLONE 1464723-F
  misc_feature: Translation starting site: 404
  misc_feature: SWISSPROT Homolog: EC 4.4.1.5 Lactoylglutathione lyase
cgggccccccctcgagccctgcagtggtaaaggacacacttacattcttggaaaatactcaacacagcgactatgtcatcggccggacgacatgacctgacgctgctggtcctgtgggtgaggccgtaggtgctgcgggtgaagttcgcgctcagcctcaaggtcctgagctacaacaacgtggacgatgatctgaggcacaacatggagctcctgctcaagtccaaccccgctgcaccacaacgtccccgtgctgatccagcggtgccagcccatctgctgatctcacgtcatcctgcagtacatcgacgaggccttcggcgggaccggtccgtccctcctccccggcgacccctacgagcgcgccgtcgctcgcttctggaccgtctacatcgactatcagatgctgcccgcctgtaaccactcgacgatgggcaacacggacgactacatctcctacggcaacatacatgccgtcgtgaccgtggacacgctggatggcgcgctgagggacagcttcagtcaccggaagcccttcttcggtgattacagcttcgggtacttcaacgtcccgcatcgagactagctcagatgctgctcgcatcctaggagctgcacggcatcagctccttccacccggagagaactcggctgcagtcgtcgt

SEQ ID NO: 51003 - DNA, 664 bp, Zea mays
  misc_feature: Ceres CLONE 1464724-F
cgggccccccctcgagccactgcagtggtaaagggcagatcgttttcttgcggagtgacgcgctcacacctgtctccttgcccccttcggtcctccctcctccgggcgagctcctctagcacgggtgtaccaagcaaccaccagtccaacaagcgcgcgggcgccatcaggtagaccggcccctgcgttagacccatcccaaccctagctaccgtgacgctcgatcggcttctggtagattgcgcaagaggcgtgcaggtgcaccgcctgtgccgtgaggctgattcatggaagtgcccccactgccaatggcgtcggaatgagagagccgaagcgtagagacggaggcatgcctccccaggctggtctccggcgtcctctcgggggaccacaccggcatcttcgcctttgctggatgcctgacaggagcgttcaccggatcattgcacggccgagcttcggacaacggcgtcctccgtggagccggactgagggcctttgcgagagcgggactatccatcgtagtgctcgacgcttcgcgcgcctactgtagcgcggaccgatcgaacctgcagagcacgtcctccatgggagaattgatagaacagctacttcaagctcgatttgtgcacgatagtatgagccatcggcatatatggcctaa

SEQ ID NO: 51004 - DNA, 648 bp, Zea mays
  misc_feature: Ceres CLONE 1464730-F
  misc_feature: Encodes the peptide sequence at SEQ ID NO. 51005
  misc_feature (570)..(570): n is a, c, t, g, unknown, or other
  misc_feature (611)..(611): n is a, c, t, g, unknown, or other
tcgagccctgcagtggtaaaggctttgcgccgccgcagccccaaaccctcatcccccatcaatctcaggggcgccccagccaccccacccttcactcacctaaccatggcggagcgcggcggcgagcgtggtggagagcgcggcgggttcggccgtggcttcggtcgcggcgggcgcggtgaccgtggtgggcgtcgcggcggccgccgtggcccgcgccaagaggaagagaagtgggttcccgtcaccaagctcggccgccttgtcaaggagaacaagatcaccaagatcgaggagatctacctgcactcgctccccgtcaaggagcaccagatcgtcgagaccctcgtcccggggctcaaggacgaggtcatgaagatcacgcccgtccagaagcagacccgtgccgggcagcgcacccgcttcaaggccttcgtcgttgtcggcgatggcgacggccacgtcggcctgggagtcaagtgcgccaaggaggtggccaccgccatccgcggcgccatcatcctagccaagctctccgtcgtccccgtcaggagggggtactgggggaancagatcggacagccccacaccgtgccctggcagtcaccggncagtgtggctccgtcactgtgcgcatggtgcccgcgc

SEQ ID NO: 51005 - protein, 181 aa, Zea mays
  misc_feature: Ceres CLONE 1464730-F
  misc_feature (84)..(150): Pfam Name: Ribosomal_S5 Pfam Description: Ribosomal protein S5, N-terminal domain
  misc_feature (155)..(155): Xaa is any aa, unknown, or other
  misc_feature (169)..(169): Xaa is any aa, unknown, or other
MAERGGERGGERGGFGRGFGRGGRGDRGGRRGGRRGPRQEEEKWVPVTKLGRLVKENKITKIEEIYLHSLPVKEHQIVETLVPGLKDEVMKITPVQKQTRAGQRTRFKAFVVVGDGDGHVGLGVKCAKEVATAIRGAIILAKLSVVPVRRGYWGXQIGQPHTVPWQSPXSVAPSLCAWCPR

SEQ ID NO: 51006 - DNA, 698 bp, Zea mays
  misc_feature: Ceres CLONE 1464733-F
  misc_feature: Encodes the peptide sequence at SEQ ID NO. 51007
  misc_feature (417)..(417): n is a, c, t, g, unknown, or other
  misc_feature (522)..(522): n is a, c, t, g, unknown, or other
  misc_feature (524)..(524): n is a, c, t, g, unknown, or other
ctggagctccccgcggtggcggccgctctagaactagtggatcccccgggctgcaggaattcgcacgagaccattacctagaacatcctaatcgaaaaaagacgatctgcgaaacaaacactagtgcgtttgcgagagaaaccgagaaagagaagctacagagtcactgaccgaccgctatggcatcgaggcagaacacgcgtgaggcgcgcgccgaggccgacgcgcggcgcgccgtggaggagctggctcgggcgcgggacgagcacctcgagaaggcggaggtgaacgcccgctcggccgcggacgagatcgcgcgctcccgcgccgaccgcggtgccgccggtggcggcggcatcctggagagcgtgcaggagggcgccaggtcctttggcagcgccgtgggccgcaccttcngtggcgccaaggacgcgaccgtggacagacctcgcgacggcgcacaccgcgggcgaacagctcggcgagtacagggactacacccgcgacaaggcccggaaggcnangacagcgtctccggtaaaacggccaaacgccggaggccacccggacaagctgggcaattcaaggcacgcccgttggaaagggcaaggaaaccaaggacccttgcccaaaaaaaaagcgaccccggagggaccaaaaaaaatctcgggaataaaaggacccggggccgaaagggg

SEQ ID NO: 51007 - protein, 173 aa, Zea mays
  misc_feature: Ceres CLONE 1464733-F
  misc_feature (80)..(80): Xaa is any aa, unknown, or other
  misc_feature (115)..(115): Xaa is any aa, unknown, or other
MASRQNTREARAEADARRAVEELARARDEHLEKAEVNARSAADEIARSRADRGAAGGGGILESVQEGARSFGSAVGRTFXGAKDATVDRPRDGAHRGRTARRVQGLHPRQGPEGXDSVSGKTAKRRRPPGQAGQFKARPLERARKPRTLAQKKSDPGGTKKNLGNKRTRGRKG

SEQ ID NO: 51008 - DNA, 776 bp, Zea mays
  misc_feature: Ceres CLONE 1464734-F
  misc_feature: Encodes the peptide sequence at SEQ ID NO. 51009
  misc_feature (50)..(50): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
atatttattattatttttcctcattataaaaaaaaaaaaaaaaaaacaancaannncccgattgggtacgggccccccctcgagccactgctgtggtaaagggtgcatgaacgcccagtatatgctacagcaccgccgcccctggccctgccgcctgcgccggtcgttgccctgtgcactccgcgggcctcgggaatggccaaccaggacatttatcggtttgcccaccctctcctctcttctcttctctcccgcccgctctccctctctcccttctctccggcttccgattgggtattgtttattggcttctggcttcaattaattactgtatttgcatgttcaggtatgttgttcatccatctcgtatgatgaagtgtcttatgctcttttccaattattgttgcaagtaacaaaattagaacatgtccttatgtttagactatgaaagaaaacacttatttcaatttgtaggggaatttttctgtttcagttggcatatcaccatgagcatgcgaattccacccgaaggcccatgcgatcttattgctcccttaaaacttcccaattttttacagtcattaattccttgcctaaccggaagatcatgcccccataacctgttccttaataacgggggcaaaataaccctaggaaaggtatggcaagggcccttgtgcccttcgtattcaacaaatggaaaccatacggccaaaagaacctgggtaagccccccgggataaatagggggggtagaacacaattgcggcgcacac

SEQ ID NO: 51009 - protein, 72 aa, Zea mays
  misc_feature: Ceres CLONE 1464734-F
MNAQYMLQHRRPWPCRLRRSLPCALRGPREWPTRTFIGLPTLSSLLFSPARSPSLPSLRLPIGYCLLASGFN

SEQ ID NO: 51010 - DNA, 690 bp, Zea mays
  misc_feature: Ceres CLONE 1464741-F
  misc_feature: Encodes the peptide sequence at SEQ ID NO. 51011
tccccgcggtggcggccgctctataactagtggatcccccgggctgcaggaattcgcacgagaccattacctagaacatcctaatcgaaaagtgacaacttagcatacactagtgcttttgctagctacttgtgcgagaagagagagcgcacggagatagatatggcgcatatcaagcgcgaaatcaagcccgggagggcgcataccaaggtggccggcgacgacgagatgctgcggaccgggttcttcgaccgcacgccgctggagggcggcaagatcgccgactcccatcccggcgacctcttcgccgctgcccgccacgtcgccgacgccccgtactcatcgcagcaggaaggaccacacgaggaggggaccaacaagaacgccgtcatcgcggagtcggagcccgtccacctgcccgcgagcgcacgaggcgtggccgaagtgaaccgtgctgggccggacgagcagacaggccgcggtcggcagggcatggtcgagcccaccgccggtggacgtcgcttgagattaggtcgcccggccccggcttaacgatccagatcaagcagtactcaactaccgccactacacgacctgctctgctcgtgtcttgtttccagttttctttctctgccagcgatgaagggtttgccaaacttttttgcaccacttatgaatatgcataacgtg

SEQ ID NO: 51011 - protein, 129 aa, Zea mays
  misc_feature: Ceres CLONE 1464741-F
MAHIKREIKPGRAHTKVAGDDEMLRTGFFDRTPLEGGKIADSHPGDLFAAARHVADAPYSSQQEGPHEEGTNKNAVIAESEPVHLPASARGVAEVNRAGPDEQTGRGRQGMVEPTAGGRRLRLGRPAPA

SEQ ID NO: 51012 - DNA, 615 bp, Zea mays
  misc_feature: Ceres CLONE 1464742-F
  misc_feature: Encodes the peptide sequence at SEQ ID NO. 51013
tcgagccctgcagtggtaaagggagcattgcaaaaacccttccatgctgggagacaagtgacatcattatcgagtgtacagaaacaatttatgaatctaccatatccaaaagaagaaacactagctagacactccatattaggacctaatggtcttaatggccggtggaatgggcctgttactggaatcaaggttcaatatccaagcaattttgaattaacacaaaatgatataacaagtttagtgccatccatcttgaaccaagatgatttgcatggttccaatactgcacctgcacctccacctccaagtagctcctcaaatgacaatgacaatatgaaatctgttctctctcttgatgatggtcgatggtctgtaccaacagaagaacacactcaactcccttctgctaaattggaaaagaatttgttccatttgaatatcaaacaaactttctcttcccaccagttttttgccaaaggtacaaaaaaaccaattttctcccatcaaaaaagtttgcccaattccaacccccccggaaatttcccgaaaccctccaggaaaacttgcccccaaattttcaaaaaaattttggattgtgtcccgaaaaacaag

SEQ ID NO: 51013 - protein, 205 aa, Zea mays
  misc_feature: Ceres CLONE 1464742-F
SSPAVVKGALQKPFHAGRQVTSLSSVQKQFMNLPYPKEETLARHSILGPNGLNGRWNGPVTGIKVQYPSNFELTQNDITSLVPSILNQDDLHGSNTAPAPPPPSSSSNDNDNMKSVLSLDDGRWSVPTEEHTQLPSAKLEKNLFHLNIKQTFSSHQFFAKGTKKPIFSHQKSLPNSNPPGNFPKPSRKTCPQIFKKILDCVPKNK

SEQ ID NO: 51014 - DNA, 636 bp, Zea mays
  misc_feature: Ceres CLONE 1464747-F
  misc_feature: Encodes the peptide sequence at SEQ ID NO. 51015
tcgagccctgcagtggtaaaggggactactggagccctataggctatagccaccaccgcactcgcctccctctctccctcccacactccaccacccgcgccgccgcctcctactccgccccggcccctctgatccggaccgagcgccggccatggcgctcgccttcgacgagttcgggcgccccttcattatcctgcgggagcaggagaagaagacgcgccttcgggggcttgacgcgcagaaggccaacatcgcctcggccaaggccgtcgcgcggatcctccgcacgtcgctgggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccggggtggtagtcatggcaggggctcttctcgagcaggctgagaagcttctggagcgtggtattcaccccattagggtggctgaaggctatgagatggcgtcaaaggtagcttttgaccacctaaaacatatatccgaaaagtttgagttccgtgcagacaacaatgaacccctggt

SEQ ID NO: 51015 - protein, 161 aa, Zea mays
  misc_feature: Ceres CLONE 1464747-F
MALAFDEFGRPFIILREQEKKTRLRGLDAQKANIASAKAVARILRTSLGPKGMDKMLQSPDGDVIITNDGATILEQMDVDNQIAKLMVELSRSQDYEIGDGTTGVVVMAGALLEQAEKLLERGIHPIRVAEGYEMASKVAFDHLKHISEKFEFRADNNEPL

SEQ ID NO: 51016 - DNA, 687 bp, Zea mays
  misc_feature: Ceres CLONE 1464753-F
  misc_feature: Encodes the peptide sequence at SEQ ID NO. 51017
  misc_feature (367)..(367): n is a, c, t, g, unknown, or other
  misc_feature (368)..(368): n is a, c, t, g, unknown, or other
cgattgggtaccgggccccccctcgagccctgcagtggtaaaggccatccgccgccgccgccatgccgggcttcgctcagcgtctcgcgggcatcccgtggcggagcatcgcgaggcaaggcctctcccgcgtgttcctggtggcgaaggcctactgcttgatccacgtcgtcaacgaccacctctgctcggtgaccttagtgcggggcgccagcatgctgccgtccctgaacctggcgggcgacgcggtggcggtggacagggtcagcgtgaggctcggccgggtcgcgccgggggacatcgtgctgatgatctcccccgaggacccgcgcaagtcggtcgtcaagcgcgtcgtcgggatgcaggnngactccgtcacctaccttgtcgaccccggcaaaagcgactcctccagaaccgtcgtggtaccgcaagatcatgtctgggtgcagggttacaatatctttgcttctaacgattcgaggcattttggagctgtgccttatgggctgattacaggaaagatctttttgccggttttggcccgccaaagagttttggcgcaaattgatgacgccaccgaaacattctttaacgctgaagaaggagcccgaagaaagtacttgagccacatggacccatatttggtttgcccccgcgccccaaaacattctattcctttaacca

SEQ ID NO: 51017 - protein, 208 aa, Zea mays
  misc_feature: Ceres CLONE 1464753-F
  misc_feature (46)..(125): Pfam Name: Peptidase_S24 Pfam Description: Peptidase S24-like
  misc_feature: SWISSPROT Homolog: EC 3.4.21.89 Signal peptidase I
  misc_feature (102)..(102): Xaa is any aa, unknown, or other
MPGFAQRLAGIPWRSIARQGLSRVFLVAKAYCLIHVVNDHLCSVTLVRGASMLPSLNLAGDAVAVDRVSVRLGRVAPGDIVLMISPEDPRKSVVKRVVGMQXDSVTYLVDPGKSDSSRTVVVPQDHVWVQGYNIFASNDSRHFGAVPYGLITGKIFLPVLARQRVLAQIDDATETFFNAEEGARRKYLSHMDPYLVCPRAPKHSIPLT

SEQ ID NO: 51018 - DNA, 681 bp, Zea mays
  misc_feature: Ceres CLONE 1464757-F
  misc_feature: Encodes the peptide sequence at SEQ ID NO. 51019
  misc_feature (533)..(533): n is a, c, t, g, unknown, or other
acccgcggtggcggccgctctagaactagtggatcccccgggctgcaggaattcgcacgagaccattacctagaacatcctaatcgaaaactctctacctcgagctctactcgcataccactgcatgggtgttggggttcttgtatccctgctagtgatgaccctctcccacagccaccaagtctgctctgtccagagaatcaagtgccagtggtgaccatgctcacaattctttaccccaccatagccagaacattctagggagttgctggcctatatgaagcttgttccataatcatctcaggttctctggaggacatggttgctggagtgacttggccgtccatcttgccaccaggttggacagtcgagtgggaccctacctcggctgaggaggagcatgaggagtgatgggacaggcttccccatctctctgtttatttatcgttagttttatcccgctgcattttgaacaatgatgactacttttgctaaaactctgatgatgatgtaataagtttaatactcttaantgtatggttttatgctcaaaaaaaaaaaaaaaaaagcttatcaataccgtcaacctcgagggggggccggtacccattccccctatagggagtcgtattaccgcgctcactgccgtctttttacacgtcctgactggaaaaaccctgg

SEQ ID NO: 51019 - protein, 30 aa, Zea mays
  misc_feature: Ceres CLONE 1464757-F
MVAGVTWPSILPPGWTVEWDPTSAEEEHEE

SEQ ID NO: 51020 - DNA, 704 bp, Zea mays
  misc_feature: Ceres CLONE 1464758-F
  misc_feature: Encodes the peptide sequence at SEQ ID NO. 51021
  misc_feature (418)..(418): n is a, c, t, g, unknown, or other
  misc_feature (425)..(425): n is a, c, t, g, unknown, or other
  misc_feature (428)..(428): n is a, c, t, g, unknown, or other
  misc_feature (447)..(447): n is a, c, t, g, unknown, or other
  misc_feature (470)..(470): n is a, c, t, g, unknown, or other
  misc_feature (490)..(490): n is a, c, t, g, unknown, or other
  misc_feature (510)..(510): n is a, c, t, g, unknown, or other
ctccccgcggtggcggccgctctagaactagtggatcccccgggctgcaggaattgcacgagaccattacctagaacatcctaatcgaaaaaaaaaagaaaaaggaaattcctctcaacatcaccagaccacgacctccctgccgagctccctccctctccgttggtgatggcatctcagagctccaagaccgcggacaccgccgcgcctccgccggaggttgcagccaccggagaggcggctccgggcgcggcttcttcaacaccggcacaaaaccctaacgctgctgcaaccgcagtggccggggccacggatctagagaagaaatgcgccgcgcggagcggtttgggatgccagtactgatgtcagaggaggaaaagcgcagcagtcgcgccgagagattttggactggctctcnaggtgtnaanggaggaagaaagagaaaantccagggctgaaaggtttggccntttgctcgccctctttctcnagatgagaagctaaaaaaanggcccgttgggaacgatttggccaaagcccaaatgtccacaagccgaaaaaaaaaaaaaaaaggcccaacctgcccaattttcaaaaacctccgggggaatcccaactccggaaaaacggaaaaaaaattttaaaaccgaaccaccccctttttccgcccaacttggttttaacccccttcccttggaaaaggc

SEQ ID NO: 51021 - protein, 64 aa, Zea mays
  misc_feature: Ceres CLONE 1464758-F
MASQSSKTADTAAPPPEVAATGEAAPGAASSTPAQNPNAAATAVAGATDLEKKCAARSGLGCQY

SEQ ID NO: 51022 - DNA, 657 bp, Zea mays
  misc_feature: Ceres CLONE 1464773-F
  misc_feature: Encodes the peptide sequence at SEQ ID NO. 51023
actccgcggtggcggccgctctagaactagtggatcccccgggctgcaggaattcgcacgagaccattacctagaacatcctaatcgaaaagagagatgcgtgttcgtcttccttcccacccatccctgtttcaagctcctcctccttccccagcgggtggccgcagcaatttgcaagcagaggaagaaagcttccgggcgtctcggcgcgaagaacagcgtcacgttctgacggaggagaacaggagaaggtctcgggtttcggccggctgcctgtatgagcgccaccatggcgtggtatccattaccgcagagcggaggcacaggcacgccgtcgggcggcggcgagctgttggacgaccagagcggcggctgggcgctctggagcttcggctcagctgacgacgaccaccgcgctggcgtggtgcgcgcggagacgcacggtaattcacaccaccggaacgaagaagggcggcccgcgcccgccgcatcaacatccgcaggcaacagaagaaatcttcatgaaccatgttttcggaccaaggaggggatgaaaaaaggaccaacccccccctttcaaaggggcttgggaattttccccgggaatccaggggaaccaagtgtgggccttagagaaaaaaattttttaaacggggg

SEQ ID NO: 51023 - protein, 126 aa, Zea mays
  misc_feature: Ceres CLONE 1464773-F
MSATMAWYPLPQSGGTGTPSGGGELLDDQSGGWALWSFGSADDDHRAGVVRAETHGNSHHRNEEGRPAPAASTSAGNRRNLHEPCFRTKEGMKKGPTPPFQRGLGIFPGNPGEPSVGLREKNFLNG

SEQ ID NO: 51024 - DNA, 747 bp, Zea mays
  misc_feature: Ceres CLONE 1464776-F
  misc_feature: Encodes the peptide sequence at SEQ ID NO. 51025
  misc_feature (1)..(1): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
naactttttcacccctcccccacagtttatttttttnntttcccnnnnnnnnacgattgggtacgggccccccctcgagccactgcagtggtaaagggtgctctctgttcccctttacgccgtttcctctcccgactctctcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccagtacgaggacgccgccgacctcttcgacaaggctgcgaactccttcaagctcgccaagaactggagcagagctgcatcagtttacatcaagattgctaactgtcatttgaagggagatagcaagcatgaggctgcctccgcgtacgtcgaggcagcaaattgctacaaaaaagttttcaccctccaggaagctgcgccagccgctaacccagtctgtttaatcttttcttgcaaaattggtaggtttaacattgcctgcaagaatacaccaaggaacattggtgaaattatatcagccaagaccaagattttaaaaaaggctaacataattacctggaaagggcgcagctgacccttttttgaacggggaggggacaggtcgttcttcattccaaaaccccattccaaacaaaaaaagttggcaaaaaaattggcttggctcccaattg

SEQ ID NO: 51025 - protein, 63 aa, Zea mays
  misc_feature: Ceres CLONE 1464776-F
MGDHEARGDDFEKKAEKKLSGWGLFGSSTRTPPTSSTRLRTPSSSPRTGAELHQFTSRLLTVI

SEQ ID NO: 51026 - DNA, 657 bp, Zea mays
  misc_feature: Ceres CLONE 1464781-F
  misc_feature: Encodes the peptide sequence at SEQ ID NO. 51027
  misc_feature (495)..(495): n is a, c, t, g, unknown, or other
  misc_feature (511)..(511): n is a, c, t, g, unknown, or other
cgggccccccctcgagccactgcagtggtaaagggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcaggccacgggcaccttcgggctgacgggcgtgtccgtgtgggaggcgctggtgctggagatcgtgatgaccttcgggctggtgtacaccgtgtacgccacggncgtggaccccgagaanggcagcctgggcaccatcgcccccattgcatcggcttcatcgtgggggcaacatcctggtgggcgggcgcttcgacggcgcgtccatgaaccccgccgtgtccttcgccccgccctcgtcagctgggagtgggctaccagtggttg

SEQ ID NO: 51027 - protein, 174 aa, Zea mays
  misc_feature: Ceres CLONE 1464781-F
  misc_feature (1)..(172): Pfam Name: MIP Pfam Description: Major intrinsic protein
  misc_feature (121)..(121): Xaa is any aa, unknown, or other
  misc_feature (126)..(126): Xaa is any aa, unknown, or other
MAFSKLTGGGPTTPAGLIAAAVAHAFALFVAVSVGANISGGHVNPAVTFGAFVGGNITLFRGLLYWVAQLLGSTVACFLLRFSTGGQATGTFGLTGVSVWEALVLEIVMTFGLVYTVYATXVDPEXGSLGTIAPIASASSWGQHPGGRALRRRVHEPRRVLRPALVSWEWATSG

SEQ ID NO: 51028 - DNA, 669 bp, Zea mays
  misc_feature: Ceres CLONE 1464783-F
  misc_feature: Encodes the peptide sequence at SEQ ID NO. 51029
  misc_feature (646)..(646): n is a, c, t, g, unknown, or other
ggagctccccgcggtggcggccgctctagaactagtggatcccccgggctgcaggaattcgcacgagaccattacctagaacatccttatcgaaaaatattccgctcataattcctcaccggcctgcctcagagagagaaaaagcggagattagcggcggcgatggcactcccggcgtcgagctccggcctcttccgcttcgtctccccgcgcagccgcccccagtccaccgacatcgtggctgccgcctcctggggagtcttcgccggcaccgccggcctctacctcgtccagccatttgactggattaagaaaactttcttcgagaaaccccaaccagaggcataaaaggcttgcaagtctgcaactttggtacttcacttttatccgggatggttcctgactgaagagaacttggataactcagcaaataatacgagaccccctcgtgtttccttgtttgttttttattattcagatgtaggcaatccccacgagggagacagggaacagagaaactgcttggttcacctgtgtctatataatactcctgtgttatccaacatgcatgttttaaaacctgtggcaaatatatcttgctgattaatattggactatgatgtcatgttcgaatgttcccatcacntaaagggagaaaaaccatgatgc

SEQ ID NO: 51029 - protein, 61 aa, Zea mays; identical to SEQ ID NO: 45456
  misc_feature: Ceres CLONE 1464783-F

SEQ ID NO: 51030 - DNA, 688 bp, Zea mays
  misc_feature: Ceres CLONE 1464791-F
  misc_feature: Encodes the peptide sequence at SEQ ID NO. 51031
  misc_feature (688)..(688): n is a, c, t, g, unknown, or other
cgattgggtaccgggccccccctcgagccctgcagtggtaaaggggcagtagcagtacaacacacccacacacacagagagagagaaagacattgaagaaaaacagagaggcacagctcagcatcgcctccggaagaccggagcggagtcccattcccatcccatggcgagttcccggaggagctccgggctctcctccggtgccgcagcgctgggcattgcgctgctggtcctggccgccagcgcgggcaacgccggcgcgtcgtactacggggagatgaggcggcagttcctggcgcagcagaacgcggcgcgcgcgtcgctgggcctggcgccgctggcgtgggacgagcgcgtgggcgcgtacccgcgggcgtacgccgaatcgcggcgcggggactgccccctggcccactccgcgggggccctccgggaaaacctcttctggggcaccggccccggctgggcgcccgcgcaggccgtccccggcctggttctccgagccgccccgctacgactactgaaccaacagctgctacggcggctccctgtgccggcccctaccccccaaatcttgtggggggaccaccccaacccctcccgaatgcgcccctggttcccatggttaaggggggcaggggccccttcttttccccctggaaattaacaacccccgccggggtaattn

SEQ ID NO: 51031 - protein, 167 aa, Zea mays
  misc_feature: Ceres CLONE 1464791-F
MASSRRSSGLSSGAAALGIALLVLAASAGNAGASYYGEMRRQFLAQQNAARASLGLAPLAWDERVGAYPRAYAESRRGDCPLAHSAGALRENLFWGTGPGWAPAQAVPGLVLRAAPLRLLNQQLLRRLPVPAPTPQILWGDHPNPSRMRPWFPWLRGAGAPSFPPGN

SEQ ID NO: 51032 - DNA, 704 bp, Zea mays
  misc_feature: Ceres CLONE 1464798-F
  misc_feature: Encodes the peptide sequence at SEQ ID NO. 51033
ggagctccccgcggtggcggccgctctagaactagtggatcccccgggctgcaggaattcgcacgagaccattacctagaacatcctaatcgaaaaaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgtcctcttcaacgacgaccggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaccaccaagttctcgattccatacaactcgtatgcttgtattctgccgtgcctatattagattctctcgaaccatttggtgttccttgaaaactgctatcgtgtgatatatgaaattgtggtgctcaagaaattgccttgcttgcatatggttgtgttgcttaataaattcaatgcgtggataacattcctggccggaaactggaaaccggccaactgaacttaaggcccccgggtatattgacctctccaaaaaaa

SEQ ID NO: 51033 - protein, 87 aa, Zea mays; identical to SEQ ID NO: 46334
  misc_feature: Ceres CLONE 1464798-F

SEQ ID NO: 51034 - DNA, 679 bp, Zea mays
  misc_feature: Ceres CLONE 1464799-F
  misc_feature: Encodes the peptide sequence at SEQ ID NO. 51035
tggagctccccgcggtggcggccgctctagaactagtggatcccccgggctgcaggaattcgcacgagaccattacctagaacatcctaatcgaaaaattttactcttcatgcttttccccttcgtgcaagcaaagctaaacaatacccgtcttgccttcaaatcgaactcctcccccgatcgatcccaatcgaacccaccaagccgataccctaaccctcgcccttctcgatgtcggccgccaccaccggcccagccccttcagtagccactccgatggcgccccctccgtcctacccggcctcctccacggcctcttcctccatctccgcgtccgccgaggaggaggaggacctctatggccgcctcaaatcgctccaacgccacatggagttcgtcgaaatccaggaggagtacgttaaagacgagcagaagaacctgaagcgcgaactccttcgtgcgcaggaggaggttaagcggatccagtctgtaccgctcgtcattggccattttatggagatggtcgacggcaacaacggcatcgggggcctctaccactgggcagcaactactacggtggggattcctcagcaccattcaaccgcgagttggttcaaaccgttcaaggttcccgtccggggttggaaatgttccaccccaaaggctttttaagtcaaag

SEQ ID NO: 51035 - protein, 131 aa, Zea mays
  misc_feature: Ceres CLONE 1464799-F
MAPPPSYPASSTASSSISASAEEEEDLYGRLKSLQRHMEFVEIQEEYVKDEQKNLKRELLRAQEEVKRIQSVPLVIGHFMEMVDGNNGIGGLYHWAATTTVGIPQHHSTASWFKPFKVPVRGWKCSTPKAF

SEQ ID NO: 51036 - DNA, 521 bp, Zea mays
  misc_feature: Ceres CLONE 1464804-F
  misc_feature: Encodes the peptide sequence at SEQ ID NO. 51037
  misc_feature (245)..(245): n is a, c, t, g, unknown, or other
  misc_feature (265)..(265): n is a, c, t, g, unknown, or other
  misc_feature (278)..(278): n is a, c, t, g, unknown, or other
  misc_feature (279)..(279): n is a, c, t, g, unknown, or other
  misc_feature (301)..(301): n is a, c, t, g, unknown, or other
  misc_feature (366)..(366): n is a, c, t, g, unknown, or other
  misc_feature (367)..(367): n is a, c, t, g, unknown, or other
gctccccgcggtggcggccgctctagaactagtggatcccccgggctgcaggaattcgcacgagaccattacctagaacatcataatcgaaaagacaacgtagcatacactagtgcttttgctagctacttgtgcgagaagagagagcgcacggcgatagatatggcgcatagcaagcgcgaaatcaagcccgggagggcgcataccaaggtggccggcgacgacgagatgctgcgggaccgggnttctttcgacggcacgccgnctggagggcggcnnagatcgcccgactcccagcccngtcgaacctcttcgcccgctggcccgccgcggtcccccgaaaccccccggtaacttctttccgcnncccgggggagggggcccccccccggggggagggggacccacaaagaaaaaacccccccccctctccccggggaaagtcggaaaaaaccccccctttataaaaactttttcctcccccccaaaaaaaacccacccggggggggggggggtgtggg

SEQ ID NO: 51037 - protein, 63 aa, Zea mays
  misc_feature: Ceres CLONE 1464804-F
  misc_feature (28)..(28): Xaa is any aa, unknown, or other
  misc_feature (35)..(35): Xaa is any aa, unknown, or other
  misc_feature (39)..(39): Xaa is any aa, unknown, or other
  misc_feature (47)..(47): Xaa is any aa, unknown, or other
MAHSKREIKPGRAHTKVAGDDEMLRDRXSFDGTPXGGRXRSPDSQPXRTSSPAGPPRSPETPR

SEQ ID NO: 51038 - DNA, 653 bp, Zea mays
  misc_feature: Ceres CLONE 1464808-F
  misc_feature: Encodes the peptide sequence at SEQ ID NO. 51039
  misc_feature (54)..(54): n is a, c, t, g, unknown, or other
  misc_feature (403)..(403): n is a, c, t, g, unknown, or other
ggagctccccgcggtggggggcgctctagaataggtggatcccccgggctgcangattcgcacgagaccattacctagaacatcctaatcgaaaagctaacgccgctcgcgcatcctattgccctcgcgccaccgtcgccgccgctgcagcgagccaccgccctgccgtcgcctgaggtaaacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtancaaaatcctccgcatccctcaggcccatgggttggcgccggaaaatcccgaggatctctactttctcattaagaaggcgggtgccaattaggaagcatttggagagaaacaggaggacaaggactccaatttcagactcattccttgtgagagaaggatccacgccttggccgttactaaaagcgaacaagaaacctcccaccccctggaaatacaaatccacttacggggagacttctggtggcctaaa

SEQ ID NO: 51039 - protein, 98 aa, Zea mays
  misc_feature: Ceres CLONE 1464808-F
  misc_feature (1)..(60): Pfam Name: Ribosomal_S13_N Pfam Description: Ribosomal S13/S15 N-terminal domain
  misc_feature (69)..(69): Xaa is any aa, unknown, or other
MGRMHSRGKGISSSALPYKRTPPIWLKTATTEVEEMITKAAKKGQMPSQIGVLLRDQHGIPLVKSVTGXKILRIPQAHGLAPENPEDLYFLIKKAGAN

SEQ ID NO: 51040 - DNA, 658 bp, Zea mays
  misc_feature: Ceres CLONE 1464818-F
  misc_feature: Encodes the peptide sequence at SEQ ID NO. 51041
ggagctccccgcggtggcggccgctctagaactagtggatcccccgggctgcaggaattcgcacgagaccattacctagaacatcctaatcgaaaactttctcgccttctcggcgcgctacgcctacgactgagctgaaagaagcggtagatcggcgttagcggcgagctagggttccggcgagtgcacccaatggcatcggaggcggcgcggcggcggcaggagatggcagaggaggggcaacggcacctggaggagactatcgcagcctcgttccagatcctcgtatccatgaacgacgagctctgcaacgccggcctttggtcctcctcatccgtctcggccaccgctgcggctggctaccagcaccatcactctgctactcttccgaccccacactctgtagattccgacgctgccgacgcagggggcgcgcccagccccggcgggtcgctcgacgaggcgaggcaccgctacaagtcagccgtggcggcgctgcgggcatctatctctgccgtgtcgtcctgcgctcaggacattggatcaacagaatctggaagctgaccctgcaaagttgagagatggaagagctgctgctgctttaaaaggaaatgaaagcaaacagcagtaaacccccatgatcactccggaccaaacc

SEQ ID NO: 51041 - protein, 123 aa, Zea mays
  misc_feature: Ceres CLONE 1464818-F
MASEAARRRQEMAEEGQRHLEETIAASFQILVSMNDELCNAGLWSSSSVSATAAAGYQHHHSATLPTPHSVDSDAADAGGAPSPGGSLDEARHRYKSAVAALRASISAVSSCAQDIGSTESGS

SEQ ID NO: 51042 - DNA, 613 bp, Zea mays
  misc_feature: Ceres CLONE 1464819-F
  misc_feature: Encodes the peptide sequence at SEQ ID NO. 51043
  misc_feature (321)..(321): n is a, c, t, g, unknown, or other
  misc_feature (328)..(328): n is a, c, t, g, unknown, or other
acccgcggtggcggccgctctataactagtggatcccccgggctgcaggaattcgcacgagaccattacctagaacatcctaatcgaaaaaaaacaaggagcgctacatccaggccagcagtttccatttgcaatccgaccccatcttcatcccgttgtcgcagcagcagccatccaagcagcgatggacggcggcaagaagagccggaacccgcacaaggcctccgcggactaccgcagcgaccgcaagtcagcctccgggatgagcggcgaccccaagaagggcggccgcggcgggcaaggtttcacctggggagggcngccgaanaactacggctacggctacgccgacaagaacctcgcctcctctccagaaaaggcaacatcaacgcggacgcgctagccaagtcaaggaaggccccgcccctaaaaggacgaacaacaagtaagcctcgccccttcggttccccgcccgggcccgtctatccccaaaaaaaacaaaaaacccctttgggttgtttaatccaaaaacagtcccatttcccggggaaaaaaaccagaaccagggggtttagggggcccggccccacaaaaaaaggggggaccccccgcc

SEQ ID NO: 51043 - protein, 72 aa, Zea mays
  misc_feature: Ceres CLONE 1464819-F
  misc_feature (46)..(46): Xaa is any aa, unknown, or other
  misc_feature (48)..(48): Xaa is any aa, unknown, or other
MDGGKKSRNPHKASADYRSDRKSASGMSGDPKKGGRGGQGFTWGGXPXNYGYGYADKNLASSPEKATSTRTR

SEQ ID NO: 51044 - DNA, 688 bp, Zea mays
  misc_feature: Ceres CLONE 1464821-F
  misc_feature: Encodes the peptide sequence at SEQ ID NO. 51045
tccccgcggtggcggccgctctagaactagtggatcccccgggctgcaggaattcgcacgagaccattacctagaacatcctaatcgaaaagatcgaggatggtggacgtctcgcgcgtgcagaaggagctcaccgagtgcaaccgcgaccgggaggtatcgggcgtctccatcgcgctccacgacggcgccaacatctcccacctcaccggcaccatcgccgggcccgccgacagcccctacgagggcggcacgttcgtcatcgatatccgcctgcccggtggatatccctttgagcctccgaagatgcagttcatcaccaaagtatggcaccctaacatcagcagccaaaatggagcaatttgctgggacattctgaaagatcaagtggaccccagccccttaccttgaagactgcgctccttttcccttcaagctctgctttcctctcttgaacctgatgatcctcaggaggctgttgttgcccaacagtccctgggtgaatatccaaaattttgccgcctaccggtcccctaatggaaagaaagcccttccccaaaaatggcttcaaccggccatggaaaaaaaaagggccaaaaaccgggtttaaaaagggcttcccccaaaaaaccagggaaaaaaatgcccctaaaaaacgggggaagggaaaaaaaaaactggcctccca

SEQ ID NO: 51045 - protein, 103 aa, Zea mays
  misc_feature: Ceres CLONE 1464821-F
  misc_feature (6)..(103): Pfam Name: UQ_con Pfam Description: Ubiquitin-conjugating enzyme
  misc_feature: SWISSPROT Homolog: EC 6.3.2.19 Ubiquitin--protein ligase
MVDVSRVQKELTECNRDREVSGVSIALHDGANISHLTGTIAGPADSPYEGGTFVIDIRLPGGYPFEPPKMQFITKVWHPNISSQNGAICWDILKDQVDPSPLP

SEQ ID NO: 51046 - DNA, 661 bp, Zea mays
  misc_feature: Ceres CLONE 1464823-F
  misc_feature: Translation starting site: 220
taatggatcccccgggctgcaggaattcgcacgagaccattacctagaacatcctaatcgaaaagttgctacaggatgcatcagccaaattaggatacaatggctcttaggctgtgggcaagctgaacagccaatgccctcaagatttcaagcagcggcgccagggctgctgccccggcttattcgatctccagatacttctccaccggtattgatggaatgaagtacacttcctcccacgagtgggtcaagaactacggctccgtggccacaattggcatcagtgaccacgcccagggccatctcggggaggtggtgttcgaggaactgccggaggcaggcaacaaggtgagccagggcggacccttcggcaacgtggagagtgtgaaggccaccaacgaacgtcaactcgcccatctccagagaggtcaactacgtcaactcaaagctgtcagagacccccggcctgatcaactcgagcccgtacgaggatgggtggatgatcaaggcgaacccaagcaacccggcggagctggagggcctgctagactcggccaagtacaccaaacactgccaggacgaggacccccactagtgctccttgctcgcttatcattcctttttgtgggaacaatatcgactactcttgtctacaataatg

SEQ ID NO: 51047 - DNA, 641 bp, Zea mays
  misc_feature: Ceres CLONE 1464828-F
  misc_feature: Translation starting site: 221
  misc_feature: SWISSPROT Homolog: EC 3.6.3.14 H(+)-transporting two-sector ATPase
  misc_feature (483)..(483): n is a, c, t, g, unknown, or other
acccgcggtggcggccgctctagtactagtggatcccccgggctgcaggaattcgcacgagaccattacctagaacatcctaatcgaaaaatatcacagcatcagaaattcagaatcgatccgatctccgcttgcgctgagctccatcagattcaattctctgcaggtgcaggaccgcgaacacgaggaggcaggggagcagcatccacaaccacaagccatggcggggaggactaacatccccactaacaactccgccctcatcgcaatcatcgccgacgaggacaccgtcactggcttcttgatggccggcgttggcaatgttgatctgcgcaagaaaaccaattacctcctcgtcgacaacaagacgacagttaaacaaatcgaggacgcgttcaaagaatttactgcaagggaggatattgctattgtgctcatcagtcagtatattgccaacatgataagatttctcggtgggatagntacaacaagccagtccctgctattctggagatcccttccaaggaccatccatatgatccagcgcacgactccgtgctgtctcgaagggaaggatctcttccctgcggaaatcgggggggtctgattggcgaagaaaggcttccttggggaataagaac

SEQ ID NO: 51048 - DNA, 680 bp, Zea mays
  misc_feature: Ceres CLONE 1464831-F
  misc_feature: Encodes the peptide sequence at SEQ ID NO. 51049
acccgcggtggcggccgctctagaactagtggatcccccgggctgcaggaattcgcacgagaccattacctaaaacatcctaatcgaaaaacatttctcttctggaacataagtaccgtgcaaacttcgaccgggaccggcgatatccgccatggccaccatcactgccgccgctcgctggagcttccccgcccgtctccagttcctcaccagccgccgcttttgcttccccgcctcctctgccgcgccgcccacttctgtagcggggttcagttgggccgacgccctccgcgtctctggggacggagggcgcggcgacaattccgacctctccgggtacttccggaaggtcaagagctgcaaccgcggaatggacaaaaaagggcagttcgcggagttctctgaggaggatcaggtcgtggggtacatccccgagggatttatcgaacacatcggagactttcatgatgtttttaccaatgtcatggatgacaatggcagcaacactgtggagcatgtgtctctccagtcatcactaaagactccagaatacccaacacatgctattggaagtgtcattaagagccttggagaattgattccagctctacccagtgacgtcatcttatggcatgcatgtgtacttcacactgggacgtgctgctgctccttactatgat

SEQ ID NO: 51049 - protein, 175 aa, Zea mays
  misc_feature: Ceres CLONE 1464831-F
MATITAAARWSFPARLQFLTSRRFCFPASSAAPPTSVAGFSWADALRVSGDGGRGDNSDLSGYFRKVKSCNRGMDKKGQFAEFSEEDQVVGYIPEGFIEHIGDFHDVFTNVMDDNGSNTVEHVSLQSSLKTPEYPTHAIGSVIKSLGELIPALPSDVILWHACVLHTGTCCCSLL

SEQ ID NO: 51050 - DNA, 671 bp, Zea mays
  misc_feature: Ceres CLONE 1464835-F
  misc_feature: Encodes the peptide sequence at SEQ ID NO. 51051
atagctggagctcaccgcggtggcggccgctctagaactagtggatcccccgggctgcaggaattcgcacgagaccattacctagaacatcctaatcgaaaagcttgagtgtgtagtccttatgtactgctggtataaccccctccctagcccaggtttgcccccttctccccatggactggatgcgctcagtgacccctccccctgcctatttattcagtgtgttccacggctgagttcagaaaagcttttctcccttgttctcgagctgtagtcccagtccactacaaaggtgttggagtcctggtattcttgctggtgtgcatcctctctttcagccaccaaatttgttttactctagagctgaatgccaacctcttgcctgtggtgaccaaacccaaccgtttttcacctccccgtggacaaggtttcccacaagtattcttggccgtgtactacttgttccatgctcggcaaagaactcctacaagaaggagtgaagattcaacctgaagtggtgactgaagaggaatctactccagtggctactgatcaagtggaggagccatctaactggggtttaattgagggatcgagtacctcttcactgcaataaggtgatgaggagtattctaggagttcctgtggctggagggcgtttccagttctgg

SEQ ID NO: 51051 - protein, 49 aa, Zea mays
  misc_feature: Ceres CLONE 1464835-F
MLGKELLQEGVKIQPEVVTEEESTPVATDQVEEPSNWGLIEGSSTSSLQ

SEQ ID NO: 51052 - DNA, 711 bp, Zea mays
  misc_feature: Ceres CLONE 1464836-F
  misc_feature: Encodes the peptide sequence at SEQ ID NO. 51053
  misc_feature (405)..(405): n is a, c, t, g, unknown, or other
  misc_feature (411)..(411): n is a, c, t, g, unknown, or other
  misc_feature (413)..(413): n is a, c, t, g, unknown, or other
  misc_feature (419)..(419): n is a, c, t, g, unknown, or other
ctggagctccccgcggtggcggccgctctagaactagtggatcccccgggctgcaggaattcgcacgagaccattacctagaacatcctaatcgaaaaatcacgaatcaccaacaccctctcctccaccttccatcccgatcaccgccgccaccgctttcgttccacgtcccgatggcaccggtagatctaacccccaggcagccccggaaggcgtatggcggcgacgccggcgcctactacgagtggagcccagccgacctgcccatgctcggcgtcgcctccatcggcgcagccaagctctccctcgccgccggtgggctctcgctccccagctactccgactcttccaaggtcgcgtacgttcttgaaggcactggcacctggcgcatcgtcctgccggaangcgacnangagaangtgctggccgtgaaagaaggcgaccccttcccgctccccctcggggtgggtccgtggtgggacaagggcccgcccgggcgaaccagctcaggtccttcttcctggggaaaccctccagggccaaagggccggggcatttcacccaattccgcgggaagggggggagggggtaccttcgggggctcccccaccaatttcgggcccccgggctgggaaactgccgaaaggaaaacccccgggctttgggggaaaaacccccgggtgggggaaattcgggggcccctccccccgt

SEQ ID NO: 51053 - protein, 179 aa, Zea mays
  misc_feature: Ceres CLONE 1464836-F
  misc_feature (6)..(134): Pfam Name: Cupin_1 Pfam Description: Cupin
  misc_feature (78)..(78): Xaa is any aa, unknown, or other
  misc_feature (80)..(80): Xaa is any aa, unknown, or other
  misc_feature (82)..(82): Xaa is any aa, unknown, or other
MAPVDLTPRQPRKAYGGDAGAYYEWSPADLPMLGVASIGAAKLSLAAGGLSLPSYSDSSKVAYVLEGTGTWRIVLPEXDXEXVLAVKEGDPFPLPLGVGPWWDKGPPGRTSSGPSSWGNPPGPKGRGISPNSAGRGGGGTFGGSPTNFGPPGWETAERKTPGLWGKNPRVGEIRGPLPP

SEQ ID NO: 51054 - DNA, 705 bp, Zea mays
  misc_feature: Ceres CLONE 1464838-F
  misc_feature: Encodes the peptide sequence at SEQ ID NO. 51055
  misc_feature (705)..(705): n is a, c, t, g, unknown, or other
ctggagctcaccgcggtggcggccgctctagaactagtggatcccccgggctgcaggaattcgcacgagaccattacctagaacatcctaatcgaaaagctagggttttaggcctttcctcaccgtcggcggctcggcgccatgtatgggaactccggcgaagcacccccgtgccgtcccacgccacttacaggccgcaatctccaccgtctccaccgcgcagatactccgctcttccggctactccgccgctgaacctgccgcgctccgcgccctctccgacatcgctggccgctacatcgcgtccctgggccacgccgccgcagctttcgccgaggcccgcggccgcacggagcccaacgtcaccgacgccgtcctcgcgctcgaggatcacgcgctcgggggcttccccggcgcggccgaccccacgcggccgttgctctgttccggcgcgctcgcggagctcgcccagttcgtcgctgcggggagggaggtcccgttcccgaagcccctgccgaggagggatccggggttgcggctccctccaacggggggaaaaactttcccggcgggggggaaggcaccccccccgctgaaccactttccacatttggcttcccctggcttcccggaaggggtgggaaggaaacgggttggcccggtccgctggccagggtggcccaccggaataaccaaaaaaggacn

SEQ ID NO: 51055 - protein, 186 aa, Zea mays
  misc_feature: Ceres CLONE 1464838-F
  misc_feature (13)..(90): Pfam Name: Bromo_TP Pfam Description: Bromodomain associated
MGTPAKHPRAVPRHLQAAISTVSTAQILRSSGYSAAEPAALRALSDIAGRYIASLGHAAAAFAEARGRTEPNVTDAVLALEDHALGGFPGAADPTRPLLCSGALAELAQFVAAGREVPFPKPLPRRDPGLRLPPTGGKTFPAGGKAPPPLNHFPHLASPGFPEGVGRKRVGPVRWPGWPTGITKKG

SEQ ID NO: 51056 - DNA, 682 bp, Zea mays
  misc_feature: Ceres CLONE 1464857-F
  misc_feature: Encodes the peptide sequence at SEQ ID NO. 51057
ccgattgggtaccgggccccccctcgagccactgcagtggtaaaggtgtgttgattgccgatggcaagtcgcggttttcaatcaatgggaagcctatctaccactttgttgggacttccaccttcagcgagttcaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaaccccaaaaaccacaacaagccagtgcaggaggtacttgctgagatgaccaacgcaggggtcgaccgcagtgtgaaatgcactggcaacattaatgctatgatccaagctttcgaatgtgttcatgatggctggggtgttgctgtgctggtgggtgtgccacataaggaccctgaattccagaccccacccgatgaacttcctgaacgaaaagaccctggaaggggaccttcctttggaaactataacccccgccctgatctggccaaaag

SEQ ID NO: 51057 - protein, 226 aa, Zea mays
  misc_feature: Ceres CLONE 1464857-F
  misc_feature (86)..(226): Pfam Name: ADH_zinc_N Pfam Description: Zinc-binding dehydrogenase
  misc_feature: SWISSPROT Homolog: EC 1.1.1.1 Alcohol dehydrogenase
DWVPGPPSSHCSGKGVLIADGKSRFSINGKPIYHFVGTSTFSEFTVMHVGCVAKINPQAPLDKVCVLSCGISTGLGASINVAKPPKGSTVAVFGLGAVGLAAAEGARIAGASRIIGVDLNPSRFEEARKFGCTEFVNPKNHNKPVQEVLAEMTNAGVDRSVKCTGNINAMIQAFECVHDGWGVAVLVGVPHKDPEFQTPPDELPERKDPGRGPSFGNYNPRPDLAK

SEQ ID NO: 51058 - DNA, 675 bp, Zea mays
  misc_feature: Ceres CLONE 1464858-F
  misc_feature: Translation starting site: 109
cgaattgggtaccgggccccccctcgagccctgcagtgggacacgccacccacagccaaatgatactctttggttagccagccgaaattctctagcctggcagcagccatgggagaagcacaagactactacgacacctccacggctctggccgccgccgccgccgccgccgccggcctcgcgctgctcgcggtctgctcgtactacctgctcgtcgggcggcgccgcggcggcggcggcgggaaggcgccgaagcggtacgcgccggtggtggggacggtgttccaccagctgtaccacgtccggcggctgcacgactaccacacggacctgttccgggagcgcaagaccttccagctgctggtgccggccggccggcggcagatatacacgtgcgaccccgccgtggtcgagcacatcctcaggaccaacttcgccaactacggcaagggaagcttcaactactaaaacatgactgacctgctccgccgacggcatcttcaccgtgtacggcgaacattggaggcagcaccggaagatccccagctacgacttctccccgagggcgctgcgcaacttcaacggctcggtccttcaagaggaacgcccgcgaggctcggccggcatccttctcctggaagggcggcagcccggggaagccccatgaaggttcag

SEQ ID NO: 51059 - DNA, 673 bp, Zea mays
  misc_feature: Ceres CLONE 1464870-F
  misc_feature: Encodes the peptide sequence at SEQ ID NO. 51060
cgaattgggtaccgggccccccctcgaggtctagggtagcgatagacttgtcatttcttttgcgagtattcctcgctgatacttgtatctagatgatgtattttgcgtgtttgtgtatgtggcttggaggagaaactttccggtgttggagggcgaagagctcgaagttctaaaggtaacgcccgccgggtgcttggtggaacgtctcaaccggaggttgttgtcgatctctcaggttcgaggcgatttagttgtggtacgttaattaatcacgtgatgtggagggcaagagttggattaatctcaagtgaagatgatgaatgaacctgaagcttggatgatctgatcaagtaccaggatcggatgagagatgctccccacgcggacgtcatctaacaacactgacttagtgttatcccaggacttgtaatggtgagcgcatcattgaaagggaaatgtgcccttgggccatttctaagtattttggtgatttagtgtccaacacaagtgcctaagtggaaaaaggtggacaaagtacaaatcaagggataaggaaaaatcaaattgaaaatgtcttggctcgagcagccaagactctgctcagtctgggtgcaccggacagtgtccgggtgcgccaggctagctcgagcgaactggcccgctctcgggaatt

SEQ ID NO: 51060 - protein, 29 aa, Zea mays
  misc_feature: Ceres CLONE 1464870-F
NWVPGPPSRSRVAIDLSFLLRVFLADTCI

SEQ ID NO: 51061 - DNA, 675 bp, Zea mays
  misc_feature: Ceres CLONE 1464879-F
  misc_feature: Encodes the peptide sequence at SEQ ID NO. 51062
  misc_feature (465)..(465): n is a, c, t, g, unknown, or other
cgattgggtaccgggccccccctcgagccactgcagtggtaaagggccaggcagccagccccggagccctggacagcagcagtgaactcgaggccgcttcgccacctcgccactcgcctcttctcgctctcgccaccgggccagggaagggaccatccgatcggctccgtcatggctggagctgctgctctcaatgagggtatcctttcttccgtgtccgagaaaaatgttgctgctcatccatggcatgatttggagataggaccagaggctcctgaagtgttcaattgtgtggttgagattcctagaggcagcaaggttaagtatgagttggacaagatatctggtctgatcaaggtggatcgtgtcctttactcctctgttgtttacccacataactatggtttcattccacgcacgctctgtgaggatagcgaccccatggacgtcctcgtactgatgcangaacaagttgtccctgggtgtttcctgcgagctcgtgctattgggctcatgcctatgatcgatcagggtgagaaagatgataagatcatagctgtctgtgctgatgaccctgaattccgtcactacaaggacatctcggacctccccccgcatcgcctttcagagatccggcgcttttttggaagatttaaaaagaatggaaccaaggag

SEQ ID NO: 51062 - protein, 168 aa, Zea mays
  misc_feature: Ceres CLONE 1464879-F
  misc_feature (39)..(168): Pfam Name: Pyrophosphatase Pfam Description: Inorganic pyrophosphatase
  misc_feature: SWISSPROT Homolog: EC 3.6.1.1 Inorganic diphosphatase
  misc_feature (98)..(98): Xaa is any aa, unknown, or other
MAGAAALNEGILSSVSEKNVAAHPWHDLEIGPEAPEVFNCVVEIPRGSKVKYELDKISGLIKVDRVLYSSVVYPHNYGFIPRTLCEDSDPMDVLVLMXEQVVPGCFLRARAIGLMPMIDQGEKDDKIIAVCADDPEFRHYKDISDLPPHRLSEIRRFFGRFKKNGTKE

SEQ ID NO: 51063 - DNA, 653 bp, Zea mays
  misc_feature: Ceres CLONE 1464882-F
cgattgggtccgggccccccctcgagccctgcagtggtaaaggctctgctccgcctgcgaccgccgcgtccaccgcgccaacaagctcgcccacaagcaccgccgcatccccctcgcccggccctctggcgacgaatccgacaccgacgccaagccgctctgcgacgtgtgtaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgcgctcgtcgacgcccaggcgccccactcccctgacgacgacgacaacgactgcggccgcggcaacggcgccgccgccgagcccgacgctgtccccgccgtctgcgcgcagggctcctgcgcggccaaggcctcgtctcttgagtccggtggcggcggcggcggcagcggcagcagcatctccgagtacctcaccaacatctgcccaggctggcgcgtcgacgacctcctctttgacgactcggcgttctcagcggcatcgaaggccgacagctgcgacgacgggcacgagcaggtgccgtccctggacgccgacctcttcgacgtggtggctggcgccggct

SEQ ID NO: 51064 - DNA, 661 bp, Zea mays
  misc_feature: Ceres CLONE 1464884-F
  misc_feature: SWISSPROT Homolog: EC 1.11.1.6 Catalase
  misc_feature (614)..(614): n is a, c, t, g, unknown, or other
cgaattgggtaccgggccccccctcgagccactgcagtggtaaagagtgccaaaaaagaggaaatgtaataaaaaaaattaaaaacctatgaaagcctgaaagctaggtgaggatggatacttgacttgaccattcctttccaaagctggtggtacctagaattacttttcttacttgtatgctaactatcttgtcgtttttctgttgtccctccctctgattctaaaaccaaagggggcaactgcgtcattaaaacaatgcaggcgggcatgcatccgtccaatcagacctaggttccgtggtctgcacttaaattaaaaaaaagaaaaaaaaaaaaaaaaaccagagctctgggaattcctgcagcccgggggatccactagttctagagcggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcngtgaacctgtcgtgccagctgcattaatgaatcggccaacgcgcggg

SEQ ID NO: 51065 - DNA, 661 bp, Zea mays
  misc_feature: Ceres CLONE 1464889-F
  misc_feature: Encodes the peptide sequence at SEQ ID NO. 51066
cgattgggtacgggccccccctcgagccctgcagtgggaaaggaggctagatcgatgatcaggaacgtacaaagggttcagttcagttttcagtgagtcggcatatgggcaactgcagcagcttcttctctcttccgaaacggggaagcaagctactcaaactcaactcacgaagggataaagaccattccggtgcagagagcctgcgagttcaccacgaactccgtgctctgcgtctgcatcgtcacttggaacatgaacagcaagatgtccgcggaagatgtggcgaagctggtgagctccgacaggaagttcgatctgctggtcgtcgggctgcaggaggcgccgaagccagacgtttcgcgggtcctgcaggaggcgttggcggggacacacgtgctgttgggtcagaagagcatgcagtctctccggatgcttcttttcggttcaaggagctcggagaagtacatcagagagatgaaggtggacaaacacgcggttgggggctgcgggggtatcatcgggaggaagaaaggagcggtggccatgtacatcaacttcagcgggatccggatggtcttcgtgtcctgccatcttgcagctcacgagcacaaggtggagaagaggaacgcggagttccagcacatctcgcagtcgctct

SEQ ID NO: 51066 - protein, 135 aa, Zea mays
  misc_feature: Ceres CLONE 1464889-F
  misc_feature: SWISSPROT Homolog: EC 3.1.3.56 Inositol-polyphosphate 5-phosphatase
MNSKMSAEDVAKLVSSDRKFDLLVVGLQEAPKPDVSRVLQEALAGTHVLLGQKSMQSLRMLLFGSRSSEKYIREMKVDKHAVGGCGGIIGRKKGAVAMYINFSGIRMVFVSCHLAAHEHKVEKRNAEFQHISQSL

SEQ ID NO: 51067 - DNA, 669 bp, Zea mays
  misc_feature: Ceres CLONE 1464890-F
  misc_feature: Encodes the peptide sequence at SEQ ID NO. 51068
cgattgggtaccgggccccccctcgagccactgcagtggtaaaggagtatattactttggtggtggatgctacagttaagtcagggataaagcgacagggttgaggcatttagatcagggtttaatcaggtgtttgacatgtcatccctccacatatttcacctcaagaacttgactatctaatatgtggtcgacaagaaatttgggagtcggaatccctggtggataacataaaatttgatcatggatatactgctaaaagtcctgcgatcgtgaatctactcgagattttgtcagaattcacccctgagcagcagcatgcgttctgccagtttgtaaccggtgctcctcggcttccacatggtggattggctgcccttagccccaagcttactatagttaggaagcatccttcaagtgctgtgaatacttcaaattcaactggggcagtagagtccgctgatgatgatttgcctagtgtgatgacgtgcgccaattatctgaagctgcccccctactccacaaaagaaatcatgcgcaagaagttgctttatgcgatcctggaaggccgaggatcatttgatctttcataagaaatatacaatatccgaactaacatacaggggtcagttttattctggagatttagtttcttggttcatgtataac

SEQ ID NO: 51068 - protein, 33 aa, Zea mays
  misc_feature: Ceres CLONE 1464890-F
IGYRAPPRATAVVKEYITLVVDATVKSGIKRQG

SEQ ID NO: 51069 - DNA, 695 bp, Zea mays
  misc_feature: Ceres CLONE 1464891-F
  misc_feature: Translation starting site: 258
  misc_feature: SWISSPROT Homolog: EC 3.1.3.16 Phosphoprotein phosphatase
ggagctccccgcggtggcggccgctctagaactagtggatcccccgggctgcaggaattcgcacgagaccattacctagaacatcctaatcgaaaaaaacgcaacccctctcgctctcaagcttcaaaatcccactagcgaaaggaaaacgggagaagctaggaagcagcagccgcggcatttcttccttgagcgttcgccttcggctgctcaacgcgtgcttcgtttcaggagagccttggtggcatctctgtttcatggccgagatctgctgtgaggcggcggcggcggcggcggggtcggaccagaagggggagtgcgccggcagccgcgcggcgcggcggcggaggatggagattcggcggctcagggtggtggccgaggaggcgtccgccaagaggcggaggctggaggcggatgaggaagacgcggttggggggcgagcgccgaggtacggcgtgacgtcggtctgcgggcggcggagagacatggaggacgcggtgaccgcccgtccggagttcatcaacggccacccacttcttcggggtgttcgacggccacggctgctcacatgtggcgacctcgtgcggggagcggatgcaccagaattgtggccgaaggaagcgaaaagctgccccagggtcctccggttcggaaaaaacccgccgggggaggggggcccgggaaaaaacccc

SEQ ID NO: 51070 - DNA, 661 bp, Zea mays
  misc_feature: Ceres CLONE 1464893-F
  misc_feature: SWISSPROT Homolog: EC 2.7.11.1 Non-specific serine/threonine protein kinase
  misc_feature (389)..(389): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
gcggtggcggccgctctagaactagtggatcccccgggctgcaggaattcgcacgagaccattacctagaacatcctaatcgaaaaatgtggtcgcgctgagggggttctgctgctccagggcgcgcggggagtgcttcctcgtctacgacttcgtgcccaacggcagcctgtcgcagttcctcgacgttgacgtcgacgccgacgccgacaacgccggcggaggcagcggccgtgtcctccagtggtccacgaggatctccatcatcaagggcatcgccaaaggaattgagtatctgcacagcacaaggacgaacaagccggccctcgtccaccaaaacatctcagcggataaggtcctgctggactacgcgtacaggccccctcatnctcggggtgcgggcctgcacaagctccctcggtggacgaacctctgtttttctcgaaccttaaaagcccggggcccccccctggggggttccccggggggcccggaaaaaaccccccccccgggggggccccctttcttccgaaaaaaaaaaaaaaaaacaggggggtgcccccccccccggggggggggtgttattttttttccctcccgggggggggccccccccccccccnnnaaaaaaagaggggggggggggggccgcccccccccc

SEQ ID NO: 51071 - DNA, 709 bp, Zea mays
  misc_feature: Ceres CLONE 1464904-F
  misc_feature: Encodes the peptide sequence at SEQ ID NO. 51072
  misc_feature (560)..(560): n is a, c, t, g, unknown, or other
aaagctggagctccccgcggtggcggccgctctagaactagtggatcccccgggctgcaggaattcgcacgagaccattacctagaacatcctaatcgaaaaagttgctcgtatagggcatgttctccaagctactccgtccccagtccccaccatttcaaattgcaaataaaactgcaatctcgcagcggctgatggattagcaagcaggacaagagactgagatccatcctccagacacgcgcacgccaaggatcgcattcgccaagcaacgtcgggtcggcggcgcgggggcgatggagacgcggcggccgcggcgcggctggaacaaacgcttcgtcctcccgctcgcgctcctctgcctcgccgtgctgctccccggcgcgctgctcccgccgtccgcctcggcgtcgtcttcgtcgccggccgcgggaggtggcagcaggaaacgccggtgggttgggtttgactactatgtactggcgctgcagtggccgggcaccatctgccgcgagaccagcaactgctgcgacaccaatggctgctgccgatcacagccntctcaagtggttcacgattcatggtcttggccacagtataactatggggggctggccatcatgctgcagaccaaaccgaattccaccataataaaaaactttatggtgaagcccgaaaccccaaaaatatatggcccgccctggtactg

SEQ ID NO: 51072 - protein, 137 aa, Zea mays
  misc_feature: Ceres CLONE 1464904-F
  misc_feature: SWISSPROT Homolog: EC 3.1.27.1 Ribonuclease T(2)
METRRPRRGWNKRFVLPLALLCLAVLLPGALLPPSASASSSSPAAGGGSRKRRWVGFDYYVLALQWPGTICRETSNCCDTNGCCRSQPSQVVHDSWSWPQYNYGGLAIMLQTKPNSTIIKNFMVKPETPKIYGPPWY

SEQ ID NO: 51073 - DNA, 691 bp, Zea mays
  misc_feature: Ceres CLONE 1464906-F
  misc_feature: Encodes the peptide sequence at SEQ ID NO. 51074
gcggtggcggccgctctagaactagtggatcccccgggctgcaggaattcgcacgagaccattacctagaacatcctaatcgaaaaatttgtcctgtttgtccggtactgtactccggttgttaaagtttctcgctcatagagataatgatccagagaagacaccaaaaacaatagtcgatgtcggatgtggcattggtggtagctcaaggtacttggcgaagaaatacggagcgcagtgcacggggatcaccttaagccctgttcaagccgagagaggaaatgctctcgctgcagcgcaggggttgtcggatcaggttactctgcaagttgctgatgctttggagcaaccgtttcctgacgggcagttcgatctggtgtggtccatggagagtggcgagcacatgccggacaagagaaagtttgttagtgagctagcacgcgtcgcggctcctggagggacaataatcatcgtgacatggtgccataggaacctggatccatccgaaacctcgctaaagcccgatgaactgagcctcctgaggaggatatgcgacgcgtactacctcccggactggtgctcaccttcagactatgtgaacattgccaagtcactgtctctcgaggatatcaagacagctgactggtcggagaacgtggccccgttttggcccgccgtgataaaatcagcg

SEQ ID NO: 51074 - protein, 102 aa, Zea mays
  misc_feature: Ceres CLONE 1464906-F
  misc_feature: SWISSPROT Homolog: EC 2.1.1.95 Tocopherol O-methyltransferase
  misc_feature: The sequence is a functional homolog of SEQ ID NO 22 in US patent 7226745
  misc_feature: The sequence is a functional homolog of SEQ ID NO 36 in US patent 7244877
MESGEHMPDKRKFVSELARVAAPGGTIIIVTWCHRNLDPSETSLKPDELSLLRRICDAYYLPDWCSPSDYVNIAKSLSLEDIKTADWSENVAPFWPAVIKSA

SEQ ID NO: 51075 - DNA, 647 bp, Zea mays
  misc_feature: Ceres CLONE 1464907-F
  misc_feature: Translation starting site: 386
  misc_feature: SWISSPROT Homolog: EC 1.7.1.1 Nitrate reductase (NADH)
  misc_feature: SWISSPROT Homolog: EC 1.7.1.2 Nitrate reductase (NAD(P)H)
ggagctccccgcggtggcggccgctctagaactagtggatcccccgggctgcaggaattcgcacgagaccattacctagaacatcctaatcgaaaaatgtatcctgctaccgttcttgtctagtcgtcttcctcggcaagccgcggcggtcgttgccccctcgtataatctactcgcggcatccttgtcatcgccgtttcgatttggttgatacagaggggagccgcgagggggcggagatgccgacgctgacgaagctgtacagcatggaggaggctgccctccacaacacgcccgacgactgctgggtcatcgtcgacggcaaggtaaggatgctacagaagaatttgacgatgcagggcacagcaagagtgccaaggatctaatgcaggactacttcattggggaggtggacttggacccaactcctgacattcctgagatggaggttttcaggaaggagcaggacacgggaattgccagcaagctttaggacaacgtgttgcagtactgggcaatcccagcagcttgaaattgggatatcagcctgttgttgcttatattgaatgccccgaagaaaggaaaagttaatggggcctggcttgggccaaaagaatccttttaaaggtttgtttcctttccaacca

SEQ ID NO: 51076 - DNA, 758 bp, Zea mays
  misc_feature: Ceres CLONE 1464908-F
  misc_feature: Encodes the peptide sequence at SEQ ID NO. 51077
  misc_feature (758)..(758): n is a, c, t, g, unknown, or other
ctggagctccccgcggtggcggccgctctagaactagtggatcccccgggctgcaggaattcgcacgagaccattacctagaacatcctaatcgaaaaatcttcgtctccagtccaagcaagcgaagagcacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcggactgcgatcggcttcgtcgtcatgggattcgtcggcttctttgtcaagctcatcttcatccctatcaacaacatcatcgtcggctccggctgatccgtaaacctcaggctagtggctgcaggagtggacaatggcgtcactaccttggaggcagcaccgttttcagctctgatttccgcaaagcaattcctttaggacttgtgttgttaaagggcaactcccttatcttttcctctcttgaggtcgtgtggtagatctggaactcttttgtacctggtgtcgaatagtcttttgtggatcagcgggtgacaaaattaaatggttaccgttgtcttggggattgctttgtgcgtttgtggtgcggcaccgttcataatttacccaaaaaaaaaaaaaaaaagcttatcgataccgtcgacctcgagggggggcccggtacccaattcgccctatagtgagtcttattacgcgcgctcacn

SEQ ID NO: 51077 - protein, 69 aa, Zea mays
  misc_feature: Ceres CLONE 1464908-F
  misc_feature (10)..(66): Pfam Name: SecE Pfam Description: SecE/Sec61-gamma subunits of protein translocation complex
MDAVDSVVDPLREFAKDSIRLVKRCHKPDRKEFTKVAARTAIGFVVMGFVGFFVKLIFIPINNIIVGSG

SEQ ID NO: 51078 - DNA, 709 bp, Zea mays
  misc_feature: Ceres CLONE 1464909-F
  misc_feature: Encodes the peptide sequence at SEQ ID NO. 51079
  misc_feature (515)..(515): n is a, c, t, g, unknown, or other
ctttactagtggatcccccgggctgcaggaattcgcacgagaccattacctagaacatcctaatcgaaaaactgctcctctctttcgacaagttcctcttccactacctgaagcgccgctggttctccggcggcagcggcgccaccgtcccaaggccccccgccaaatcgaggcggaacatggcggccgccaagtggagcgagacggccatgctcgttatcgacatgcagaaggacttcgtggacccggcgatgcgcagcccgatgctggtggccggtggcgaggccgtcgtccctgccgttgccggggccgtcgccgtcgcaagggagcgcggtattttcgtcatccacgttgacacacaccatgaccctcccggaagagatgttgaacttttccgtaggccccattattctgggggaaaggttcccacgactaaaggtctgaaaggagcggagctggttgaatggtttgttatcctaaaaggggagttacaagtggcgaacacacaatttagngcttctcttccaacacatcctgcatcttgtcccgaaaaccgctttgaatcaagtacttggcctcatggttggatttcataccccaaaattggtttttcctggaaaacagcagcttccatgcctcttatgcttggggacgtatcaagcataagttaccgagtgtccatatataaatgacaaaccaacttccctgg

SEQ ID NO: 51079 - protein, 170 aa, Zea mays
  misc_feature: Ceres CLONE 1464909-F
  misc_feature (112)..(112): Xaa is any aa, unknown, or other
MAAAKWSETAMLVIDMQKDFVDPAMRSPMLVAGGEAVVPAVAGAVAVARERGIFVIHVDTHHDPPGRDVELFRRPHYSGGKVPTTKGLKGAELVEWFVILKGELQVANTQFXASLPTHPASCPENRFESSTWPHGWISYPKIGFSWKTAASMPLMLGDVSSISYRVSIYK

SEQ ID NO: 51080 - DNA, 673 bp, Zea mays
  misc_feature: Ceres CLONE 1464910-F
  misc_feature: Encodes the peptide sequence at SEQ ID NO. 51081
  misc_feature (673)..(673): n is a, c, t, g, unknown, or other
agtggatcccccgggctgcaggaattcgcgcgagaccattgcctagaacatcctaatcgaaaactctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgctccacgaccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcgttcaggtgtgccaggtgatcggcgccgtcgttgacgtgcgcttcgatgagggcctcccgcccatcctcacggcgctcgaggtgctcgacaacaacatccgcctcgtgctcgaggtggcgcatcaccttgacgagaacatggtgcgcaccatcccttaggacggcacgtaggggctcgtccgcggccagcacgtcctcaacactggctcccccattaccgtgccttgttggcagggctaccctttggaagcattcataatggttattggtgaaaccgatttgttgagaaagggtgacan

SEQ ID NO: 51081 - protein, 134 aa, Zea mays
  misc_feature: Ceres CLONE 1464910-F
  misc_feature (85)..(134): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRAPPHRPSPAGYLFNRAAAYASSAAAQAAPATPPPATGKTGGGKITDEFTGAGAIVQVCQVIGAVVDVRFDEGLPPILTALEVLDNNIRLVLEVAHHLDENMVRTIP

SEQ ID NO: 51082 - DNA, 746 bp, Zea mays
  misc_feature: Ceres CLONE 1464914-F
  misc_feature (746)..(746): n is a, c, t, g, unknown, or other
tggagctccccgcggtggcggccgctctagaactagtggatcccccgggctgcaggaattcgcacgagaccattacctagaacatcctaatcgaaaattttttcttttgtttgggtaaagtcagtgaggagaagtctatagttctctatttgtccactcaggaattaatgttgagtaaattgttgcattacaagttaatgttttgttgagtctatgaactcagggccactaagagtttatggctgcttgagtctatggattcatggtcatgaaaatatatttttagtgctttcttgcttcctgataacacttaatttatatagaattgttggtacctttgttggcatgtttatgttgattatgttaggtgatggtgattagaagctacaacagtggtttatgttattagttattcaaagacagggctctgaatcaaagtgagcttgtagttgaatgccagcatactgcattagtgatactttttaaatacttcacctgattaagtctagataaacctgatcattttattgtgttatttatttgttttttcgcagataaagttcttccacaagataaacagtcttcctggacctgtgactgattctgagaagctaatttggaatgttctggaagctgaacgacctgacatgaggcaattacatggaaagtccctcgttgaagtaaacagaagtttccttgaaaaacacaatgcttccttgatgcaccgagcagctggtgctgaaatn

SEQ ID NO: 51083 - DNA, 779 bp, Zea mays
  misc_feature: Ceres CLONE 1464915-F
  misc_feature: Encodes the peptide sequence at SEQ ID NO. 51084
ggagctccccgcggtggcggccgctctagaactagtggatcccccgggctgcaggaattcgcacgagaccattacctagaacatcctaatcgaaaaagaaggcgaacttcaccgacgggcattggaaacggaacataaccgatccgaggctgaagacttgcttcgagaagttctgcttctgggagagcatgctatggcactggggcgagaacaagaacaactcgacgcagagcagcgcggtgccggcaacacctgccgcgacgagcctgtcgagctcgtgaggcctgttgtgtagatacagctttgttgagagtagtagtataccagatacgaaacttctgaagctcctccatacatacatagcaacagctctgtaaaagtagctatgtaggccttttcccccccaaacgactatactctttgttcgccgtcacggctgcagcgccccctcctgctgcttcctgatggctgacaatctttttgggttttgccaataatcatcagaattggctggtttttccctctgggcgggttggggccccgtctggggctgtttttgcttcaaaccctacgggggctactgcttttggtgcgggaccccagcggtttgaatgttgggggggtaaaccattttccgggataactcggggggggggcaatatgggattgggggacccacaaaaccgggccctttttggggggggaaatttttttgttggcgggccaacaaaaaaaaaaaaaacttttttttcccccccccccccgggggggggccccgc

SEQ ID NO: 51084 - protein, 30 aa, Zea mays
  misc_feature: Ceres CLONE 1464915-F
MLWHWGENKNNSTQSSAVPATPAATSLSSS

SEQ ID NO: 51085 - DNA, 758 bp, Zea mays
  misc_feature: Ceres CLONE 1464923-F
  misc_feature: Encodes the peptide sequence at SEQ ID NO. 51086
tggagctccaccgcggtggcggccgctctagaactagtggatcccccgggctgcaggaattcgcacgagaccattacctagaacatcctaatcgtaaagggcccgtgtctcagcgcacacctcttcgtgctcgctcccatggaggccaccccgatctccatgaagccaccggcgccggcgccggcgccacccccggtcactctggagcccatagaattgtcaacgcatgccgtcggagtgaccgagctggagcgatccagcatgaaccagctcgcaatagcgccggaccccaagcggcagagggtggaggaggctgcggatggcaacgggtgcaagcattgcgcctgcaagaagtccagatgcttgaagctctattgcccatgttttgctggaggtggttattgttccgataagtgtggctgccaaccatgtttcaacaaagaagccttttcagaaacagttcagactactcgcaaggtgttactttcaagacagaagcgcatgtcgatgaaaattaataggagacctgaggcaaatgctgaaccaatggaagatgttcaccattcttcttcgtcaactccaccaaggagaggttgcaactgcaagaaatcaagttgcctgaagaaatactgtgattgctaccaggatgggaccggatgttccttgttttgccgttgtgacgattgccagaacctttcgggaaaatgacggcataattgctgatgacagtaagcgctatctgtacactggtgctgatt

SEQ ID NO: 51086 - protein, 189 aa, Zea mays
  misc_feature: Ceres CLONE 1464923-F
  misc_feature (148)..(189): Pfam Name: CXC Pfam Description: Tesmin/TSO1-like CXC domain
  misc_feature (63)..(104): Pfam Name: CXC Pfam Description: Tesmin/TSO1-like CXC domain
MEATPISMKPPAPAPAPPPVTLEPIELSTHAVGVTELERSSMNQLAIAPDPKRQRVEEAADGNGCKHCACKKSRCLKLYCPCFAGGGYCSDKCGCQPCFNKEAFSETVQTTRKVLLSRQKRMSMKINRRPEANAEPMEDVHHSSSSTPPRRGCNCKKSSCLKKYCDCYQDGTGCSLFCRCDDCQNLSGK

SEQ ID NO: 51087 - DNA, 651 bp, Zea mays
  misc_feature: Ceres CLONE 1464925-F
  misc_feature: Encodes the peptide sequence at SEQ ID NO. 51088
  misc_feature (605)..(605): n is a, c, t, g, unknown, or other
  misc_feature (636)..(636): n is a, c, t, g, unknown, or other
ggagctccccgcggtggcggccgctctagaactagtggatcccccgggctgcaggaattcgcacgagaccattacctaaaacatcctaatcgaaaaactattttttagttccaaaaagctcgtcgggaagaggagcaaaacaaaccctatctaaaccgcggcggactcttcgtccagcaaggtttcccatccagatccggccacgccacttgctcctcttctccgccacaccgatggtgtacgtggattcctgggacgagttcgtggagcggtccgtgcagctcttccgcggcgaccccaacgccacccgctacgtgatgaagtaccggcactgcgaggggaagctcgtgctcaaggtcaccgacgaccgcgagtgcttgaagttcaagacagatcaagctcaagacgcaaagaagatggagaagctcaacaacatcttttttgctctcatgacacgtgggcctgatgttgatatcagtgaagtttcagggaaggaacaggcagagcaacagcaagcgaagaaaggtcgggggagggagggcatatgcggtctgatcccttatttgtacagaaaatcacaactggaatgatggataacatttcantgacttttatgtactcggagaaagttttccngtaccgaaccgaaaa

SEQ ID NO: 51088 - protein, 118 aa, Zea mays
  misc_feature: Ceres CLONE 1464925-F
  misc_feature (2)..(76): Pfam Name: SRP9 Pfam Description: Signal recognition particle 9 kDa protein (SRP9)
MVYVDSWDEFVERSVQLFRGDPNATRYVMKYRHCEGKLVLKVTDDRECLKFKTDQAQDAKKMEKLNNIFFALMTRGPDVDISEVSGKEQAEQQQAKKGRGREGICGLIPYLYRKSQLE

SEQ ID NO: 51089 - DNA, 696 bp, Zea mays
  misc_feature: Ceres CLONE 1464926-F
  misc_feature: Encodes the peptide sequence at SEQ ID NO. 51090
aagctggagctccccgcggtggcggccgctctttactagtggatcccccgggctgcaggaattcgcacgagaccattacctagaacatcctaatcgaaaaacaacaccaagaagcaagaaaactagaaaaggctcctcccgaccgcaacgcccctcatctccctcgaccccgacatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgatgccgccaagctggcgcggtacaacaagaagcccaccattcacgtcccgcgagatccagacctccgtgcgcctagtcctccccggagagctcgcccagcacgccgttctccgagggaaccaaggccgtcaccaaggttccccccaaactgaccgccctgccgggacccccgaatctggttaaaagggttctttggtgggtccttttcccca

SEQ ID NO: 51090 - protein, 149 aa, Zea mays
  misc_feature: Ceres CLONE 1464926-F
  misc_feature (55)..(122): Pfam Name: Histone Pfam Description: Core histone H2A/H2B/H3/H4
MAPKAEKKPAEKKPAAEEKAEKTTAGKKPKAEKRLPASKSSGKEGGEKKGKKKAKKSVETYKIYIFKVLKQVHPDIGISSKAMSIMNSFINDIFEKLAGDAAKLARYNKKPTIHVPRDPDLRAPSPPRRARPARRSPREPRPSPRFPPN

SEQ ID NO: 51091 - DNA, 676 bp, Zea mays
  misc_feature: Ceres CLONE 1464931-F
  misc_feature: Encodes the peptide sequence at SEQ ID NO. 51092
tggagctccccgcggtggcggccgctctagaactagtggatcccccgggctgcaggaattcgcacgagaccattacctagaacatcctaatcgaaaaactcgccgcctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaaagaaggagaggcttctgaaggagggcccagctgagaatgaaggaaaaactggtgagatccaaaaaacccatttgttgggaagattggccttaaactggggactttacccccattggaaaaaaaaaagggtccccctttgttgtcctccccccccacacggggatcccataaaaaattttttttggggggcttcccc

SEQ ID NO: 51092 - protein, 113 aa, Zea mays
  misc_feature: Ceres CLONE 1464931-F
MAPKRGGRAPVPAKKKTDKVTNPLFEKRPKQFGIGGALPPKKDLHRFVKWPKVVRIQRQRRILKQRLKVPPALNQFTRTLDKNLATNLFKMLLKYRPEDKAAKEGEASEGGPS

SEQ ID NO: 51093 - DNA, 746 bp, Zea mays
  misc_feature: Ceres CLONE 1464935-F
  misc_feature: Translation starting site: 117
  misc_feature (333)..(333): n is a, c, t, g, unknown, or other
  misc_feature (435)..(435): n is a, c, t, g, unknown, or other
ggatcccccgggctgcaggaattcgcacgagaccattacctagaacatcctaatcgaaaaattcgtatcctctcctcactctcgccgccgccgcttcccctgcgccccgagccaagatgaatgttgaaaagctcaagaagatggcaggtgctgtgcgcactggggggaagggtagcatgcgcaggaagaagaaggcagtccacaagactacgacccagatgataaaaggcttcagagcaccctgaaaagaataggagtgaacaccattcctggtattgaagaggtcaacatctttaaggatgatgttgttattcagtttgtgaatcctaaagngcaagctttaatacatgggtggtcagtggaactcttgtgtgccccccaacctgcaagatctgcttccgtccattatcaaccagctcggccctgacaacctanacaacctgcggaggcttgcggagcaattccagaagcaggcccctggtgcttcaggtgcagaggctggcgccagcgctggtgctgctcaagaccatgacgaatacgttcctgagctcgtccctggagagacttttgaggaggccgcggaaagaaaaaaaggagtcatcatggattttgccacttgcccgccccttgggaagggctttataaataaagccttttcgtagaaagggacctgtttaagaacttcgaacctcctttatttttggccctggttacggttatggtctgaaacgaaaaatttgttaata

SEQ ID NO: 51094 - DNA, 787 bp, Zea mays
  misc_feature: Ceres CLONE 1464937-F
  misc_feature: Encodes the peptide sequence at SEQ ID NO. 51095
  misc_feature (16)..(16): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (787)..(787): n is a, c, t, g, unknown, or other
ttgtggccccccccgnggcggggccattaaccaacttctcccgggggnnntaaaactggggctccaccgcggtggcggccgctctagaactagtggatcccccgggctgcaggaattcgcacgagaccattacctagaacatcctaatcgaaaaccaacctacccagcctcggccagccacctccccgtcgctctcacgctcttcgtgcccgacgcctcccctcttcccctccaacctcactcctcccgtctgacgcacatggcatccatcgccggatcttcagatctctccttcgccatgcctgtcaaggcaatcaactcaaattctctagccttctccccggtgaggaagggtaacacattcctccgcctgcaaccagtgcctatgagatctgtttcctgcgttcccaagaaggatacggtggacaaggtttgtgaaattgtgaacaaccatcttgctcctcccgaccactctgaggttcgcggtgaatggaaatattctgaactaggcgcggattccggggacaggggccacattgtcatgggccttgaagaggcactttgaccttagcgcgcagcgattcccccgcttcaccaattcgccccgttgtttgaattctctctgcctcctcgcaccagaatagatccccccaaaaaaaatagggcgtgtacacattagagaacccggggagtccgtaccgcgctgcccctctcccaagccgcctcccatcaccaccgggcgtgactttttctcccccctacatattacattcgcaccccccctccn

SEQ ID NO: 51095 - protein, 101 aa, Zea mays
  misc_feature: Ceres CLONE 1464937-F
MASIAGSSDLSFAMPVKAINSNSLAFSPVRKGNTFLRLQPVPMRSVSCVPKKDTVDKVCEIVNNHLAPPDHSEVRGEWKYSELGADSGDRGHIVMGLEEAL

SEQ ID NO: 51096 - DNA, 671 bp, Zea mays
  misc_feature: Ceres CLONE 1464940-F
  misc_feature: Encodes the peptide sequence at SEQ ID NO. 51097
ggagctccaccgcggtggcggccgctctagaactagtggatcccccgggctgcaggaattcgcacgagaccattacctagaacatcctaatcgaaaaaaaatacgagggtcaaatctctcgtctcgctcggctcctctgggcccacagcggccagcaaactgcctccgtcctccctgcgggctgtgccgcctcttcttcgcgtcggcgccgccctcctcccttctcttctgctgctgatggaactggatcctcgcctctacgagaacgtctctgtcagcgacaacgatgtctgaaacatagttctatcttatcttatgcacaactgttttaaagggacggcagaggcattcctatctagcactgggttgaatttacctgtcgactatagtgtggatgtggataagcgtaaagcaatttttaattttgtgctagaagggaatgcccttaaagccatagagctgacagaagaaatggcacctaacttgctagagaatgatatggatctacattttgatcttcttagtctccacttcattgagctagttcgctcaaaaaaattcacagaagctcttgactttggccagaaaaaattgacatcatttcagaaggttaccaagtatattgagaaactagaggactttatggccctcctggcttatgaagagcctga

SEQ ID NO: 51097 - protein, 118 aa, Zea mays
  misc_feature: Ceres CLONE 1464940-F
MHNCFKGTAEAFLSSTGLNLPVDYSVDVDKRKAIFNFVLEGNALKAIELTEEMAPNLLENDMDLHFDLLSLHFIELVRSKKFTEALDFGQKKLTSFQKVTKYIEKLEDFMALLAYEEP

SEQ ID NO: 51098 - DNA, 684 bp, Zea mays
  misc_feature: Ceres CLONE 1464942-F
  misc_feature: Encodes the peptide sequence at SEQ ID NO. 51099
aagctggagctccccgcggtggcggccgctctagaactagtggatcccccgggctgcaggaattcgcacgagaccattacctagaacatcctaatcgaaaaacacttcaattacgattattccagataagcacgatccgatgatggccccaccgatatccgccgatgccttggtggaggctgcctcggccgtcgccgcgtacccagccatcgcgccgaacagaatgctttgcaaggacgcgccggcgccggccatctctgtcgtctcgaagcagacggtccggcccgccggcgcgtcggcggcggtcggcagtggagacctcaggctctcggtgtcggacatgccgatgctatcgtgccactacatccagaaggggctgttcttcccgccgcctcctcccggcgtgctggcggcctcgctggtgtcgtcgctcgtggcggcgctctcccgcgcgctcggggtcttccccgcgctcggcgggcgccttcgtcacgctccacgacaacggcatccgggattcggggggcgcgggttaccactccccgccgttcaagtttcaaccacgcgggggggccgccttcctctgcccctccggggaaatttcccgggaggcccgggggcccaaaaatggcccatccccctttttaaccaaaacgggccttgtgtccccccctgggaaccggg

SEQ ID NO: 51099 - protein, 180 aa, Zea mays
  misc_feature: Ceres CLONE 1464942-F
MAPPISADALVEAASAVAAYPAIAPNRMLCKDAPAPAISVVSKQTVRPAGASAAVGSGDLRLSVSDMPMLSCHYIQKGLFFPPPPPGVLAASLVSSLVAALSRALGVFPALGGRLRHAPRQRHPGFGGRGLPLPAVQVSTTRGGRLPLPLRGNFPGGPGAQKWPIPLFNQNGPCVPPWEP

SEQ ID NO: 51100 - DNA, 687 bp, Zea mays
  misc_feature: Ceres CLONE 1464945-F
  misc_feature: Encodes the peptide sequence at SEQ ID NO. 51101
tggagctccccgcggtggcggccgctctagaactagtggatcccccgggctgcaggaattcgcacgagaccattacctagaacatcctaatcgaaaaatgtccagcatatcgacgcagagtcgcagtcgcagcacacactgaattctctttagctagctaagagagggtagccacaccaagacaggatgcagacagcgaaggtgaaggcgaaggacatggtgagctcggcgaaggagaaggtgaaggaggggtcggcaaagatgcagggcaagacgggcgaggcgacggcggccacgcacggcgagaaggagatggccaaggaggcggcccgcgccaagaaggaccaggccaacgccgacaagcaccaggagaaggccgaccaccgagcggacgccgccactggccaccacggcacgcgcgtgcccctcaccggcccgcacggccaccacggcgctggcgcggccgtcgaccccgcgtacccgtcctccggcaacacgtacccggcgtcgggcaagtacatctaggtgactgcgtcggatgagcgaggccagggtcgtggtcgcacttgcgtttttgtgtcgtagcgaccggaaaatcgatcctggctgtacgcctgcagtaccggtacccacgggtaattttaaaagggatgcgtggcaccctcccgtgccccaaacctcctgaaa

SEQ ID NO: 51101 - protein, 112 aa, Zea mays
  misc_feature: Ceres CLONE 1464945-F
  misc_feature (1)..(73): Pfam Name: LEA_1 Pfam Description: Late embryogenesis abundant (LEA) group 1
MQTAKVKAKDMVSSAKEKVKEGSAKMQGKTGEATAATHGEKEMAKEAARAKKDQANADKHQEKADHRADAATGHHGTRVPLTGPHGHHGAGAAVDPAYPSSGNTYPASGKYI

SEQ ID NO: 51102 - DNA, 690 bp, Zea mays
  misc_feature: Ceres CLONE 1464950-F
  misc_feature: Encodes the peptide sequence at SEQ ID NO. 51103
ggagctccccgcggtggcggccgctctagaactagtggatcccccgggctgcaggaattcgcacgagaccattacctagaacatcctaatcgaaaagactaatagcatctgcctgcctgcactggactcaaaaacatgcctgccgtaggatcctctgatgtgtccattcgcgtgttgagtcggcggcttgtgaaggcatccgacccctccctccagccgcacgtcgtcaccttctcaaacctagatctctacccggacaacgtgcaggcctccatagtgtgcctctaccccaagctgtcaacaaagtccggcccgggcggcggcttcgacgccgtcgtctccaccttcgaggccgtcctgccgaccttgcttaaccacttctaccctctcgccggccgcattgtcgtcaacccaagctccggcgtccccgagctccactgccacaaccagggcgcggagctcgtcgtgggagaggtcggcgtcgccctgggcagcctggattacggtctcgccgaggagtccctgaagaagatcatgatgccgtaccctgaggacgtcacgctctcggtgcagctgctgtccttcgcgtggcggcgctttctccgtcgtggtggccaaaaaacaaccttcctaacgacggcaaccgcccttcccatgggcgtcaggatgggggcccgaactggccccgaa

SEQ ID NO: 51103 - protein, 185 aa, Zea mays
  misc_feature: Ceres CLONE 1464950-F
MPAVGSSDVSIRVLSRRLVKASDPSLQPHVVTFSNLDLYPDNVQASIVCLYPKLSTKSGPGGGFDAVVSTFEAVLPTLLNHFYPLAGRIVVNPSSGVPELHCHNQGAELVVGEVGVALGSLDYGLAEESLKKIMMPYPEDVTLSVQLLSFAWRRFLRRGGQKTTFLTTATALPMGVRMGARTGPE

SEQ ID NO: 51104 - DNA, 678 bp, Zea mays
  misc_feature: Ceres CLONE 1464952-F
  misc_feature: Encodes the peptide sequence at SEQ ID NO. 51105
gcggtggcggccgctctagaactagtggatcccccgggctgcaggaattcgcacgagaccattacctagaacatcctaatcgaaaaattcacatctgtagccgcgcctctccgtatcactccgcgcctctctcccgccaggccgccgcccaagcaaccatggtggccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcagcgaggttttctggaactggacctggtgctggggacctgggacgagcagcacgtgcacgccatggacgaggccaacatccacgccctcctgcaagtgctcgacctcgaaaacccagatttgtggaaatggttgactagccaggagcagccaccagaggatctgaattctaatccggggtttgctgccttcaaatcaaaggtcacaaataacctgaacaaaacatgctttctcctgaaaccccattttaccccagtccaaaccttggttttaaaaaatgggcacaaactaaagaaaggcc

SEQ ID NO: 51105 - protein, 173 aa, Zea mays
  misc_feature: Ceres CLONE 1464952-F
  misc_feature (60)..(151): Pfam Name: DUF339 Pfam Description: Protein of unknown function (DUF339)
MVAALLRRALHLRRVLPSPAVTAAASQRLIPAFSTTPTPTPTTSQQNAATTTIDLSSDESRRRLLNRLVYRSKQRGFLELDLVLGTWDEQHVHAMDEANIHALLQVLDLENPDLWKWLTSQEQPPEDLNSNPGFAAFKSKVTNNLNKTCFLLKPHFTPVQTLVLKNGHKLKKG

SEQ ID NO: 51106 - DNA, 757 bp, Zea mays
  misc_feature: Ceres CLONE 1464954-F
  misc_feature: Encodes the peptide sequence at SEQ ID NO. 51107
  misc_feature (650)..(650): n is a, c, t, g, unknown, or other
  misc_feature (724)..(724): n is a, c, t, g, unknown, or other
  misc_feature (757)..(757): n is a, c, t, g, unknown, or other
aagctggagctccccgcggtggcggccgctctagaactagtggatcccccgggctgcaggaattcgcacgagaccattacctagaacatcctaatcgaaaaatcaatctgatctgatttaatgcccataagcctcgagtcggtccatccggttttgtgttgcgctatctcctattttgtggaggcgatggagagttttactaatgggaatgttcgattactgaagcatgagcgtagcattgtcgcagaggatgatcttgaccagcgatggcaggaagccactggagagtctgtttctgaggtcatattcctcagcaaacacactgcagtctccaaacgtccagcactcacagtgcatccaattggtgtgccacatctgaaggaggatgaaaccccaccccaaggaggaactcctggatgggcagcaattccaagtcctcgaattggaccttggctccggttgatgcaaaagatagctgtagaacaaggccttgttccagagtttgaggttacgcttgaggctactcaccatggaccagttaccagcacacccaccatgtttgttgagataggaagtacagaagaccactggggtcgacaagatgctgcacaggcaattgctctagttctatggaaaggtcttggtctggnagatggaaatgctgttggaacttggcagaggaattgtgaaaaggttctattaggtataggaagtggtcactatngtcctcgtcacatggatatttgtcatcaagtgn

SEQ ID NO: 51107 - protein, 212 aa, Zea mays
  misc_feature: Ceres CLONE 1464954-F
  misc_feature (177)..(177): Xaa is any aa, unknown, or other
  misc_feature (202)..(202): Xaa is any aa, unknown, or other
MPISLESVHPVLCCAISYFVEAMESFTNGNVRLLKHERSIVAEDDLDQRWQEATGESVSEVIFLSKHTAVSKRPALTVHPIGVPHLKEDETPPQGGTPGWAAIPSPRIGPWLRLMQKIAVEQGLVPEFEVTLEATHHGPVTSTPTMFVEIGSTEDHWGRQDAAQAIALVLWKGLGLXDGNAVGTWQRNCEKVLLGIGSGHYXPRHMDICHQV

SEQ ID NO: 51108 - DNA, 986 bp, Zea mays
  misc_feature: Ceres CLONE 1464956-F
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (308)..(308): n is a, c, t, g, unknown, or other
  misc_feature (487)..(487): n is a, c, t, g, unknown, or other
gagggggtggncaccnnnnnnnnaaggggggggannnnnnaaaactggcgctccccccggtggcggccgctctttaatagtggatcccccgggctgcaggaattcgcacgagaccattacctagaacatcctaatcgaaaacttttggagttcgtgttatatctcgagcccccaccctgccgctcgctccccctcctcccgcttgattccagtggccctgcttccctcgtcgtcactctctctcgagagcagcaccggcacttcggacaggagttgaaaagcaaaggtgtgttcttgtcatggaccanccccaccacaagggaatagcggtctctgcgcaagcggcggccgccaaacggaaccaagggcgccgaagctgatcggggtacttcgacgttgctcgtgttggagggggtgtggtaacatctatgaatatttggtttttaccagaaaggaagtatgccgacccccggggggccacacctanactagtgaaaagtggacgccgggccgcctccccaccacatatcccaccaaaccaagaggggctacgagcccggtggtttaagaacttgttagatttcgcccccctcatattgaggtttcggtgggtaacttgtaaatctctctgttatttcggtgtggtaagagggtctagtaaagtccatcatcgtctgtgtcttcaataatatattatcttatcaacaaccaattttatcggaggtgttatgctatcatatgcgctcccgtctctacggtaaaatatgtggttcatttatacacataaatggatcgacgagtcatttcttgtgcaaatcttgtgatagcgattactcataagtccgaagctgtgtcacaccaatacacgtcgtcgggctagtcgcttgctgttcgcatgtactgctttataataaatcagcgctgacccgagcacagcaacgtcttcgtccatgttttctgataacattcatattggtcgaatctac

SEQ ID NO: 51109 - DNA, 760 bp, Zea mays
  misc_feature: Ceres CLONE 1464957-F
  misc_feature: Encodes the peptide sequence at SEQ ID NO. 51110
  misc_feature (23)..(23): n is a, c, t, g, unknown, or other
  misc_feature (50)..(50): n is a, c, t, g, unknown, or other
tgttgcctccctatacttgcccnccattaccggaaacttttccccccctntttcaaaactggggctccaccgcggtggcggccgctctagaactagtggatcccccgggctgcaggaattcgcacgagaccattacctagaacatcctaatcgaaaagagtagggttctagcgcctatctggtttctccctgcgccgccgccgccgccgtggacaaccggagcgtagtgggaggggatgatggagggaggtagccgcgcggatgggcggaatccgaaccagctccggccgttcacctgcaccgggaacccgctccaccgcgcccacggctccgcgcggtgggcgcagggcgacaccgtcgtgctggccgctgtgtacgggcccaagtcgggaacccggaagggcgagaaccccgagaaggcctccatcgaggtcgtgtggaagcccaagaccggccagatcggaaggcaagacagggaatatgagatgacactcaggaggacgttgcagagcatctgcttgcctcacagttcattcctaacaccaccacctctggtcgggctttcagttgggggggaagatggttcctcttaagccactggcaattaatgcgttctggtgcggccctggctttgcctggaatccctatgaaaaattctccctgtccccaattacccggggagaggaaggaccaatgggggtggtaattccttaacccttcccaaagccaaaaaaaacgccagctttaggttgttttggtc

SEQ ID NO: 51110 - protein, 117 aa, Zea mays
  misc_feature: Ceres CLONE 1464957-F
  misc_feature: SWISSPROT Homolog: EC 2.7.7.56 tRNA nucleotidyltransferase
MEGGSRADGRNPNQLRPFTCTGNPLHRAHGSARWAQGDTVVLAAVYGPKSGTRKGENPEKASIEVVWKPKTGQIGRQDREYEMTLRRTLQSICLPHSSFLTPPPLVGLSVGGEDGSS

SEQ ID NO: 51111 - DNA, 701 bp, Zea mays
  misc_feature: Ceres CLONE 1464958-F
  misc_feature: Encodes the peptide sequence at SEQ ID NO. 51112
  misc_feature (430)..(430): n is a, c, t, g, unknown, or other
  misc_feature (461)..(461): n is a, c, t, g, unknown, or other
ggagctccccgcggtggcggccgctctagaactagtggatcccccgggctgcaggaattcgcacgagaccattacctagaacatcctaatcgaaaaacagactcgcactgcactcgtccaatccagggaggctgggaaggatcagggatccatccaccgttctgtcttctcaggtcgacaggaggccagaccaggtgcgcgcgtccgtgtcggcgatgagcgcgggcgggagccgggcgcggcagaacgcgatgcgctcaggggtggtggtgctgggcgccgtggccttcggctacctctccttccgcgtcggcttcaagccctacctcgaccaggctcaggaggccatcgactccgcccgcgaccccgaccctgaccccgccacccaccgcgcgagggacgcgtccgacgatcccggcgccggtcgccnagggggagacctcgggccgtccaaggacccngccgtcgtactgcgcgactgaagcccggtgcgggcggttggttggcccattttggcaaacactttgtacgcgggcccctggctcaactgttttgggtagaatgggccaccctgggggaagaacttccctccctgctgctttgaaatttgaaacgggtttcgtggggaagcccaacctaaaactccctgttgaaatcaaaaaaaaaaaaaaaaatttttttaatcccggcaccccccgggg

SEQ ID NO: 51112 - protein, 88 aa, Zea mays
  misc_feature: Ceres CLONE 1464958-F
  misc_feature (72)..(72): Xaa is any aa, unknown, or other
MSAGGSRARQNAMRSGVVVLGAVAFGYLSFRVGFKPYLDQAQEAIDSARDPDPDPATHRARDASDDPGAGRXGGDLGPSKDPAVVLRD

SEQ ID NO: 51113 - DNA, 714 bp, Zea mays
  misc_feature: Ceres CLONE 1464959-F
  misc_feature: Encodes the peptide sequence at SEQ ID NO. 51114
aagctggagctccccgcggtggcggccgctctagaactagtggatcccccgggctgcaggaattcgcacgagaccattacctagaacatcctaatcgaaaaacaagaagttggagctgctcgcctgctgcccctttcctcccccgggccccctctccgctgcgacggcgagcccaagaaaactttcctctaggagcgcatggaggtgtccgctgggctccggccgccgcccgtcgctgcggcagcgtcgctccgaggccgtcggtttgcgtcggtgccgccgctcgcggcttcccattcggtgcggtccgtgtcccgcgcggttaagaataaagcaagtgcaatctatgacctccaaaggaatagaagtaaccttgaatcgctattctgctacgacaaatctgtcccagaggagaatattggaaaaccgtccggtctagatctggaaaagaaagatgtcggggaacaaccctccctgctcaagctgtgaaagctaaggggctgtgctgtgcccaacatgcgctgggtcaaggcttgtacgtcgactcgatactgaaaaagcaagggatcctccggaaagtcaaaatgctaagctggggaggaactgggaacatcatggggccccaggggtgaaggccggggccatcccgaattgaaaaaaagttggggaattggcagggccccccaaaaaaaaaaaaaaacccggttaaacccc

SEQ ID NO: 51114 - protein, 96 aa, Zea mays
  misc_feature: Ceres CLONE 1464959-F
MEVSAGLRPPPVAAAASLRGRRFASVPPLAASHSVRSVSRAVKNKASAIYDLQRNRSNLESLFCYDKSVPEENIGKPSGLDLEKKDVGEQPSLLKL

SEQ ID NO: 51115 - DNA, 644 bp, Zea mays
  misc_feature: Ceres CLONE 1464960-F
  misc_feature (198)..(198): n is a, c, t, g, unknown, or other
  misc_feature (199)..(199): n is a, c, t, g, unknown, or other
  misc_feature (481)..(481): n is a, c, t, g, unknown, or other
  misc_feature (575)..(575): n is a, c, t, g, unknown, or other
  misc_feature (592)..(592): n is a, c, t, g, unknown, or other
  misc_feature (594)..(594): n is a, c, t, g, unknown, or other
  misc_feature (601)..(601): n is a, c, t, g, unknown, or other
  misc_feature (617)..(617): n is a, c, t, g, unknown, or other
  misc_feature (618)..(618): n is a, c, t, g, unknown, or other
  misc_feature (622)..(622): n is a, c, t, g, unknown, or other
tggagctccccgcggtggcggccgctctagaactagtggatcccccgggctgcaggaattcgcacgagaccattacctagaacatcctaatcgaaaaacgcacaccaatcgcccacaagcgctcgcaggagaggtcgaaaccctagcttttgcggcggcggcgagagaagatgatctacgacgtgaactcccccctcnnttccgttccttttcctccagccagaaagggggcgggccgccccaacaaaaaggggaaaatggggggggggctttttaccccccagggggggccaaaaggccccccagggggttaaaaagaaaaaaaaaccccctgggggtaataaaaaaaaaaaaaaatttttttctccccaaaaaatttttttttttttgggggggggcccccccacacccccccaaaaattgactttttttttttttgcggggcccccaaataaaaaaaaaaaaaaaaaaccgggcgccnaaaaaaaaaaaaaaaattttcggtgggggggggggggggggtatattccccccccccccccccccccaaaaaaaaaatttttttgttttttttntccccccccccggcggngncgggggncggggggccggcgccnnccanagaaaataaaaaaatatttttt

SEQ ID NO: 51116 - DNA, 711 bp, Zea mays
  misc_feature: Ceres CLONE 1464962-F
  misc_feature: Encodes the peptide sequence at SEQ ID NO. 51117
  misc_feature (711)..(711): n is a, c, t, g, unknown, or other
ggagctccccgcggtggcggccgctctagaactagtggatcccccgggctgcaggaattcgcacgagaccattacctagaacatcctaatcgaaaaatttgggatatctccccccatggccttctagagaaattgtacacatattccctgcctctcgctagcgccttccctccgcaaacggaaggctctcgtgaccaccgggatgtccgccatggagaccgacatcaacgcgccgccgccgcccgccccagctggagagggatcctctgcggccggtccgtcctcctcccgcaagcccaacaagcgcttcgagatcaagaagtggaacgccgtcgcgctctgggcatgggatatcgtcgtcgacaactgcgctatctgccgcaaccacatcatggatctatgcatccagtgccaggcgaaccaagccagcgcgaccagcgaggagtgcactgttgcttggggagtctgtaatcatgcttttcacttccactgcatcagcaggtggcttaagactcgtcaagtgtgcccattagataacagtgacgtgggagttccaataaatattggcactatttcctggggcccctcatgtgatgtcggggctttatttttaaggggaatggctaccactcccaggggttttttttttttacacaaaagctcccactttttaatggtttggaataccccaacattatacacaggcaaatn

SEQ ID NO: 51117 - protein, 169 aa, Zea mays
  misc_feature: Ceres CLONE 1464962-F
MSAMETDINAPPPPAPAGEGSSAAGPSSSRKPNKRFEIKKWNAVALWAWDIVVDNCAICRNHIMDLCIQCQANQASATSEECTVAWGVCNHAFHFHCISRWLKTRQVCPLDNSDVGVPINIGTISWGPSCDVGALFLRGMATTPRGFFFLHKSSHFLMVWNTPTLYTGK

SEQ ID NO: 51118 - DNA, 840 bp, Zea mays
  misc_feature: Ceres CLONE 1464964-F
  misc_feature: Encodes the peptide sequence at SEQ ID NO. 51119
  misc_feature (1)..(1): n is a, c, t, g, unknown, or other
  misc_feature (35)..(35): n is a, c, t, g, unknown, or other
  misc_feature (36)..(36): n is a, c, t, g, unknown, or other
ntttttttccccttccctctccccttttccggcgnnctgcttttatttaccaaaactggagctccccgcggtggcggccgctctttaatagtggatcccccgggctgcaggaattcgcacgagaccattacctataacatcctaatcgaaaatccagtctccgtgtccagtctagtctcatcaaggaagatgtgggggagaggaaagaagcgtttcggcggtggcggcagcggtgagcccgcggccaagcgccaggcctcgagggacgatggcccctccgaatccgttgaagacggtaccgtcgtagccgagatatcgaagaacaagatggtgtccgttaggagctggaaaggcagggtcttcgtcgacttacgcgagttcttcttcaaggacggtgagactctccccaccggcaaaggtatatcactcccattaagaccagtgcaacatattgcaaggacaccatgcgaagccctttaatgacggtctttgatggagaatacactgatgggaatctcgccaaagtatgtccccttgactggccgagacttttggctcccccctcctgtttgaaagccctgaatgtctatgaactatttttttatgttcccccttagtgccaatcagggtctgccttattcccccttatgggaccactactgcttttctactaggcggtcccgcgcttgcctatgaaatggttttgcgtttcgctctccctccggtttcctattatctatttcttcccttccccctcgtacccctttaggaactcttacctctctaccctatattgcgcgcttcccccctcttcaacttattcgtgtctatttcttctag

SEQ ID NO: 51119 - protein, 96 aa, Zea mays
  misc_feature: Ceres CLONE 1464964-F
  misc_feature (10)..(96): Pfam Name: PC4 Pfam Description: Transcriptional Coactivator p15 (PC4)
MWGRGKKRFGGGGSGEPAAKRQASRDDGPSESVEDGTVVAEISKNKMVSVRSWKGRVFVDLREFFFKDGETLPTGKGISLPLRPVQHIARTPCEAL

SEQ ID NO: 51120 - DNA, 653 bp, Zea mays
  misc_feature: Ceres CLONE 1464969-F
  misc_feature: Encodes the peptide sequence at SEQ ID NO. 51121
  misc_feature (512)..(512): n is a, c, t, g, unknown, or other
ggagctccccgcggtggcggccgctctagaactagtggatcccccgggctgcaggaattcgcacgagaccattacctagaacatcctaatcgaaaaggaggcattgaggaagtcattgctaaggccgagaaaatcgccaaggagtctgcttcataaggaggcttcttgcttgttgaatcctgtacaatcaagttccatttttggattttaagcgattgtttatgcttttcacagttaggcagcacgagttggagatccatctcctgctgagatgcttgttttctctttgttgttcaaacacttcacacccaaataagcaactgcagtgacattaattttggctgcaccaaagttacatgaactgaagaaacttgtggcctgtgtgacccggatccatcagaacataaagttacggcttctggttggtaaattatgctactcttcaggttctgttcccgcattgtggaggtatcttgttctggactggctctgccgaaactagtttccgtggntttccatgtagttcattttatgggtgtgcaacttctcgccgggaccagtttaatgtttatcgactttgattggagatgacccgaaaaaaaaaaaaaaaagcttatccattccgtcaacctcaaaggggggccccgtgaccc

SEQ ID NO: 51121 - protein, 51 aa, Zea mays
  misc_feature: Ceres CLONE 1464969-F
GAPRGGGRSRTSGSPGLQEFARDHYLEHPNRKGGIEEVIAKAEKIAKESAS

SEQ ID NO: 51122 - DNA, 757 bp, Zea mays
  misc_feature: Ceres CLONE 1464979-F
  misc_feature: Encodes the peptide sequence at SEQ ID NO. 51123
  misc_feature (617)..(617): n is a, c, t, g, unknown, or other
  misc_feature (731)..(731): n is a, c, t, g, unknown, or other
ggagctccccgcggtggcggccgctctagaactagtggatcccccgggctgcaggaattcgcacgagaccattacctagaacatcctaatcgaaaaatcgcgaaggtcgtttggttccttgcccatccaatccgagcattcccagtgcgcgaaccaactgttcgtttgcttttcagtcttcgtcctctcttttgcggcccagggccagttgtcgcccgcccgcgtcgtcgtctccgccggccggtcggcctcccaaaccctagcgagccgagcgagagagaaactagacgccatgttcgggtacaggaaggcggacccggacctcgaggccggcgggtcctcgctgctgtacccggggatgacggaaagtcccgaactgcggtgggcgttcgtccgcaagatctacgtcatcctcacggtccagctcgccatgacggcagccgtctcggccttcgtcgtcaaggtgcccgccgtctccaattttttcgtctcctccaacgccgggatcgcgctctacatcttcctcatcgtcctgcccttcatcgtgctgtgccctctgcactactaccaccagaagcatccgatcaatctgctgctgctcggcctcttcaccgtcngcatcagcttcgccgtcggcatgacatgcgctttcactagcggaaaaatcattttggaagctgccattttctacagcgtggtggtgaacagcttaactgcttacactttctggnctgcgaagagggccatgacttcaact

SEQ ID NO: 51123 - protein, 155 aa, Zea mays
  misc_feature: Ceres CLONE 1464979-F
  misc_feature (109)..(109): Xaa is any aa, unknown, or other
  misc_feature (147)..(147): Xaa is any aa, unknown, or other
MFGYRKADPDLEAGGSSLLYPGMTESPELRWAFVRKIYVILTVQLAMTAAVSAFVVKVPAVSNFFVSSNAGIALYIFLIVLPFIVLCPLHYYHQKHPINLLLLGLFTVXISFAVGMTCAFTSGKIILEAAIFYSVVVNSLTAYTFWXAKRAMTST

SEQ ID NO: 51124 - DNA, 733 bp, Zea mays
  misc_feature: Ceres CLONE 1464982-F
  misc_feature: Encodes the peptide sequence at SEQ ID NO. 51125
  misc_feature (733)..(733): n is a, c, t, g, unknown, or other
aagctggagctccccgcggtggcggccgctctagaactagtggatcccccgggctgcaggaattcgcacgagaccattacctagaacatcctaatcgaaaatgctcgagtccgtggtggagcgggtgccggtggccgacctcgccgccgcggcgcggatctcgcgggagtggctccgcgcggtgcgcgccgcgctgcgccgccgcccgctgcggctgccctggctcgtcgtgcacctccagggccgcgggggcctccggtgcgccgcggcgtacaacccgtgctcgggcgcctggatcgccgtgccggcgccgcgccacgccacgccgtcgcacgtccgcctcctgcgcggcgcgcgcggggaccgcgtctgcacgctctcactctcagggctcgccgtcgcggccgatccgctcggcacgaccggatgcctcccgttggatgcccccggcgtgtggcgcatcgacctggtgttggccgcggggggcgaccgcgtcatcgcgctcggcggcacgtgccggctggcgctggccaagggcggcatctgccccgcgggcgaggtccccgaggaccgcggggcggacggcctgccatcccgatgccggaacccctcagcgactccccccgcccccaacttggctcctccccggtccgcctcgggaccaggggggtggtccctcctgggaaaagtgaccccccgggtggggtgaaggctggctccgcaccccgggggn

SEQ ID NO: 51125 - protein, 202 aa, Zea mays
  misc_feature: Ceres CLONE 1464982-F
MLESVVERVPVADLAAAARISREWLRAVRAALRRRPLRLPWLVVHLQGRGGLRCAAAYNPCSGAWIAVPAPRHATPSHVRLLRGARGDRVCTLSLSGLAVAADPLGTTGCLPLDAPGVWRIDLVLAAGGDRVIALGGTCRLALAKGGICPAGEVPEDRGADGLPSRCRNPSATPPAPNLAPPRSASGPGGWSLLGKVTPRVG

SEQ ID NO: 51126 - DNA, 734 bp, Zea mays
  misc_feature: Ceres CLONE 1464987-F
  misc_feature: Encodes the peptide sequence at SEQ ID NO. 51127
  misc_feature (734)..(734): n is a, c, t, g, unknown, or other
tggagctccccgcggtggcggccgctctagaactagtggatcccccgggctgcaggaattcgcacgagaccattacctagaacatcctaatcgaaaaatacaggccattttgccgtttccggcgcgcgcctctgaacaaacccgaaagcccccctcatcgccattcctcttcctgccatggcgatcctctttactcctcccctcccaccaccaccgcccctcccaactacaccacaccgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaaactcaacaaccgccaagttgactttctccaagcgccgcaacgggatcctcaagaaggcgcgggaaatcagcgtgctctgcaaccccaagggcggggtcttctccttccccaaggccggaaaattttacaactactggccccccaaaacaatccttatcaaaatcctgggaaaaatcccaacccactccgggaaaaatacggggggggggaaaaacccaaaaacccttatggggaaaattgcacccttaaaaaaaaaagaaacaaacccctggaaaaaaaagtcccgggccctgaaaggggaaaaaaatataaaccctgttccccccaaaaaccttttattttgttaggagggn

SEQ ID NO: 51127 - protein, 39 aa, Zea mays
  misc_feature: Ceres CLONE 1464987-F
MGKIAPLKKKETNPWKKKSRALKGEKNINPVPPKNLLFC

SEQ ID NO: 51128 - DNA, 741 bp, Zea mays
  misc_feature: Ceres CLONE 1464988-F
  misc_feature: Encodes the peptide sequence at SEQ ID NO. 51129
  misc_feature (380)..(380): n is a, c, t, g, unknown, or other
aagctggagctccccgcggtggcggccgctctagaactagtggatcccccgggctgcaggaattcgcacgagaccattacctagaacatcctaatcgaaaaattcactttgcctccgctttagcctttgtgctgcctgtactatactaacttgcaagggacgtcggcgacgaccaggcgcaccactcggcggcccggccagcccacccagagaccacctagccatggcgtccaggtgcttcttccccagggacgcgtccggcgccgacggccggcaccagcattcgaagggcgcggcggaggccctcgagcagctgcgccacggcgggcgcctcctgtcccgggaggacgtgggcggcgcggtgcgcgtcaggatcgtcnccaccaagcgcgagctcaaacatatggtcccggccctcggcaacaactacggctctggcgcggcggcggtggctgccaccaacaagcgccgccaccgtcagcttggcccggccgcggtctccggatacggggcccggaacccaagcaaagtcttgaggttgctgccggcggaacaccctcgcgtgagggtggtctgaggcgccctccccccgaacaattccattctttttcgggtatttggcaacttcgcgcatgacagagcattctccggaagaagttttatctatcctaagcatcctcctgacttacccacatatagcgggtcgagggccaccttgtacgccgactggcccatgccttg

SEQ ID NO: 51129 - protein, 117 aa, Zea mays
  misc_feature: Ceres CLONE 1464988-F
  misc_feature (53)..(53): Xaa is any aa, unknown, or other
MASRCFFPRDASGADGRHQHSKGAAEALEQLRHGGRLLSREDVGGAVRVRIVXTKRELKHMVPALGNNYGSGAAAVAATNKRRHRQLGPAAVSGYGARNPSKVLRLLPAEHPRVRVV

SEQ ID NO: 51130 - DNA, 707 bp, Zea mays
  misc_feature: Ceres CLONE 1464990-F
  misc_feature: Encodes the peptide sequence at SEQ ID NO. 51131
  misc_feature (702)..(702): n is a, c, t, g, unknown, or other
ctggagctcaccgcggtggcggccgctctagaactagtggatcccccgggctgcaggaattcgcacgagaccattacctagaacatcctaatcgaaaaatggaaccccgtttctatgcgttatccaaagagctgcatagcagcgcttctcccagccacgtcttcatcacacacggtcgcggcgcgaagcaatggcgaccacggcgccgctgctctcgccccagcgcgcttgccctacccatctccggcgccgcctctcgcccctacatctcgtattccccctcgacgcgtcagcgaggcggctgcgccttcgccgggcgccgccaccttgttcggccaagttcggcaagttcgacgcctccgacgccccggcggaggccgaggaggcggggggcgcgacggatggtgggctggcgcagcccgtggaggaggacgacaggtcgggttcactgcaccctcaactcgtgcgtaattgagaacacaaaagatgctgacgttgtgaagcggccttcgctgtggttcagttgcttgccatcggatttggagggcgcgattcggcagtcagggaaggcgagcgcagatttcgtaaactccggaggcatgcgagctatcgcagaactgctgatccctcagttggaattcctcaacgaggaaggagcacaggctgaactctgggcgttgtcaaagattttcctggacacanctgta

SEQ ID NO: 51131 - protein, 102 aa, Zea mays
  misc_feature: Ceres CLONE 1464990-F
  misc_feature (101)..(101): Xaa is any aa, unknown, or other
MVGWRSPWRRTTGRVHCTLNSCVIENTKDADVVKRPSLWFSCLPSDLEGAIRQSGKASADFVNSGGMRAIAELLIPQLEFLNEEGAQAELWALSKIFLDTXV

SEQ ID NO: 51132 - DNA, 675 bp, Zea mays
  misc_feature: Ceres CLONE 1465007-F
  misc_feature: Encodes the peptide sequence at SEQ ID NO. 51133
  misc_feature (336)..(336): n is a, c, t, g, unknown, or other
  misc_feature (339)..(339): n is a, c, t, g, unknown, or other
  misc_feature (421)..(421): n is a, c, t, g, unknown, or other
  misc_feature (504)..(504): n is a, c, t, g, unknown, or other
  misc_feature (544)..(544): n is a, c, t, g, unknown, or other
  misc_feature (594)..(594): n is a, c, t, g, unknown, or other
  misc_feature (618)..(618): n is a, c, t, g, unknown, or other
  misc_feature (660)..(660): n is a, c, t, g, unknown, or other
ggatcccccgggctgcaggaattcgcacgagaccattacctagaacatcctaatcgaaaaaacccagcagatcgatcggtcgaggcgggtaggacaggatctagaggtagctagccatggcggaggaagcgtctgcgcctgcggcggggacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagtccaccgccgcctccgccgtcggcctcgccggttctggtgccncgnatgtgctgccgtacttggaggtggatctcaagcggtccgccctgcgcgtcgtcgaaaaagccaaaggcctctgctctcaggngagcgacgctgtgtttgaggccctggagggggaccttaggaattttttctgcgaggctgtcgaaaggcacggggcccaaatgnttggggttgggtgccatggttacggagccattaaccgggntggttcttggaattgtgtgtcgaatattgttgccttccctacatttgtancgggattcatgtttacctccccangccgagcctcccctgctcagtccctagtgctcctttccttgncctccactcaatctt

SEQ ID NO: 51133 - protein, 186 aa, Zea mays
  misc_feature: Ceres CLONE 1465007-F
  misc_feature (74)..(74): Xaa is any aa, unknown, or other
  misc_feature (75)..(75): Xaa is any aa, unknown, or other
  misc_feature (102)..(102): Xaa is any aa, unknown, or other
  misc_feature (130)..(130): Xaa is any aa, unknown, or other
  misc_feature (143)..(143): Xaa is any aa, unknown, or other
  misc_feature (160)..(160): Xaa is any aa, unknown, or other
  misc_feature (168)..(168): Xaa is any aa, unknown, or other
  misc_feature (182)..(182): Xaa is any aa, unknown, or other
MAEEASAPAAGTEAPPGKMTMVVGVDESEHSFYALQWALQHFFPPGQPQQYRLVVVTAKSTAASAVGLAGSGAXXVLPYLEVDLKRSALRVVEKAKGLCSQXSDAVFEALEGDLRNFFCEAVERHGAQMXGVGCHGYGAINRXGSWNCVSNIVAFPTFVXGFMFTSPXRASPAQSLVLLSLXSTQS

SEQ ID NO: 51134 - DNA, 705 bp, Zea mays
  misc_feature: Ceres CLONE 1465010-F
  misc_feature: Encodes the peptide sequence at SEQ ID NO. 51135
  misc_feature (395)..(395): n is a, c, t, g, unknown, or other
  misc_feature (423)..(423): n is a, c, t, g, unknown, or other
  misc_feature (471)..(471): n is a, c, t, g, unknown, or other
ctggagctccccgcggtggcggccgctctagaactagtggatcccccgggctgcaggaattcgcacgagaccattacctagaacatcctaatcgaaaaagaaggcttctcctggagttcagtggctattccctactaactgctaactggcagcagcttctggatcgggccatcggggtcggtggatctcactgttttcttttcctgctgcttgctgcatttttcgcagggtgtgggagctgagttgggaggaggactgctgctgcagccatgaaggccctcattctcgtcggaggcttcggcacccgcctgcgcccgctcacgctcagcgtccccaagccgctcgtggatttcggcaacaagcccatgatcctgcaccagatcgaggctctgaangaaagttgtgttacagaagttgtcctgncccatcattaccagcctgaagtcatgctcaacttttctcaggacttcnagagcagcttggcatcaggatcacctgctcgcaggagaggagcccctcggaccgcaggccccctggccctggccccaaaaaattcccaaagaaccgggaaactttttttcgggtcaaaagaagggtttccggaaaaccccttccccaaaatcttggattccaagggccccccgggggggggcccccatatggggacaaagggcaaaaccccccaaaaaggggggtgtggaaaag

SEQ ID NO: 51135 - protein, 145 aa, Zea mays
  misc_feature: Ceres CLONE 1465010-F
  misc_feature: SWISSPROT Homolog: EC 2.7.7.13 Mannose-1-phosphate guanylyltransferase
  misc_feature (42)..(42): Xaa is any aa, unknown, or other
  misc_feature (52)..(52): Xaa is any aa, unknown, or other
  misc_feature (68)..(68): Xaa is any aa, unknown, or other
MKALILVGGFGTRLRPLTLSVPKPLVDFGNKPMILHQIEALXESCVTEVVLXHHYQPEVMLNFSQDFXSSLASGSPARRRGAPRTAGPLALAPKNSQRTGKLFFGSKEGFPENPFPKILDSKGPPGGGPHMGTKGKTPQKGGCGK

SEQ ID NO: 51136 - DNA, 671 bp, Zea mays
  misc_feature: Ceres CLONE 1465016-F
  misc_feature: Encodes the peptide sequence at SEQ ID NO. 51137
  misc_feature (671)..(671): n is a, c, t, g, unknown, or other
ggagctccccgcggtggcggccgctctagaactagtggatcccccgggctgcaggaattcgcacgagaccattacctagaacatcctaatcgaaaaacaaagaagctccataattaattattgccctttcagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgttcgcatcttcgtcgacaccgtcgcggaggcaccccacatcggctgagaatcaatctataaaatgaataactcggacatgtcatgcgtgcatgtccgtcgccgaataatggatgtgtgtgcttcgttccaataaattgctagtaaaaaaaatgccatcctcgggatgcatgaataaaaatgaacataatggtcatccctttccgattgggaaaaaagaaaatgggctcaattggttgggtcccaaaaaaaaaaaaaaaaaacctttatcaataccctccaaccccgagggggggccccggaccccaatttccccctataaggggagccgaaattaccccgcgccccccgn

SEQ ID NO: 51137 - protein, 70 aa, Zea mays; identical to SEQ ID NO: 49429
  misc_feature: Ceres CLONE 1465016-F
  misc_feature (11)..(70): Pfam Name: potato_inhibit Pfam Description: Potato inhibitor I family

SEQ ID NO: 51138 - DNA, 730 bp, Zea mays
  misc_feature: Ceres CLONE 1465019-F
  misc_feature: SWISSPROT Homolog: EC 2.4.1.12 Cellulose synthase (UDP-forming)
aaagctggagctccccgcggtggcggccgctctagaactagtggatcccccgggctgcaggaattcgcacgagaccattacctagaacatcctaatcgaaaatctggtccatcctcctggcttcgatcttctcgctgctttgggtccggatcgacccgttccttgcgaaggatgatggtcccctgttggaggagtgtggtctggattgcaactaggaggtcagcacgtggacttccccgtcagtgtgtggtcgaagaatatttttgcagatgttttgtgcccatatttcttttttcaatttttgtccctctgtagatagaaaccaggggagaagggggaaaaaaggacttggtatttcttttgttccatggtgggtggtggatggtgggcgggctcacccctcgtgaagtgcagttattgggccaaacccgaagggctgccggcaaccctttggtgcagttccggcctccaaatttttccttggggaaaaattcgggacccaatcccatccaattccgaattgaacccgagtcttccatttgtgtccaaagagaaataaaaaaaaaaaaaaaaaagtttttttcggtaatccgggtggggaagcccccccccctttttggcccgggggtaccccaattttcccccccctaaataggggggggccctattttcgcgggggggaacaaacacgacccccctcccttttttatccaaaggtgctggtgggtgg

SEQ ID NO: 51139 - DNA, 713 bp, Zea mays
  misc_feature: Ceres CLONE 1465021-F
  misc_feature: Encodes the peptide sequence at SEQ ID NO. 51140
  misc_feature (713)..(713): n is a, c, t, g, unknown, or other
cagctggagctccccgcggtggcggccgctctagaactagtggatcccccgggctgcaggaattcgcacgagaccattacctagaacatcctaatcgaaaaagctgcctaggtctgccgcctgtcttgaccccacccactggccacttcccctcctgtccgttcccaaatcccgtcccctccacccgcactccattggcgccgctcccctcccctcgccgacgccggagatctgatccgatccgatccgatccgtttgtgcttgtgctgcagcaggagtgagaagaaaaaaaatatggctgccctgccactggccaccgccgaaatatgctaccctaaccctcacctgatcatgaacggtgagctccgcacgctccagccaatcttccagatctacggacggcgccaggtcttcaccggccccatcgtcacgctcaaggtctacgaggacaacgtcctggtccgcgagttcctcgaggagaaaggccacgataaggtcctcgtggtcgacagcggcagcagcatgcgctgcgccatccttggaggcaaccccgtccagcaagcgcagaacaacgggagggctggtaacctggacaacggctgcatcaaggacgtggatgagatcaacggctgccacatcggggtccgagctctcaactcgcaccctatgaaggccaacaagatggggatgggcgagaagcacctccccacaan

SEQ ID NO: 51140 - protein, 139 aa, Zea mays
  misc_feature: Ceres CLONE 1465021-F
  misc_feature (11)..(139): Pfam Name: Methyltransf_6 Pfam Description: Demethylmenaquinone methyltransferase
MAALPLATAEICYPNPHLIMNGELRTLQPIFQIYGRRQVFTGPIVTLKVYEDNVLVREFLEEKGHDKVLVVDSGSSMRCAILGGNPVQQAQNNGRAGNLDNGCIKDVDEINGCHIGVRALNSHPMKANKMGMGEKHLPT

SEQ ID NO: 51141 - DNA, 748 bp, Zea mays
  misc_feature: Ceres CLONE 1465022-F
  misc_feature: Encodes the peptide sequence at SEQ ID NO. 51142
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
tcgttcccctttcctctctgctccttgtgcggcgcganttagtnnnncnncttaaaactggggctccacgcggtggcggccgctctagactagtggatcccccgggctgcaggaattcgcacgagaccattacctagaacatcctaatcgaaaatccctcgacacgcacgcagttctcttgcttcttcagtcgcatcgcatatgtaagcagcacaagcacagcagcagcagcagcagcagcaggcaagaagaatccaaagcggaagggtctctccccccatctctgttccaccaggtgcggcgggcggcgatgggggcgcggaggcggctgcaggcagacgcgccgccggggcatcgccacaggcagggcgcgccggcgccggactggagcgccgggtacctcaacgggtggctgtcgtagcagacgcccgtcttcggcctccgcctctgggtgctcatcagcatcgccgtgggcgccgccatcgtgctcgtgctcctcctcatcttcgtctgcctctcccgccgccgccgccgccgccgcctcgccgccaacccctagtaccccgccgacccctagctgctcaagaagcacctgcaggagaaggccatgcccacgcccacgcccaccaaggacaaccagaaaatcgtcccccccccacaggagcccgcggtgtagttcgccaaggccgggccgacagccgaaggcccctggccctggactcctccggcggcggccgcctccggagta

SEQ ID NO: 51142 - protein, 36 aa, Zea mays
  misc_feature: Ceres CLONE 1465022-F
MGARRRLQADAPPGHRHRQGAPAPDWSAGYLNGWLS

SEQ ID NO: 51143 - DNA, 736 bp, Zea mays
  misc_feature: Ceres CLONE 1465024-F
  misc_feature: Encodes the peptide sequence at SEQ ID NO. 51144
aaagctggagctccccgcggtggcggccgctctagaactagtggatcccccgggctgcaggaattcgcacgagaccattacctagaacatcctaatcgaaaaaaaaaacccaacggccgaagctaagctcgagccgccgccgcgatgatcctccgtatccgcagccgcgacggcacggaccgcatcacggtcccagactcggcctcagtcaccatcgccgacctgcagcgcctcatcgagtcgcacctcaccgtgcccgtcccgctccagcgcctctccctcgacccggccctcctactccctaacccctccgccgctgtcccactcctcaccgactcggcggcgccgcttgcctcgctccgcctcgccaacggcgccttcgtctacctcgcatacccgcccgacgcgcgctcggcccgcccgccgccgccccaggcacttttccgcccgctggctctttcggcaaaaaagatgaccatggatgaccctaacggcgcggcagattcggcgtcacccccccaggaagaacccgcttctggcccgcccccctcttttgaaccgcgaatgcccccaaaggggttccaagtttttcgtcgccgaatttcctccgggttcggggggaaaaggggggggggtttttctttaggggccgggtttaaaccaaaagcacaagggggggttcccccccaaattttatttattaaaccccccccccaacagggcttccaagagaaag

SEQ ID NO: 51144 - protein, 197 aa, Zea mays
  misc_feature: Ceres CLONE 1465024-F
MILRIRSRDGTDRITVPDSASVTIADLQRLIESHLTVPVPLQRLSLDPALLLPNPSAAVPLLTDSAAPLASLRLANGAFVYLAYPPDARSARPPPPQALFRPLALSAKKMTMDDPNGAADSASPPQEEPASGPPPSFEPRMPPKGFQVFRRRISSGFGGKRGGGFSLGAGFKPKAQGGVPPQILFIKPPPQQGFQEK

SEQ ID NO: 51145 - DNA, 715 bp, Zea mays
  misc_feature: Ceres CLONE 1465032-F
  misc_feature: Encodes the peptide sequence at SEQ ID NO. 51146
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
tggagctccccgcggtggcggccgctctagaactagtggatcccccgggctgcaggaattcgcacgagaccattacctagaacatcctaatcgaaaaacaacacaagagccttctcgctctgatctgagcaggaggaggaagaaagccaaaggccttccttgcgcttccagggcaaagaagatctgaggccgcggcggagcgtgacgacgacgaagtcggtcaggatgagccgcgaggataccctgaaagtgcagaccctcgagctcaaggtgaacatccactgcgacggctgccttaagaaagtcaagaaggtgcttcacaagatcgatggggtgtaccagagcacggttaatgcggcggaggaagggttgacgggtgtcnnnnnnnnnnnnnnnngnnnnnnnnnnnnnnnnnnnnnnnnnnnnnnnnngnnnnnnnnnnnnnnnnnnnnnnnnnnnnnnnnnnnnnnnnnnnnnngnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnn

SEQ ID NO: 51146 - protein, 52 aa, Zea mays
  misc_feature: Ceres CLONE 1465032-F
MSREDTLKVQTLELKVNIHCDGCLKKVKKVLHKIDGVYQSTVNAAEEGLTGV

SEQ ID NO: 51147 - DNA, 694 bp, Zea mays
  misc_feature: Ceres CLONE 1465033-F
  misc_feature: Encodes the peptide sequence at SEQ ID NO. 51148
  misc_feature (426)..(426): n is a, c, t, g, unknown, or other
ctggagctccccgcggtggcggccgctctagaactagtggatcccccgggctgcaggaattcgcacgagaccattacctagaacatcctaatcgaaaaaagcatactattagacataccggtatatattattgttcttagtcatcgcacaagactcttgtcaacaagaccaacaacaggatgaggactgccgtgcatgctgcgctttgcattgtgcttgtgataatgtcttcaacactgtcatcttgcgagaacgatgagaaggtatctatcgcatgtgacacaggatgcaatgccgcgatctcccgtctcaaatgcttcctgatggcctattctgaagggaaagtgttggtcagcagcaactgcgaaacgccgaccaggtgcggctgcgtgtttcgtcacaaacaagatgcaacccttatcgccnggcgacgttggcaaacaaaaagggatattgatggcaagacgtgtattttcttggttgaatatatatactgctagatttaatatgggccacaacaacgaatatctataatgttattcttcagtggaatgctttccccatgttctgttttaagataactaaatacctatcttcccccctttataaaaaaaaaaaaaaaaagcttatccatcccgtcaacccccagggggggcccgggccccaattcccccctaaagggggccctataacc

SEQ ID NO: 51148 - protein, 106 aa, Zea mays
  misc_feature: Ceres CLONE 1465033-F
  misc_feature (83)..(83): Xaa is any aa, unknown, or other
MRTAVHAALCIVLVIMSSTLSSCENDEKVSIACDTGCNAAISRLKCFLMAYSEGKVLVSSNCETPTRCGCVFRHKQDATLIAXRRWQTKRDIDGKTCIFLVEYIYC

SEQ ID NO: 51149 - DNA, 763 bp, Zea mays
  misc_feature: Ceres CLONE 1465035-F
  misc_feature: Translation starting site: 229
  misc_feature (22)..(22): n is a, c, t, g, unknown, or other
tgtgttttttgtttcctcctcnccgcgcccccccctccttccaagaacaaaaaaatactataaaattctattaaggaggaagccgctctctactagtggatcccccgggctgcaggaattcgcacgagaccattacctagaacatcctaatcgaaaagttgcccttctcttccccactcgcctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagacaaaggggtcgttcctcgacaagggcgaggtcgctgaccgtgtcgtctccgtcgtcaagaacttccagaaggttgaacttttaaaggtgacacctagtgctcattttcagaaggacctcgccacttgatagcttggacactgtggagatcgtgatggcgtttgaggaagaattttcctttgagattcctgacaacgatgcagagaagactgactccatcaagacagcggctgatttcattgcttcgtatcctcaagcaaaataagaggatttctttcttttttcctatctcaaagtgtgctttgcactttttgcatccagaactttatgagacacgggaatcgttcctatctaagcttgcctcattaaatatggaagtcaattttctttacctttttcaaacctcccacgcaac

SEQ ID NO: 51150 - DNA, 687 bp, Zea mays
  misc_feature: Ceres CLONE 1465037-F
  misc_feature: Encodes the peptide sequence at SEQ ID NO. 51151
ggagctccccgcggtggcggccgctctagaactagtggatcccccgggctgcaggaattcgcacgagaccattacctagaacatcctaatcgaaaagagaccagaggaggagacgtcacgcctgcgcggctgcgcccaccatggacgaggatgagtttcggcgcatgctcgacctcttcccggtcgtccgctcccgagactactgctgctccgatcttggaacatccagcagaggaaccagacagcgatcacgagttcaggaggcaactaagggcgataataaggactcgtccggtggacgagatatgtttatgcagaaattgaagatggctgcggagaataagattggagcgacaaaggcagagttcttctgcaagacattcaaagaagttcatgagaaacttgttcacagagagctgaatttggatgctgctaagaagttcctgagcgcatatgagagctgatgatgaacaataggtagatgctgcttaagggtcggtagttgccaatgatctggaaagttgttgatgctgttgagattttgatcccaggcaaacttttaaccacgggaaatgctgttgagcgcctactgataccccctgattggttcacccatcccccgtagccagctcgtatgcagcccggttggccagaaactgttatttgggcccaaaaagtggatccccc

SEQ ID NO: 51151 - protein, 107 aa, Zea mays
  misc_feature: Ceres CLONE 1465037-F
MDEDEFRRMLDLFPVVRSRDYCCSDLGTSSRGTRQRSRVQEATKGDNKDSSGGRDMFMQKLKMAAENKIGATKAEFFCKTFKEVHEKLVHRELNLDAAKKFLSAYES

SEQ ID NO: 51152 - DNA, 737 bp, Zea mays
  misc_feature: Ceres CLONE 1465038-F
  misc_feature (401)..(401): n is a, c, t, g, unknown, or other
  misc_feature (407)..(407): n is a, c, t, g, unknown, or other
aaagtggagctccccgcggtggcggccgctctagaactagtggatcccccgggctgcaggaattcgcacgagaccattacctaaaacatcctaatcgaaaatatatcacagcatcagaaattcagaatcgatccgatctccgcttgcgctgagctccatcaaattcaattgtcgtgcggtgcaggaccgcgaacacgaggaggccggggagcatcatccacaaccacaagccatggcggggaggactaacatccccactaacaactccgccctcatcgcaatcattgccgaagaggagagcgacactgggtttcttgatggcccggcgttggcaatgccgaaccccccccagaaaaacttattatttttttcgatgataagggggggggggggcccccccncccctnaccccccccccccccgttggcggctcccccaccacatctcctctcggcgccgcgccggtccgcccaccgcccgcccccccccgcgcccctcggtcctccgcttccccactccactcggtccttcctcactctcggcaccacccgcattttgatctctctctctgatcccagccccctcccgccccaggcttccccctccccccccctcacctctccctcatccaccgctccccgtaatggtggcggcgttcggctattccttccctcctccccccctcttgtacattgccggttgagcttggttttctccaccgggacatgccggcccct

SEQ ID NO: 51153 - DNA, 732 bp, Zea mays
  misc_feature: Ceres CLONE 1465039-F
  misc_feature: Encodes the peptide sequence at SEQ ID NO. 51154
aagctggagctcaccgcggtggcggccgctctagaactagtggatcccccgggctgcaggaattcgcacgagaccattacctagaacatcctaatcgaaaaatttttcgttctatcgaatcctgaaaaaaaaatgacgaggcagttctgaaacagagaagcattgattctgtccgtttgcagatcctccagatcttccacaggaaagtgtaccccgagagcgcggccctggcgcggaacctgaccaagaagagccgcaagcgcggcagcggtgcctaccacaagccggagccggcggcgtccaggctccggtgcctcaaggagcagcgcgcgccggggttcggctgctgcgccagccgggcctcgttcggcggtgccgcctctcccatcgacgaccacgaggaggacctccccggttgctagagcggccactggatcaagaccgaccctgaataccttgcggccggacctgtataatgacaaatcactggaaagacagagaaagagagatccggatcctgttggcttggccaccatccaccctttattggtgcgtattcttcggcataacgccccgcttatgtctccgttgccttgccccctcccagaacaaaaaaaacccccctgcatcctttatgctttcgttccctggtggactccccctgccccggttttaagccttgccccttcagtcccccccccatctaatctcggaataccaggggcgcaaaag

SEQ ID NO: 51154 - protein, 40 aa, Zea mays
  misc_feature: Ceres CLONE 1465039-F
AGAHRGGGRSRTSGSPGLQEFARDHYLEHPNRKIFRSIES

SEQ ID NO: 51155 - DNA, 705 bp, Zea mays
  misc_feature: Ceres CLONE 1465040-F
  misc_feature: Encodes the peptide sequence at SEQ ID NO. 51156
aaagctggagctcaccgcggtggcggccgctctagaactagtggatcccccgggctgcaggaattcgcacgagaccattacctagaacatcctaatcgaaaaatgctgctgcttagcagcgaaggaagcgggcaggaaggccgtgtggggtccacacctccccggacacccgcgcagccgccgcccacgcttggtccgtcgaccgccggccgatcgattgatggatgcatgcatccaccgtccacgtacgcggcgacgagacgtgttgcgtttgcgtgccaccggactagctagtagatcgctcgactggtatgtagctgtcgccatcccatcgccctccctctcgtccaaggtctgcctgcctataaagtgaaagtgaagccagggaagaggcaaagcgaaaggagagaaggaatccgatccatccaagccaagccaaggcagagaagaagaagaagaggaggaagaagaaccatcgggcagcatgtcggaggggactgccaactgcgtggacatcttgatcgccatcctcctgcctcccctgggggtggtcctcaagtacgggtgccgcgcccgagttctggatttggcctcctcctccccttccctcggatactcccccgggattatctaggccgttctacgcttttcctcaaagaacacgtagctagtgttcccttgtccaaacaacaaccctgtgctcct

SEQ ID NO: 51156 - protein, 49 aa, Zea mays
  misc_feature: Ceres CLONE 1465040-F
MSEGTANCVDILIAILLPPLGVVLKYGCRARVLDLASSSPSLGYSPGII

SEQ ID NO: 51157 - DNA, 744 bp, Zea mays
  misc_feature: Ceres CLONE 1465044-F
  misc_feature: Translation starting site: 398
ggagctccccgcggtggcggccgctctagaactagtggatcccccgggctgcaggaattcgcacgagaccattacctagaacatcctaatcgaaaaactagacgcgcagcctcgctccgtcgccgcaattcgacgattccaccgcttcgtccgtcggcatagcaatcatactcttttctcttcccctccctcccctcctcaccagtcacctcgacgagatctcccccacctcttccacttccaccccgcccgtcgtctctcgcgaagcacccctatcgtacgttttccgtagctcgacggggacggcgagccgctcctgctgctgccgccgccggaggaggaggaacaggattagcgggaggaggagcagggcaccggtcgcttggggctgtgccacatgccgctctgggggaccgccgcgtccgcgcagccggcagccgagggcgacgccgcccgcgcgccctcaaggtccggcggcggcggcgtcaaggtgatccggtcgctgctcccacccggggccgcctccgcctcgacccgcccgctaagctttattttccatatgaacccggtaagcaagtcgagagcgctgtcaggatcaagacatcagcaagtctcatgtggcttttcaggttccaaaccaccgcaccaaaaaattgctttatgaggcctcccggcggggtacttgctccggggaaaggatcatagcaacagttttccagtttgttaagcatccggaaaaaaaca

SEQ ID NO: 51158 - DNA, 778 bp, Zea mays
  misc_feature: Ceres CLONE 1465049-F
  misc_feature: Encodes the peptide sequence at SEQ ID NO. 51159
  misc_feature (315)..(315): n is a, c, t, g, unknown, or other
  misc_feature (413)..(413): n is a, c, t, g, unknown, or other
ggagctccccgcggtggcggccgctctagaactagtggatcccccgggctgcaggaattcgcacgagaccattacctagaacatcctaatcgaaaaatctccttccatttgtgcatatacaaaccctcttcaaaagccggcagaatcatacacccgcctccaccgcgcctgcccacgataacccagaggcctcgagaagggctggaagcaccgagagcgctccagagatgtcgtcggatgagttgcgattggagctggacgagctgcggcggctggagggcctcgccaagcgcccccgcgtccagaccctcctcngcaacgagatccgcaacattgaagctaagatggcgaaggcaactgaaccgtcaccggagccactagcggcgggcttccgcgcccacggggcggccccntcctaattgagctaccgcccggtggggctcgttcagctgggaaccggacacccagaaaatccggattttttttccccttgagggatccaaacaaggaaggggggaggctcctttccagcccacctccgaaaagttaaatttccgggagccaaggcgaaaaatttcgggggggccaaacaaaattaaaaaagaaaaagtttccaaaaaaaagaaggggggggggaaaaccacaagaggtgtttttccccttttctagggtttaaaagaggcaggtgttaaatttctcttttcgaagaaaaaatttcccccccccttgtgggaaaaaaaagaaccccctcccccaattatttccttctaaaaaaaat

SEQ ID NO: 51159 - protein, 63 aa, Zea mays
  misc_feature: Ceres CLONE 1465049-F
  misc_feature (30)..(30): Xaa is any aa, unknown, or other
MSSDELRLELDELRRLEGLAKRPRVQTLLXNEIRNIEAKMAKATEPSPEPLAAGFRAHGAAPS

SEQ ID NO: 51160 - DNA, 755 bp, Zea mays
  misc_feature: Ceres CLONE 1465051-F
  misc_feature: Encodes the peptide sequence at SEQ ID NO. 51161
  misc_feature (422)..(422): n is a, c, t, g, unknown, or other
aaagctggagctccccgcggtggcggccgctctagaactagtggatcccccgggctgcaggaattcgcacgagaccattacctagaacatcctaatcgaaaaatagcaaaaggcgaagccacggtaaccgccaccaccaaatcgctaccgccaatccgccatgatgctcccgacggccaccgcgacggccgtcttcctcaccgcggcgccttcctctttctccacccgccgtcggcgcagtcgcgccatcttcgcatccctttcgccgtccttctccgcctcgggtaaacccaattccctttcctttctcaccaccatttcgcttctaatctgaactacacgacgcgtgcccagaggagccgctgctggtgcgcgcggcgcggggcgaggacggcctcccacgcccgctctccccccaccangcggcaggcagggcggtacatggcggagtaccaggcgctggccaagcgccacccctcgttccgggagcgctccgagaacacggacctcatcgtcgagatcacgctgcagccgtggcgtgccttcccgcccgacggcgtcatcctgttctcggacatactcacgcccctgccggcatcggggggccgttcaatatctcggactccaaggggcccgtgaaccaatcgccagtacgtccccaagaatctggtgaggaaccctttccccttcgaacttgaaatgcctccagttcctcggggaatcactaaagattcttggaaaatgattttgctggg

SEQ ID NO: 51161 - protein, 65 aa, Zea mays
  misc_feature: Ceres CLONE 1465051-F
  misc_feature: SWISSPROT Homolog: EC 4.1.1.37 Uroporphyrinogen decarboxylase
MAEYQALAKRHPSFRERSENTDLIVEITLQPWRAFPPDGVILFSDILTPLPASGGRSISRTPRGP

SEQ ID NO: 51162 - DNA, 757 bp, Zea mays
  misc_feature: Ceres CLONE 1465052-F
  misc_feature: Encodes the peptide sequence at SEQ ID NO. 51163
  misc_feature (723)..(723): n is a, c, t, g, unknown, or other
tggagctccccgcggtggcggccgctctagaactagtggatcccccgggctgcaggaattcgcacgagaccattacctagaacatcctaatcgaaaaattaaaaaagggattatcttcattttgtagctttgaatcgcctctcagaaccgagatcctcaaaacccttctcccccctcccggatcgagtgcttgagctccgaccaaatctcgcagcggctgcaattccgagcccgaagagcggatcaggcgaggacgacgccttcgattctgatctgcggtcggcgcgacctagagagaaccggagatgcagcagggcgacggcacggaggcgcaggtgacgtgggaggaccagcagaacatcaaccgcttcggtcgcctcaacaaccgcctccacgagctccaggacgagatcaagctcgcgaaggagacgaatgagaaccttgatgatgctgggaatgaactcatcttgtcggatgaagacgttgtacgcttccaaattggggaagtgtttgctcacatgccaagggatgacgtcgagactaggctggagcagatgaaagaggatgcggctaagaagctggagaggttagaggaggaaaaggaatccatcctggcccagatggccgagctgaagaagatactgtacgggaagttcaaggatgccatcaacctggaggaagattagcagtactggagtcgtggcgatttaaccctctttctangtcaggtgctgttttttcccttgctctccggctc

SEQ ID NO: 51163 - protein, 126 aa, Zea mays
  misc_feature: Ceres CLONE 1465052-F
  misc_feature (16)..(120): Pfam Name: Prefoldin_2 Pfam Description: Prefoldin subunit
MQQGDGTEAQVTWEDQQNINRFGRLNNRLHELQDEIKLAKETNENLDDAGNELILSDEDVVRFQIGEVFAHMPRDDVETRLEQMKEDAAKKLERLEEEKESILAQMAELKKILYGKFKDAINLEED

SEQ ID NO: 51164 - DNA, 794 bp, Zea mays
  misc_feature: Ceres CLONE 1465053-F
  misc_feature: Encodes the peptide sequence at SEQ ID NO. 51165
ggagctccccgcggtggcggccgctctagaactagtggatcccccgggctgcaggaattcgcacgagaccattacctagaacatcctaatcgaaaaatttcacttatactaatcaggtcaaatacttgaggcctctcagttctatgaaaaagttgcagggctgtggatgccagagcgtttgcttgcctggcgacgccagttgtgcttgtggacaacataatggaggcgatttacccttcagttcatcaggattgttgtcatgccgcaaaccaatagtctacgaatgtggtgaatcttgcaactgttctacaaattgcaggaacagagtgacccaaaaagggtccaggctacatttcgaggtcttcaggaccacaaatcgaggctggggtcttcgctggctgggacccacccctcttggttcatttaatattgagttggctggtgagggcattgatgagccccaattttattttgaatgaaaagggaaaaagattcctttttttaaaccggttgcccctgggggaaaaacttttaaagggattttggccccccaacctgatgggggaaaaaaccccctttttttccccgcgaaaaatttacaacccccccctgccaaaaaaaggggaaaaaaaagggggatattccccccttttttaaaaacaaatgcgcccccccagtttttttgtgcgccccctcttttttgtggggaggggagcggcgcccctcttattttttttttggaggaaaaattcccccccccgagaaaaaatatataaatggtgggggggggaaaa

SEQ ID NO: 51165 - protein, 111 aa, Zea mays
  misc_feature: Ceres CLONE 1465053-F
  misc_feature: SWISSPROT Homolog: EC 2.1.1.43 Histone-lysine N-methyltransferase
MKKLQGCGCQSVCLPGDASCACGQHNGGDLPFSSSGLLSCRKPIVYECGESCNCSTNCRNRVTQKGSRLHFEVFRTTNRGWGLRWLGPTPLGSFNIELAGEGIDEPQFYFE

SEQ ID NO: 51166 - DNA, 801 bp, Zea mays
  misc_feature: Ceres CLONE 1465054-F
  misc_feature: Translation starting site: 169
aagctggagctccccgcggtggcggccgctctagaactagtggatcccccgggctgcaggaattcgcacgagaccattacctagaacatcctaatcgaaaaatctacgttctactcccactcgcggtcgcggtagccggcggcggcggcggaggaaagcaggcaggccatggcgtcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtccctcaggagctggagctgctcagcgatggggccaacgtgtacaagttcatcgaaccggtgctgggtcagcaggacctcgcgaaggccacccccaaccccagaagcgcatcgagtacatctccgccgaactgaaacggattgatcgggcgctccaagacttggaggaaaagcaaaccgccaggaaggatccttttttcagtttccaccgaagaagccgggttttccagatttagggttaaacaactgtttttttggtttcaatttgcccagggcctggtttttttcctcccaattcccctccgggttttttttttggggggagggaaatcggggtttttagtttctcctcctcccaccccacaaaaaaaaaaaaaaaccgcccctatgaaaaatatagagtgtttttttgggtcgcccaaaaaaaaagaggggccccttttaaatatcgtggaaaaagtgttttttttctttttt

SEQ ID NO: 51167 - DNA, 764 bp, Zea mays
  misc_feature: Ceres CLONE 1465055-F
  misc_feature: Encodes the peptide sequence at SEQ ID NO. 51168
ggagctccccgcggtggcggccgctctattatagtggatcccccgggctgcaggaattcgcacgagaccattacctagaacatcctaatcgaaaactagctagcgccgccgccgctgcagactcctccttttcgatcccttcacaaagcgccgccgtcgccccatcgaacatggctccgaagaaggataaggccccgcccccgtcgtcgaagcccgccaagtccggcggtggcaagcagaagaagaagaagtggagcaagggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggatttctaccccccacctgatggcgcggggcctcatccggttggtctcggttcactcaagccagcagatctacaccagggcaacaaatacctaaggatgggattcccttgtttgccctctctgtaggagctcgtcttctttagaacagttgccatctctgtcaagagtttgctaatgctatgttagatgagtttctcacgtggctgaaacgtttcagagagtttgcgttagtttgggcttgcctattatacccttatctggccttaagctttttctatggaaatcttgcttgaaaatgtctgatccggggattatgcaacctttattctaacctaactgttattgcttgcaaaaaaaaaaa

SEQ ID NO: 51168 - protein, 108 aa, Zea mays
  misc_feature: Ceres CLONE 1465055-F
  misc_feature (1)..(106): Pfam Name: Ribosomal_S25 Pfam Description: S25 ribosomal protein
MAPKKDKAPPPSSKPAKSGGGKQKKKKWSKGKLKEKVNNAVLFDQATYDKLLSEVPKYKQITPSILSERLRINGSLARISTPHLMARGLIRLVSVHSSQQIYTRATNT

SEQ ID NO: 51169 - DNA, 852 bp, Zea mays
  misc_feature: Ceres CLONE 1465058-F
  misc_feature: Encodes the peptide sequence at SEQ ID NO. 51170
  misc_feature (234)..(234): n is a, c, t, g, unknown, or other
  misc_feature (240)..(240): n is a, c, t, g, unknown, or other
  misc_feature (268)..(268): n is a, c, t, g, unknown, or other
  misc_feature (397)..(397): n is a, c, t, g, unknown, or other
  misc_feature (400)..(400): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (852)..(852): n is a, c, t, g, unknown, or other
aagctggagctccccgcggtggcggccgctctagaactagtggatcccccgggctgcaggaattcgcacgagaccattaactagaacatcctaatcgaaaaaattaccccgactgcccgagctcgccggctcgctgccactaaccagccaagagtaatccagcgcccaccggatggccgcgcgcgcacctctcatcatgccgcgcgccgcctccagcgccggcccggtcccggntgcggngacgaccgtggccaggcaccagtccccncagggtctccacgcgaggggggcctgtcgcgggcctcctcttccaccagaggattgtgcggccgggccaccacctcctccctggcgcaatttttttaccctttgccacccagacaagaaggggggccanctnaannnntctnnncccccccccctgggggaaaaaaaaaaaaaagaatttttaagcgccaagggggggcccatcccttaacctcgtacagccatatgcagggccctcgctcggctataccccagcgatcctcccgcagctcgcctcctccaaaaaaatcttcataccttcttctggttcccaaccgcgcccacccttgccgtctccctccaactcctctctctactctctcacggcccccctcgttcctttatctccccgcacccccttcctcacggtggcacccgcacgcctcgcggagatagctcgcgcgcgctctcactctcacgctgggcgagagaaacaccgtgtgtgcgcgatcccgtctgcgccgatcccgattccgctaccgcgagcactcctgcatatagtggctctccggtcccatacctcgccgatggcgggtggccctcacn

SEQ ID NO: 51170 - protein, 101 aa, Zea mays
  misc_feature: Ceres CLONE 1465058-F
  misc_feature (21)..(21): Xaa is any aa, unknown, or other
  misc_feature (23)..(23): Xaa is any aa, unknown, or other
  misc_feature (75)..(75): Xaa is any aa, unknown, or other
  misc_feature (77)..(77): Xaa is any aa, unknown, or other
  misc_feature (78)..(78): Xaa is any aa, unknown, or other
  misc_feature (80)..(80): Xaa is any aa, unknown, or other
MAARAPLIMPRAASSAGPVPXAXTTVARHQSPQGLHARGACRGPPLPPEDCAAGPPPPPWRNFFTLCHPDKKGGXLXXSXPPPLGEKKKKEFLSAKGGPIP

SEQ ID NO: 51171 - DNA, 775 bp, Zea mays
  misc_feature: Ceres CLONE 1465059-F
  misc_feature: Encodes the peptide sequence at SEQ ID NO. 51172
  misc_feature (414)..(414): n is a, c, t, g, unknown, or other
  misc_feature (438)..(438): n is a, c, t, g, unknown, or other
  misc_feature (439)..(439): n is a, c, t, g, unknown, or other
  misc_feature (502)..(502): n is a, c, t, g, unknown, or other
ctggagctccccgcggtggcggccgctctagaactagtggatcccccgggctgcaggaattcgcacgagaccattacctagaacatcctaatcgaaaaagaacagaaccgaaacctcagacactctacatatatcctctgcgcgtgtatctcgtcgtacagagccgaaagctggagcttccaatggcgggagacaacgacctgaaggtgctcggcgtgtggacgagcccgttcgtgatccgggtccgcatcgtgctcaacctgaagggcctggcgtacgagtacgtggaggaggacctcagcaacaagagcgcgctcctcctggggtccaacccggtgcacaagagcgtgccggtgctcctccacgccgggcgcgccataaacgagtcccaggtcatcctgcagtacatccacnaaagtgtgggcggggacggggccnngacgtgctgccggacgacccctacgagcgcgcggtggcccggttctggggcgcgtcatcaacnaacaggtgaatccgcgtggctggggatccttttcaggtgacaaacaaaaaagaaaggccgccgccggggcccccccccccaaagccctcaacccctggaagggccgttcccggaactgtccgggggaaggcgtttttttggggggaaaaaaattgggtttgggaacccctttttcggggggacaccccggtgtgtttgggcccccccggggaattcttcgggagagggtttttcacccccgccggaaaactcttttgtgccccgggggaaaac

SEQ ID NO: 51172 - protein, 119 aa, Zea mays
  misc_feature: Ceres CLONE 1465059-F
  misc_feature (5)..(78): Pfam Name: GST_N Pfam Description: Glutathione S-transferase, N-terminal domain
  misc_feature: SWISSPROT Homolog: EC 2.5.1.18 Glutathione transferase
  misc_feature (78)..(78): Xaa is any aa, unknown, or other
  misc_feature (86)..(86): Xaa is any aa, unknown, or other
  misc_feature (107)..(107): Xaa is any aa, unknown, or other
MAGDNDLKVLGVWTSPFVIRVRIVLNLKGLAYEYVEEDLSNKSALLLGSNPVHKSVPVLLHAGRAINESQVILQYIHXSVGGDGAXTCCRTTPTSARWPGSGARHQXTGESAWLGILFR

SEQ ID NO: 51173 - DNA, 924 bp, Zea mays
  misc_feature: Ceres CLONE 1465062-F
  misc_feature: Encodes the peptide sequence at SEQ ID NO. 51174
  misc_feature (1)..(1): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (417)..(417): n is a, c, t, g, unknown, or other
  misc_feature (924)..(924): n is a, c, t, g, unknown, or other
ncccccgactccccctccnnnnntaaaaaaatcaccccccccccaaaactggagctccccgcgggggcggccgctcttttaccagtggatcccccgggctgcaggatttcccacgagaccattacctagaacatcctaatcgaaaaatcgaaaacgccgccgcctcctctgatgctttccgccgtgcgatgtgatgaccttcgtcggtggcacccgccgccgcacctcctcccacgcatcctttcctcctcctttggtacatctcccgcgcgaccacaggtgggggcgctgctggagctcccggaagtggagaaggaactgctcgacctacaatcggacgacgtgcacgaattccccgtgggcaagagcggtctgcacggtgggggctgcgacgactacatggacggtagaaaaaanaaaattcccattggtacgacccccccaccgggcagggtccttgtgtttcaccatcaaccaaatctccaccccgcctcctcaaaaaaaaattgaatgcctaactcgtatcaaagccactcacagcagggaaaaacgcgctcggccatctgattttttcgcaacgcctacgccccccccgcgcacattaaaatagatatgggtgtaagcaagaattattctgggaatttcaccacgagcgactctggggttcaagcaagaagtgaggtcccgctaactcttttccactctctaagatctatcggcaatacccgcgcccgggtggaaagtagatgctttgtactctgaacccccatgccacaggatgacaccccggcataaatgtactccttaaggtaaggtgagatccttgtgaacgcatggattccctcggaactctggaaaaaattttacaccggggaacgcgcgtagacctattaacccgcctttcaccttttttcggggggggtn

SEQ ID NO: 51174 - protein, 112 aa, Zea mays
  misc_feature: Ceres CLONE 1465062-F
  misc_feature (82)..(82): Xaa is any aa, unknown, or other
MLSAVRCDDLRRWHPPPHLLPRILSSSFGTSPARPQVGALLELPEVEKELLDLQSDDVHEFPVGKSGLHGGGCDDYMDGRKXKIPIGTTPPPGRVLVFHHQPNLHPASSKKN

SEQ ID NO: 51175 - DNA, 756 bp, Zea mays
  misc_feature: Ceres CLONE 1465066-F
  misc_feature: Encodes the peptide sequence at SEQ ID NO. 51176
  misc_feature (43)..(43): n is a, c, t, g, unknown, or other
  misc_feature (342)..(342): n is a, c, t, g, unknown, or other
  misc_feature (374)..(374): n is a, c, t, g, unknown, or other
  misc_feature (383)..(383): n is a, c, t, g, unknown, or other
ggatcccccgggctgcaggaattcgcacgagaccattacctanaacatcctaatcgaaaactgctccccgcggcgtgccccagatcacggttaccttcgacatcgatgccaacggcatcctcaacgtctctgccgaggacaagaccaccggccagaagaacaagatcacgatcaccaacgacaagggccggcttagcaaggaggagatcgagaagatggtgcaggaggctgacaagtacaaggcagaggacgaggaggtcaagaagaaggtggacgccaagaacgcgctcgagaattatgcctacaacatgaggaacaccatcaaggatgatttggttggcnccaagctccccgctgaggacaagaagaagatnttttgactntcctcacggcgccatcagctggctggaccgcaaccacctggctgacgtggaggagttcgaatacaagatgaaggagcttgaggggatctgcaaccccatcatcgcgaagatgtaccaaggtgagggcccgcgcatgggcgctgcctgccggcatggatgaagatcgccccttctggctgggaaccgcggcttgctcccaagacccgacgagcgagcatttagctctggtaagacttccgagcgcttggtctcggtcgcaggtgtgaaagtgcccctgaaactccggaagggatggcttgttggaggtctggggtcgcccaatagctcgcgtaaccttgagggccggagctttcgctgcagaaatatgatttta

SEQ ID NO: 51176 - protein, 54 aa, Zea mays
  misc_feature: Ceres CLONE 1465066-F
  misc_feature (43)..(43): Xaa is any aa, unknown, or other
  misc_feature (53)..(53): Xaa is any aa, unknown, or other
MVQEADKYKAEDEEVKKKVDAKNALENYAYNMRNTIKDDLVGXKLPAEDKKKXF

SEQ ID NO: 51177 - DNA, 768 bp, Zea mays
  misc_feature: Ceres CLONE 1465068-F
  misc_feature: Encodes the peptide sequence at SEQ ID NO. 51178
  misc_feature (373)..(373): n is a, c, t, g, unknown, or other
  misc_feature (670)..(670): n is a, c, t, g, unknown, or other
aagctggagctccccgcggtggcggccgctctagaactagtggatcccccgggctgcaggaattcgcacgagaccattacctagaacatcctaatcgaaaaaaccaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttggcnccaaggttcatgttgttttgttttggtggtcgagcatcgcacgttctgcttctggttccagatctggagaaatttctaagtcgtcgtcgtcgtcgtcgttcggttcggagcggatctgaggcgacgatggctggaggcggcgggatctcttggtctgcagccctgcttcacctcgatggatgatgtctctgcgctgataattattggaccaatttccataattattagtagatccttgagaaatgcccccctgaaaaaagccaggtaagcctgcagaatggtaaaagtttgttggcnccccacgcaaaaaaaaaaaaaaaaaaaccttaccgataccctccaaccccaggggggggccccgggaacccaattcgccctaaaagggggtgggaatt

SEQ ID NO: 51178 - protein, 57 aa, Zea mays
  misc_feature: Ceres CLONE 1465068-F
MLFCFGGRASHVLLLVPDLEKFLSRRRRRRSVRSGSEATMAGGGGISWSAALLHLDG

SEQ ID NO: 51179 - DNA, 705 bp, Zea mays
  misc_feature: Ceres CLONE 1465070-F
ggagctccccgcggtggcggccgctctagaactagtggatcccccgggctgcaggaattcgcacgagaccattacctagaacatcctaatcgaaaatagagagtgtatgttgcattagaaagtctgcaaatctctgtatgttcttgcatggcactgaagctgcatgcttcagtttcttcacatgaggctgcttttgagcaccttatgtgccggaaagttccagaggtagaatatatactcaagggacagcatcaaagaagtcaactgttaagttttctttttgggttgggagaagattcattttgggatgaaaataattcctttgcagagtttacatacaatttggactggaaaatttagcagtctaaccagatacatctggatagatactgtaaaagagatacagttggatcaatggacattcttttttttagatttaggaaatgcaaattgtgagctcaactgtgcagggccagtggtgttggattcttttagtaatatcttgttttataccggcgaagaaggctctgcctccctcgtataagtagctcctttgtgcttattcgtacactatgaattcagttggatttcatacactatggcatccttcttttcagaggaaaatgcatgtaggtagatccagatctggtcggcaggttttcatgtgtttcgtttttcatgtgccgtctgcaatgcatgcgtgct

SEQ ID NO: 51180 - DNA, 813 bp, Zea mays
  misc_feature: Ceres CLONE 1465071-F
  misc_feature (422)..(422): n is a, c, t, g, unknown, or other
  misc_feature (427)..(427): n is a, c, t, g, unknown, or other
  misc_feature (428)..(428): n is a, c, t, g, unknown, or other
  misc_feature (456)..(456): n is a, c, t, g, unknown, or other
ggagctccccgcggtggcggccgctctagaactagtggatcccccgggctgcaggaattcgcacgagaccattacctagaacatcctaatcgaaaaagagcgccactcgactcatcctttcggttcccctcccccctccgcgttccacaaccctcgagaagcttccaccctcccctcctgcgacgccgccagagccgcggaaaccctacccaccccggccgctcacgcaccgggcgcccgcagccgccggtcgcgtgcctgccgccgacaccgcccaaagcgattggatctcgagatcgtcgaagccacgatggaggactgggattctgaagaatccagccagttgtgcctggtgtgaaagccgagccacttaaaatcagtgggctgatgaagatgttgaagaagatgatgtaaaagaatcntgggnnagaggaggaggaggaggagaaacctagnccagcggcaggtgaaaaaggtcccttgcaaaaacttaacacttaagggtcctggctaaaagggggaaaacaacaggccttggcaaggggctgagaaaacccaaaaaaccctcccctttaacccccccttcacaagaaaatcccccaaacaaaactttgggggaaaaagtttaattttttgcgcccccccgggttttttttgaaggaagggggggggagaaaaaccccctaatttttttttttccacacccccaaggggttttttggggaaaaccccggttttttttaaaaacaacccccccctcagagaaaaatcctccccccggggcccctaaaaaaaggggggtacctttcccca

SEQ ID NO: 51181 - DNA, 758 bp, Zea mays
  misc_feature: Ceres CLONE 1465072-F
  misc_feature: Encodes the peptide sequence at SEQ ID NO. 51182
tggagctccaccgcggtggcggccgctctagaactagtggatcccccgggctgcaggaattcgcacgagaccattagctagaacatcctaatcgaaaaaccactcatcaccagctagctctagcaaagcacttgccatctaccgaccgccgcattccaaacagcccgacgagctagcagagcggcaggcacctccctcctcaaggaacatggcccgcatgcagaagttggcagtggcgacggcggccgtggtggccttggtgctgctggcggcggcggcgacctcggaggcggccatcagctgcgggcaggtggcgtcggccatcgcgccctgcatctcctacgcgcgcggccagggctcggggccctccgctggctgctgcagcggcgtcaagagcctcaacaacgccgcccgcaccaccgccgaccgccgcgccgcctgcaactgcctcaagaacgccgccgccggcgtcagcggcctcaacgccggcaacgccgccagcatcccctccaagtgcggcgtcagcatcccctacaccatcagcacctccaccgactgctccagggtgaactgaaccctaaacgacgacgacggcgccggcggccgcctgaagacgatccatatctatcccgccgtcgtcggcgcccgcggatcggaccgtcatgaccatatctacctacgcatgatcacaacttgcatgtctaccactacctactgaataaaaaacctctccccggacgtcggccttggggttgggg

SEQ ID NO: 51182 - protein, 121 aa, Zea mays
  misc_feature: Ceres CLONE 1465072-F
  misc_feature (32)..(117): Pfam Name: Tryp_alpha_amyl Pfam Description: Protease inhibitor/seed storage/LTP family
MARMQKLAVATAAVVALVLLAAAATSEAAISCGQVASAIAPCISYARGQGSGPSAGCCSGVKSLNNAARTTADRRAACNCLKNAAAGVSGLNAGNAASIPSKCGVSIPYTISTSTDCSRVN

SEQ ID NO: 51183 - DNA, 765 bp, Zea mays
  misc_feature: Ceres CLONE 1465076-F
  misc_feature (407)..(407): n is a, c, t, g, unknown, or other
  misc_feature (440)..(440): n is a, c, t, g, unknown, or other
  misc_feature (480)..(480): n is a, c, t, g, unknown, or other
  misc_feature (481)..(481): n is a, c, t, g, unknown, or other
ggagctccccgcggtggcggccgctctagaactagtggatcccccgggctgcaggaattcgcacgagaccattacctagaacatcctaatcgaaaatagagagtgtatgttgcattagaaagtctgcaaatctctgtatgttcttgcatggcactgaagctgcatgcttcagtttcttcacatgaggctgcttttgagcaccttatgtgccggaaagttccagaggtagaatatatactcaagggacagcatcaaagaagtcaactgttaagttttctttttgggttgggagaagattcattttgggatgaaaataattcctttgcagagtttacatacaatttggactggaaaatttagcagtctaaccagatacatctggatagatactgtaaaagagatacagntggatcaatggacattcttttttttagaattangaaaatgcaattgtgagctcaactgtgcaaggccaggggnngtgggaatccttttagaaaaatcttggttttaaccgggcaaaaaaagctcctgcctcccccgaaaaaaaagcccccttggggcttattccaaacccaagaattcccttgggatttccaaaaccataggcccccctctttttcaaaaaaaatcgctgggggggaaatcccaattggggcccggaggtttccaaggggtccccttttccaaggcccccccgcaaaaaaaaggccgccttccacaaaatcaccaaaaaattaaaccgggagaagaaaaaaaaaaccc

SEQ ID NO: 51184 - DNA, 881 bp, Zea mays
  misc_feature: Ceres CLONE 1465079-F
  misc_feature (14)..(14): n is a, c, t, g, unknown, or other
  misc_feature (21)..(21): n is a, c, t, g, unknown, or other
  misc_feature (25)..(25): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (419)..(419): n is a, c, t, g, unknown, or other
  misc_feature (420)..(420): n is a, c, t, g, unknown, or other
  misc_feature (473)..(473): n is a, c, t, g, unknown, or other
  misc_feature (474)..(474): n is a, c, t, g, unknown, or other
  misc_feature (881)..(881): n is a, c, t, g, unknown, or other
accgggtacacaancaagaanaacncccccccnnnnnnaaaaacagaactccccccggtggcggccgctctattatctagtggatcccccgggctgcaggaattcgcacgagaccattacctagaacatcctaatcgaaaaggcgaaattcgcaatattcttttcctcagaaaccaaaatttcgagtttttttaaatacactataaccgagagcctgaaaatgggaacaaactaccgactgaagcgtaccaacaaaaaacgcccgattcgcctcgcaaaatcgccgccgccatcgcctactccaacagacgccgatagttccgccttcctttcctgctgcacgcctgtcgccatggagaagcgatggcttcccctcgaggccaaccccgacggcatgaagcaggtcttggggttttttnnattaacacgaggaaaaaaatttttgtgaagaacccccctgtcccccccacaanncaagacaaggtgccccagccgggggtcggggccccaacccctcaacccaaagaaacagaacaaggagtcccaagcttcctcctagctcgtcggggggagacgtagggggcgaggcaggaatggagttttacccaatgaatagcagttgggaatggctcggggcaacagtttggggtcaatgacctgtgttgtgggcatgggtcaagtccacgattccaagtctgggggggaggggttcctaaatattggatcaatttttgggaatggaccgtccctgtggcttgggtgtaggctttcgctgtggggtgggtgctttttttcttggggcgaggaatcagaagctagaatgggagaagtggaccttaatacccactctttctatacgataactggtgtgtggagcggcn

SEQ ID NO: 51185 - DNA, 752 bp, Zea mays
  misc_feature: Ceres CLONE 1465089-F
  misc_feature: Translation starting site: 209
  misc_feature (619)..(619): n is a, c, t, g, unknown, or other
ggagctccccgcggtggcggccgctctagaactagtggatcccccgggctgcaggaattcgcacgagaccattatctagaacatcctaatcgaaaacccacaatctcacagccctcgaaggcaccacccgcgccgccgccaccgctccgaaattacagccatcgtagtgcggcggctaggtcggccggcgtttggaggagctccgaagatgtggtgccagtcgtgcaaggaagggtacgacgaggaggacgccgggacctgcaaggagtgctacgaggaggccagcgagacggaggaggagctcaagcgggagatcgacgacctccgctcccgcctcctcttcctccgcctcccctcccctaccctcgacgccgcatccgcccccaactgcgacctcctcctccacgccatcccctccaccggcgcgggaggcgaacgcgatgctgggcgcacccccgacacaccccccgtgcccgcccatcgcgtcatccttaagcccttctagacgaacagatggcatctgacctcttggtgttggctgagaagtacgaagtaaagcacctgaaggcatactgtgagaagttcatagcatccaaagtgaatgacgacaatgctattnaccactacgccttcgcgcaccgtcacagcgcaaagcagctgctggaggcctcgctttctgtgctcatggccacatgtctacgctatcggatcgtgaagatacaaggagcttgtggagaaggaccaaaggcttt

SEQ ID NO: 51186 - DNA, 739 bp, Zea mays
  misc_feature: Ceres CLONE 1465091-F
  misc_feature: Translation starting site: 143
  misc_feature (602)..(602): n is a, c, t, g, unknown, or other
ggagctccccgcggtggcggccgctctagaactagtggatcccccgggctgcaggaattcgcacgagaccattacctagaacatcctaatcgaaaaatgtcatcatgtgtagttccgtggaaacatatcgcctgtgactgagatggatgttacattgcagggtgaggtgattcgcatccaaggagacgagttctggcacatgacacgggttttgcgccttggcgttaacgacaaggttgaactattcaatggggcgggtggtttagctgaaggattcatacataaagttgacaaaggtggctcagatgttgagttattagaggatgctaggatcatagctcctcaaggcatccaatggcatgtctttgctgcgtttgggacactgaaaggcggacgtgcggattggcttatagagaaatgaacttggagcttctagtgttacccctctcctgacagaacgatgtcacacaatagcagaaaatcgggtgggacagggctgcacgccttgtgctggctgcagtttaaacatgccagaggatacatgaaatgtcgctgaaatccccaattcagataaagcaccttctacctgttgtatcacagtncaagcttgcttttctagcatcagcggaagcgcctcctcttttaggtgtcttgcagaatcagcattgacaaagtgggcttctgattattggcctgaagggacttcccgcagaggggtacattccctgaatcagcagtg

SEQ ID NO: 51187 - DNA, 738 bp, Zea mays
  misc_feature: Ceres CLONE 1465096-F
  misc_feature: Translation starting site: 162
tggagctccccgcggtggcggccgctctagaactagtggatcccccgggctgcaggaattcgcacgagaccattacctagaacatcctaatcgaaaaagctggagggcaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtaaaacgcgcgcgcgtgcgcctgtgctgcctgatccggatgcgcgcctaattaatctgccgcatatgcgcgcctttctgggttttactttgcaggtgggcggagctggagagcggggcgacgaccatcgcgttcacgccgctgcaccagcgggagacggacgagctgtcgggggcggtgcagctgccggactcgtcggccgccggccggggctccgtggaggtctgcttcgcctacgcggacgtcgacgccgcgtacaagcgcgccgtggacaacggggcggtggccgtgagcgcgccggaggacaagccctggggccagaagtccggcttcgtgcgggacatggacggcaacatcgtgcgcatcgcgagctacgtgcgagagtagtcgcattccgctgcatcaccatcgatcaatcgatcagcctttcccatgcatgtctcgtatac

SEQ ID NO: 51188 - DNA, 793 bp, Zea mays
  misc_feature: Ceres CLONE 1465106-F
  misc_feature: Encodes the peptide sequence at SEQ ID NO. 51189
  misc_feature (307)..(307): n is a, c, t, g, unknown, or other
ggagctccccgcggtggcggccgctctagaactagtggatcccccgggctgcaggaattcgcacgagaccattacctagaacatcctaatcgaaaaaaacccttcgaaaacccttctcccgtcctgctcactcccgtctccgagcgccgccgccgccagcgccgatacgcgataaacaagaggaagaagaggccaaccgatccagcagcgatggcgggcgggggcatgctggggggcgctttctgggcgacgcgggcgctggaggtggtcaagcgaacgattcccccggcctattgtggagcgcatncagctcaccacacccgcaagaccaacgccaagaagcgcctcggcgggtcttggcaaaatgaagcggtttaaaaagctggggggggatcaaggttggacccggcttcccagggtgaaaaaaaaaggtagtcttggaacccaattgggacagggccctggggccccccctgggttgtaaaggtaaaacccttattttttcccccccccccccccaaagggtttaattttccgccccccaaaaaaaaaaattttccccccccaaaaaaaacaatttttttttgggacccccccccccccccctttttttttaaaaaggggggtggtgtgaaaaaaagttgggaaaaaaggcggggcccccaagggggggagaggcgcccccgcgccttcccccaggggggggggggggagaaaaaaaaaagggggggggggggggggggaaaataaaaaccccctttttttttttgttgtggggtggaaaaaaaaatcc

SEQ ID NO: 51189 - protein, 55 aa, Zea mays
  misc_feature: Ceres CLONE 1465106-F
  misc_feature (33)..(33): Xaa is any aa, unknown, or other
MAGGGMLGGAFWATRALEVVKRTIPPAYCGAHXAHHTRKTNAKKRLGGSWQNEAV

SEQ ID NO: 51190 - DNA, 768 bp, Zea mays
  misc_feature: Ceres CLONE 1465108-F
  misc_feature: Encodes the peptide sequence at SEQ ID NO. 51191
  misc_feature (753)..(753): n is a, c, t, g, unknown, or other
gcggtggcggccgctctattactagtggatcccccgggctgcaggaattcccacaagaccgttacctagaacatcctaatcaaaaaaaatatcctcacctgagttccctccgtcgcctgacgaactctcccgcgatgccaccaccacacgttcggggtagctgagagcttctcgacgtcggcgggtaacatggtgtgcgttgaagctgcacaagctgctctgcgtgagcgacctcacgtgtggaaaaggcaaacccgggcttgaccccgatgaagtcagcgagatctccatggctaagtcccgccagaacatccgcaagttggttaacgatgggtttatcataaggaagcctcatagagcacactctaggtcccgtgccatacggggacatgagggccaacacaaaggaaggccctctgatatatggcaagcgcagggggaccagggagaggtaggttccccaccaccattctgaggatgaggaggatgtgtgttatgaagcgcctgctcggccctaccgctgagccaagaaaattccgagtacaggttcctgagttgtccatgagggtctgggccaatatgtttaagaacaccaggccgcttttggtgatttatccaccagtccacgggggaaaaaggtcccaagacaaggaccctttctggaacagattggagggtctttgatcccagtgaaggaagggccggcccctggaggagaaaccattgcctctgggaggaaagattaaccctggnccccaagggctcaag

SEQ ID NO: 51191 - protein, 61 aa, Zea mays
  misc_feature: Ceres CLONE 1465108-F
MAKSRQNIRKLVNDGFIIRKPHRAHSRSRAIRGHEGQHKGRPSDIWQAQGDQGEVGSPPPF

SEQ ID NO: 51192 - DNA, 708 bp, Zea mays
  misc_feature: Ceres CLONE 1465110-F
  misc_feature: Encodes the peptide sequence at SEQ ID NO. 51193
tggagctccccgcggtggcggccgctctagaactagtggatcccccgggctgcaggaattcgcacgagaccattacctagaacatcctaatcgaaaaatctcttacccgcggtgcgacgccggcccgggcgtggcgcggtcgctgctggtgctggaggtggtggccttctcgtccttcctcttctccagcctggtggcgcagggcctgaagctggcgctcaacctcatcaactccaaggacccgcacgacgcggcgcgcgcccacatcgacgcccgcgtgctccgcctcggcatgctcgcctccgccgtcggatccgtcgtcggctgcgtcttcctcatgacgtccatggtcatggtcgtgcaggtccgcctcggcacgctgagctgccccaccgaccgcgccgccgccaaggccgccgcgggcctcgtcggcctcgtcaccaccgcgctcgccttctacgtgggcaccgtcttctacacctttcaccactgatgccagttccatgcgtccgtgcgctgcatcccaaatccatctagcgttgcgttgcgttgcaaagggcacatcgccatcagtggtgtcggtgtgcgaggaaatgaaaagagggacctgcatctgcggtaaaaaaaaaaaaaaaaagcttatcgataccgtccacctcgaggggggcgccggaacccaattccccctatggggagtcgaatacccgc

SEQ ID NO: 51193 - protein, 163 aa, Zea mays
  misc_feature: Ceres CLONE 1465110-F
GAPRGGGRSRTSGSPGLQEFARDHYLEHPNRKISYPRCDAGPGVARSLLVLEVVAFSSFLFSSLVAQGLKLALNLINSKDPHDAARAHIDARVLRLGMLASAVGSVVGCVFLMTSMVMVVQVRLGTLSCPTDRAAAKAAAGLVGLVTTALAFYVGTVFYTFHH

SEQ ID NO: 51194 - DNA, 753 bp, Zea mays
  misc_feature: Ceres CLONE 1465120-F
  misc_feature: Encodes the peptide sequence at SEQ ID NO. 51195
aagctggagctccccgcggtggcggccgctctagaactagtggatcccccgggctgcaggaattcgcacgagaccattacctagaacatcctaatcgaaaaaaacccttcgaaaacccttctcccgtcctgctcactcccgtctccgagcgccgccgccgccagcgccgatacgcgataaacaagaggaagaagaggccaaccgatccagcagcgatggcgggcgggggcatgctggggggcgctttctgggcgacgcgggcgctggaggtggtcaagcggaacgattccccgggcctattgtggaagcgcatcaagctcaccaccacccgcaagaacaacgccaagaagcgcctcaagcggctctggcagaatgaggcggttataagagcttgtggtgcatcagcgtctgacgcggcttccacagctgacaaacaacagtagcttggagcacaactggagcaggtcctgtgacctacctatgcttgataagctgaagccttgactttgctgcccccccccccaagtgttttgattttgctgtcctcggattgaatactttctccatccagaggacaacatcattgcttgttaccagctcgccaccccattctttttcgaagcttgcaagtttggttaaagacatgttggaagagtccggtgcccatcaatggaccggatgctgccccatgtactctctcatgtagtcatgtgctgcgtaacaaaacatgtggtgtgtgtggtgatggtacaa

SEQ ID NO: 51195 - protein, 75 aa, Zea mays; identical to SEQ ID NO: 46030
  misc_feature: Ceres CLONE 1465120-F

SEQ ID NO: 51196 - DNA, 785 bp, Zea mays
  misc_feature: Ceres CLONE 1465123-F
  misc_feature: Encodes the peptide sequence at SEQ ID NO. 51197
  misc_feature (561)..(561): n is a, c, t, g, unknown, or other
  misc_feature (570)..(570): n is a, c, t, g, unknown, or other
  misc_feature (785)..(785): n is a, c, t, g, unknown, or other
tggcggccgctctagaactagtggatcccccgggctgcaggaattcgcacgagaccattacctagaacatcctaatcgaaaaaccaatcccatcctccacccattcgaaggaccaaccgagcggtagcagcggcggcgatcggagaagatggtgcgcaaggccaaggttgagttcaacgagcagccgccggataacttcgacccgaagaacccgtatgccgacccggtggcgatgctccagtaccgggaacacctgctgcgagagaagtggatccagatcgagacggacaagatcatccgggagcgcctccgctggtgctaccgcatcgagggcatcaggcgacctcgggaaagggcgaccactcaacgaccaatacctatcagcctaccccgaggggggcgcctcgcggcaaggatgcccgcccgtccttgactccccaacccccagaaaataccggcagggcggaataagcggggctggctgcccttgctttctcatggcttggcgccccccgcgaatgagagaaggggattttgcccccttcccgttgggataaaaancccccccgnccccccccacccaaagataagtctggcttttttttcttcttaacgcttccccgaaataactttttacataaaaatcctttggtcccgagaaaaaaatatcttcgtaagacgtcaaatctgttgcgcccacacgcttgtgtggctttatgagcgcacccgcgcgaaatgttaaaccgttggtggctggggctctggctcctcaagacaaacccgtn

SEQ ID NO: 51197 - protein, 94 aa, Zea mays
  misc_feature: Ceres CLONE 1465123-F
MVRKAKVEFNEQPPDNFDPKNPYADPVAMLQYREHLLREKWIQIETDKIIRERLRWCYRIEGIRRPRERATTQRPIPISLPRGGRLAARMPARP

SEQ ID NO: 51198 - DNA, 1119 bp, Zea mays
  misc_feature: Ceres CLONE 1465129
  misc_feature: Encodes the peptide sequence at SEQ ID NO. 51199
aaaaaattccacaaccgaaacctgcagtcgggtcatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccacctccccgaagaatacgatggactccgtgaaggacgtgctcggcaagatggggaagaggtttggcgaggcggcccgcaagaccgagaccatcaccggcaatttctggcagcacttgaaaactggaccaagcattactgatgcagcaatgagcaggatctcacaggtcaccaaagtcattgcagaaggtggatatgacaaaattttccatcaaacttttgaggtcgcccctggtgaaaagctcaagaagccatatgcatgttatctgtcaacctcggctggtcctgttatgggtgtgctttacctgtccaatgtaaaactggcattttgtagtgataacccacttgcataccaggttggagacaaaactgagtggagttactacaaggtggtcatcccccttgctcaactgcgatcaattaattcatcaacaagcagaacaaatgcagcagagaaatacattcaggtggtttctgttgataaccatgagttttggtttatgggcttcgtttactatgacagtgcggtgaagaatctgcaggaagcacttcaggaggctcagaatttacgtgcttagtgatgttcatggattggaactagcatgtcttatacattacagttgtgatatactgttttcccgtcagtttcgactgtttgtccagatttagtttgcgtaggtatcagctgtttctgtgttttgtactgacttaaaccgatgcggttcaatatgtgacgtgcatcctttcatggttgttctctgctatgatgagcccatttgcttcgagcaaaaaaaaaaaaaaaaaa

SEQ ID NO: 51199 - protein, 259 aa, Zea mays
  misc_feature: Ceres CLONE 1465129
  misc_feature (135)..(212): Pfam Name: GRAM Pfam Description: GRAM domain
MNPPAAAASTGAGGHAAAPAAAREYVHYPRLSPEEVAPPPPPPYHAATAAPSAYGGNPYIYSPAGGAATSPKNTMDSVKDVLGKMGKRFGEAARKTETITGNFWQHLKTGPSITDAAMSRISQVTKVIAEGGYDKIFHQTFEVAPGEKLKKPYACYLSTSAGPVMGVLYLSNVKLAFCSDNPLAYQVGDKTEWSYYKVVIPLAQLRSINSSTSRTNAAEKYIQVVSVDNHEFWFMGFVYYDSAVKNLQEALQEAQNLRA

SEQ ID NO: 51200 - DNA, 729 bp, Zea mays
  misc_feature: Ceres CLONE 1465131-F
  misc_feature: Translation starting site: 170
  misc_feature (420)..(420): n is a, c, t, g, unknown, or other
  misc_feature (625)..(625): n is a, c, t, g, unknown, or other
ggagctccccgcggtggcggccgctctagaactagtggatcccccgggctgcaggaattcgcaagagaccattacctagaacatcctaatcgaaaaacctgccgtgtacgcattcccggcgcggctccgttgcgttccagtcagtgcggcgacgccgccaacgtctcacatggcttgtcggatctcaagaggttttgctgctgtgctaaagcctgatccttttgatggtaaaaacttcttgatatggaaagctaagatggaattgtggctaactgcaatgtcttgttttcatgccgctgagggcaagcctgccaacttacctcctgaggatgaggctaagtttaaggctgaagacaacctctttcgaggtgcagtgattagcgcactggatactaaattccagaaaagctatatcatccnttcccacgggggaaagagctgtgggatgctcttgtaggaaagtttggagttactgacgctggtagcgagctgtatctcatggagcagctgtatgactacaagatggttgagaaccgatctgtagtgaacaggctcatgagtttcaggcactagctaaggaactcgaactttttccttgtccttgcctgacagttttgtggtggcngtattatcgccaagttgcaccttcttggaaggactttgctactctctcaacataagaaaaagagttcatgtggaagactcattgtactctgatgttgaagaaag

SEQ ID NO: 51201 - DNA, 668 bp, Zea mays
  misc_feature: Ceres CLONE 1465204-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (491)..(491): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactggggctccccgcggtggcggccgctctagaactagtggatcccccgggctgcaggaattcgcacgagaccattacctagaacatcctaatcgaaaaaataggagacggacagactttggctttgggtgtgcggcgggcggcggcaccgtggcagttggcactgcggtctacagactgcatcagccggcaggactctgcgtctcctcccgtcctccggtttctcccctgcgacgggacaaatctgctgctcgattttctctggttgtcccctgtggcggaacggcacatcggncaagccaggaagccagttcgtcagcctcttaatcggaatccggaaattatcctttctatttttgacggagacaaaacccttcgaaaacctgggctgggatttttaaggaaaaaaaaggcctaaaaaggggacccccaattcccgaaaaaaaattttggggggaactttataacgggg

SEQ ID NO: 51202 - DNA, 658 bp, Zea mays
  misc_feature: Ceres CLONE 1465241-F
  misc_feature: Encodes the peptide sequence at SEQ ID NO. 51203
aaagctggagctccccgcggtggcggccgctctagaactagtggatcccccgggctgcaggaattcgcacgagaccattacctagaacatcctaatccaaaaatcaaagaaaataactcgtgaggcaatttcagcttttgctgtgtcacccaacggtgctcttcttgcaattggaacaatagaaggaagcatcatcatagttggctcaaaagacatgcggacacttgtaacagttaaaaaggctcatcttggtattgttactacgttgaccttctctcaggattcaagaacattgctgtcaacttccttcgactcttctgcaagggtgacatctgttgggtccctaaagagtaatggaacaagcatatggcccatgctactagttgttattcttgcaattttggtgtactactgtatgcagcacaaagaagacattttggcaatgttgcagcgttgagatagatttctgttcagcccctgaccggtctactctgctggacgtattattagtgtttcttcagagattgaagaaattttggacttgggtcaacttcattattctctcaaggacaaacaatacagcaaaaggcactgagccctgctatgttttgtagtaaaaagggtcatgtaatcatgttgtcgaagtttttgtaagttg

SEQ ID NO: 51203 - protein, 80 aa, Zea mays
  misc_feature: Ceres CLONE 1465241-F
MRTLVTVKKAHLGIVTTLTFSQDSRTLLSTSFDSSARVTSVGSLKSNGTSIWPMLLVVILAILVYYCMQHKEDILAMLQR

SEQ ID NO: 51204 - DNA, 730 bp, Zea mays
  misc_feature: Ceres CLONE 1465244-F
  misc_feature: Encodes the peptide sequence at SEQ ID NO. 51205
  misc_feature (318)..(318): n is a, c, t, g, unknown, or other
  misc_feature (328)..(328): n is a, c, t, g, unknown, or other
aaagctggagctccccgcggtggcggccgctctagaactagtggatcccccgggctgcaggaattcgcacgagaccattacctagaacatcctaatcgaaaaatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcgggcgccgcgcgcgcccacgacgaccagggcagcggggccggcatacngcagccgagncgcaagtaccgcgggaaggaagtgggggccaagaacgaagtgcggaacgtggagggcaacggcaaggtgcaggaacttgggcgggttccccgtcccaaagtaaccggggaatccccaaaaaggtggggccgcgggcgcagggcctcaattccgggggggggggggggggccccccgggagggggggtgcgggggaccaaaaataaccccccccccccttggccctgaaaaaaggggcgcccccaaaaaaaacggaaaaaaatggtttttaaaaacccccttttttttaaaacaccgggtgttttcaccccccccccgctttttattttgcccggggggccccaaaaaaagagcggccccccccccggcggggaaaaaattgggtttttcttttctttccccc

SEQ ID NO: 51205 - protein, 174 aa, Zea mays
  misc_feature: Ceres CLONE 1465244-F
  misc_feature (37)..(37): Xaa is any aa, unknown, or other
  misc_feature (40)..(40): Xaa is any aa, unknown, or other
MARALGACVLLAVLLGALAPAGAARAHDDQGSGAGIXQPXRKYRGKEVGAKNEVRNVEGNGKVQELGRVPRPKVTGESPKRWGRGRRASIPGGGGGAPREGGCGGPKITPPPLGPEKRGAPKKNGKKWFLKTPFFLKHRVFSPPPRFLFCPGGPKKRAAPPPAGKKLGFSFLSP

SEQ ID NO: 51206 - DNA, 593 bp, Zea mays
  misc_feature: Ceres CLONE 1465246-F
  misc_feature: Encodes the peptide sequence at SEQ ID NO. 51207
  misc_feature (369)..(369): n is a, c, t, g, unknown, or other
  misc_feature (408)..(408): n is a, c, t, g, unknown, or other
  misc_feature (462)..(462): n is a, c, t, g, unknown, or other
aagctggagctccccgcggtggcggccgctctagaactagtggatcccccgggctgcaggaattcgcacgagaccattacctagaacatcctaatagaaaaacctatctttttcctcagcaaccgtgctcggttcctcctccctcgaaacggctcccacccccgcgccgcgataagaaaacccaccaaaccctaaccctagcagcggtgccacaaccgcccgcgttcccggccggagaggaagccgagccagcaaggatgccgcccgggtcggcgacgcaatttcggtacacgcagacgccgtccaaggtgctgcatcttcggaacatgccatgggagtgcaccgaggaggagctcgtcgacctctgcnaacccttcgggcgggtcgtaaaacacatgtgcaacgtcngcgctaacccgcaacagcattcgtcgagtttgcagatcaaaacccagcattttncagggggtcctattatgcttcatcttcagaacctgtccaggttcgtggtaaaactggatatattccatatttcaaccggccagaaaatacctacaattaaggccctggggatcctctgggaaaggtctact

SEQ ID NO: 51207 - protein, 112 aa, Zea mays
  misc_feature: Ceres CLONE 1465246-F
  misc_feature (38)..(38): Xaa is any aa, unknown, or other
  misc_feature (51)..(51): Xaa is any aa, unknown, or other
  misc_feature (69)..(69): Xaa is any aa, unknown, or other
MPPGSATQFRYTQTPSKVLHLRNMPWECTEEELVDLCXPFGRVVKHMCNVXANPQQHSSSLQIKTQHFXGGPIMLHLQNLSRFVVKLDIFHISTGQKIPTIKALGILWERST

SEQ ID NO: 51208 - DNA, 661 bp, Zea mays
  misc_feature: Ceres CLONE 1465257-F
  misc_feature: Encodes the peptide sequence at SEQ ID NO. 51209
aaagctggagctccccgcggtggcggccgctctagaactagtggatcccccgggctgcaggaattcgcacgagaccattacctagaacatcctaatcgaaaactctctctagcgccggtggcggcgacgggcgcacgacgtctgagaccatggcgccgccgccggagcctcgccgcccgtacaagcgaccggccatctccgaccagcagcgccgtcgggagctcgcactccaggcgcagtcggctcggcgggccgatgcccaggctcgcgcgcgcgccctcgccacttctctcctcaccacccaggcgcctaccgcggccaccagtcgcgacgattacgaggaggaggagtacgagcatgaggaggaggatgagcgcgagctcactgcctgtggcgtcgcggcggccgccgccgcctccaggctccgcggctccgaagcgcgtcggtggttcgcgcgccaggttatgctccccgagtggatggtcgatgccccgccccacctcgccacggactggcatgtttttgcccgaccttctggcaaacgatgtttggttgtgtcatccaatggcatgacgatcagcagggttcgtaatggatccatccttcatcgcttcccttccgctctgcccaatggttcaaagagagacatttctggcccagc

SEQ ID NO: 51209 - protein, 170 aa, Zea mays
  misc_feature: Ceres CLONE 1465257-F
MAPPPEPRRPYKRPAISDQQRRRELALQAQSARRADAQARARALATSLLTTQAPTAATSRDDYEEEEYEHEEEDERELTACGVAAAAAASRLRGSEARRWFARQVMLPEWMVDAPPHLATDWHVFARPSGKRCLVVSSNGMTISRVRNGSILHRFPSALPNGSKRDISGP

SEQ ID NO: 51210 - DNA, 664 bp, Zea mays
  misc_feature: Ceres CLONE 1465259-F
  misc_feature: Translation starting site: 460
aagctggagctccccgcggtggcggccgctctagaactagtggatcccccgggctgcaggaattcgcacgagaccattacctagaacatcctaatcgaaaactaaaccctacccgactccgccgccgctcccgctccgccccagcgcatcgcccgccgccacagcgtaccgcgacctcatctatcaccttcagctttcaatcatggcggacgtcgatgtcgaaccggaggttgccgccggagctcccaagaagaggacgttccgcaagtacagctaccgcggcgtcgacctagatgcgcttctcgacatgtccactgacgacctcgtccagctcttccccgcgcgcgccaggagaaggtcatctcatccctgacggcttccctgaggttcgatggtgctctgaacgttgatgtgaacgagttccagaccaacctggtgccctacccgaggatccacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatca

SEQ ID NO: 51211 - DNA, 656 bp, Zea mays
  misc_feature: Ceres CLONE 1465261-F
  misc_feature: Encodes the peptide sequence at SEQ ID NO. 51212
aaagctggagctccccgcggtggcggccgctctagaactagtggatcccccgggctgcaggaattcgcacgagaccattacctagaacaatcctaatcgaaaacttctgatggatttgttatttggggccagagccatgtgaatgaaagcatgattactggagaatcacacccagtagcgaagaggaagggtgacactgtaattggaggaacagtgaatgagaatggcgtgctccatgtccgggcaacatttgtcggatcagagactgaactgggcactggcacagatcgtccggctagttgagtcggcagaaatggcaaaagctcctatttagatattcgctgatcagatatctagtctttgtcccactggttattgttctctctttgctaacttggcttgtgtggttcttagctgggagattccacggttacccttactcatggacaccatcttccatggatagctttcagcttcctcttcagtttggattatcagttatatgtatagacgctgaatttgctatcagtcttgatcaaaaccatggctctattattcttgatagctacccacaatggttctattctttttttactttatattcaaactcttttcatttataaaaaaaaaaaaaaaaaagcttatcgataccgtcg

SEQ ID NO: 51212 - protein, 50 aa, Zea mays
  misc_feature: Ceres CLONE 1465261-F
  misc_feature: SWISSPROT Homolog: EC 3.6.3.4 Copper-exporting ATPase
MITGESHPVAKRKGDTVIGGTVNENGVLHVRATFVGSETELGTGTDRPAS

SEQ ID NO: 51213 - DNA, 638 bp, Zea mays
  misc_feature: Ceres CLONE 1465273-F
  misc_feature: Encodes the peptide sequence at SEQ ID NO. 51214
aaagctggagctccccgcggtggcggccgctctagaactagtggatcccccgggctgcaggaattcgcacgagaccattacctagaacatcctaatcgaaaaattccccaatcacgtccgcttctctccccgtcccttacctcgcccaggaggggagcctcccgcttacaaaccctaacctctactcctctgagcttccaccgctccgctccccatggaggacgaggacaccggccccggcgatgggggcgaggcctctcctccgcaccacgtcggggcgtctagcgaccgggcgcgcgacatggtggcgtccccgaccagctcgcgctctgtgacgttgacggagaacgggtcccaccacttcgagatccagggttactcgctcgctaagggcatgggcgtggggaaccacatcgccagcgagacattcgccgtgggaggttaccagtgggctatctacttctaccccgacgggaagaaccccgaggacaactccacgtacgtctccgtcttcatcgcgctcgcgtccgacggctcccacgtgcgcgcgctcatcgagctcacgctcctcgaccagagcggagagggcaagcttaaggtgcactcgcactgcaaccgctcactagattccgggccgt

SEQ ID NO: 51214 - protein, 141 aa, Zea mays
  misc_feature: Ceres CLONE 1465273-F
MEDEDTGPGDGGEASPPHHVGASSDRARDMVASPTSSRSVTLTENGSHHFEIQGYSLAKGMGVGNHIASETFAVGGYQWAIYFYPDGKNPEDNSTYVSVFIALASDGSHVRALIELTLLDQSGEGKLKVHSHCNRSLDSGP

SEQ ID NO: 51215 - DNA, 472 bp, Zea mays
  misc_feature: Ceres CLONE 1465295-F
gcggtggcggccgctctagaactagtggatcccccgggctgcggattcgcacgagaccattacctagaacatcctaatcgaaaaaccaccactcatcaccaccagctgccttgccatctactgacctgtgacctccgcatttccaaacagcccgacgacgagcgagctagcagagcggcaggcacctccctccctcaggaacatggcccgcatgcagcaattggcagtggcgaccgcggccgtgggtggccttggtgcctgctggccgcggccaactcggaagcggcccttcactgggggaggggggggtttggccatttggcccttgattttccttaaaccccggggcaagggtttgggggccccccccccccgggtgtgtttaaaaagggtttttaaggaaaccccttaaaaaaaaacccccccccggcggaaaaacggctccaaaaaaaaaaccggggggggggcccca

SEQ ID NO: 51216 - DNA, 564 bp, Zea mays
  misc_feature: Ceres CLONE 1465308-F
  misc_feature: Encodes the peptide sequence at SEQ ID NO. 51217
  misc_feature (256)..(256): n is a, c, t, g, unknown, or other
tggcggccgctctagaactagtggatcccccgggctgcaggaattcgcacgagaccattacctagaacatcctaatcgaaaaacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcangttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctcttcagcgcagggccgcacctctacgttttccgcgttaggtcgcccttcccccgtggcaattacctgtgggcaagggcggcccggtttggtccctgggccaaaaaacccgggttgcctttaccgggccggttttccgggggggtttac

SEQ ID NO: 51217 - protein, 102 aa, Zea mays
  misc_feature: Ceres CLONE 1465308-F
  misc_feature (25)..(94): Pfam Name: Histone Pfam Description: Core histone H2A/H2B/H3/H4
  misc_feature (37)..(37): Xaa is any aa, unknown, or other
MSGRGKGGKGLGKGGAKRHRKVLRDNIQGITKPAIRXLARRGGVKRISGLIYEETRGVLKIFLENVIRDAVTYTEHARRKTVTAMDVVYALQRRAAPLRFPR

SEQ ID NO: 51218 - DNA, 787 bp, Zea mays
  misc_feature: Ceres CLONE 1465311-F
  misc_feature: Encodes the peptide sequence at SEQ ID NO. 51219
  misc_feature (20)..(20): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gcctggggggtcgcccccgntaatttcccctcccnnnnnnnggtgctnnnnncaatactgcgactccccgcggtggcggccgctctagtctagtggatcccccgggctgcaggaattcgcacgagaccattacctagaacatcctaatcgaaaagtccccgtctcaccgcactgccttgccccctactctgcctcgcttaccttcgccgccgctgctacgccctctcgccgtgcttgttcccgcgtcggtctgcccgcggtggcgccccctgtcgccgtgctgcccggggcggtgccgcctgtgctgccccgcgcgagcgtcggcacaggagatggacccgcccctgccggccggccccgtgcccccccccggcgcggtttcgggggcccgccgggcccggccccgggggccgcggttgcgtttgttgctcctcgttcctccccggggggggggggggcgccggccggggggggtagggggggaaccccaaggggggggtggttggctgggtgggagaattaggtggcctctgtgccactgttgttccgcctgggcccggggacgggcaagctggcggggggcccggctggggcccgggccgccccgcagcgcggcggcccggccggatggcggggggggggaggcggcggcggcgcgccccccggctggtgggggcccccgcggccccgcgggggggggcccgaggcccccggtgggccccccccccccccccgcttgggcggccggagggggccccccccccccccgagtgcccccctcgctcag

SEQ ID NO: 51219 - protein, 151 aa, Zea mays
  misc_feature: Ceres CLONE 1465311-F
MDPPLPAGPVPPPGAVSGARRARPRGPRLRLLLLVPPRGGGGRRPGGVGGEPQGGGGWLGGRIRWPLCHCCSAWARGRASWRGARLGPGPPRSAAARPDGGGGEAAAARPPAGGGPRGPAGGGPRPPVGPPPPPAWAAGGGPPPPRVPPSL

SEQ ID NO: 51220 - DNA, 650 bp, Zea mays
  misc_feature: Ceres CLONE 1465334-F
  misc_feature: Encodes the peptide sequence at SEQ ID NO. 51221
tggcggccgctctagaactagtggatcccccgggctgcaggaattcgcacgagaccattacctagaacatcctaatcgaaaacttttccggttctaccgtcccatctggattcctcttctgctccccttcgcctcccttcccttcctcgacttcacctcaccaccatctccagctccatccgcacgcagccatccaccaaccgacgcagcgaggagatgaacgcgtcgcagttcatggacaagcagatcctcggcctggctgcctccgcttccccctccggcggcggcgcggggggcggtgggggtgtggatctcagcgatctgatgataccgatcccccaggaggacggcgagaaccgcctcggtcgccggcgtagcagcaccagcgtcaacggaaccgcagacgacatgctacccagttatgacttccagcccatccgcactagtggcggcgccgcggccgcggccgccgccgcgcctcaggcctcgtgggggtcgctcgactccaaggcaccctctgcctcatacaacctcaagagtgctggtatattggagccacatgtgctgaagaaagttagtcatgaggaagacaagagtaactttcctacagttactattgcggatattgatcgaaccatgaagacgtactc

SEQ ID NO: 51221 - protein, 144 aa, Zea mays
  misc_feature: Ceres CLONE 1465334-F
MNASQFMDKQILGLAASASPSGGGAGGGGGVDLSDLMIPIPQEDGENRLGRRRSSTSVNGTADDMLPSYDFQPIRTSGGAAAAAAAAPQASWGSLDSKAPSASYNLKSAGILEPHVLKKVSHEEDKSNFPTVTIADIDRTMKTY

SEQ ID NO: 51222 - DNA, 747 bp, Zea mays
  misc_feature: Ceres CLONE 1465340-F
  misc_feature: Encodes the peptide sequence at SEQ ID NO. 51223
  misc_feature (46)..(46): n is a, c, t, g, unknown, or other
aaaaaaatcttacccacaaccacaaaacaaatactcatataccatntttcctcctctccctccttgagctccaccgcggtggcggccgctctagactagtggatcccccgggctgcaggaattcgcacgagaccattacctagaacatcctaatcggaaagtctgtcacctaccctaccctgctcgacaaggcaatctgaaaatgctctccgcaatctccacctccgcaatctccacctccctactagtagtactcttcggtggagtccgcatccccacatctgaccgactctcaaagttcacagctccaatcctggtgcaagcgcacagtagcggagcaagatgcggggaggagaccggccatcggcgtcgctccagctcctctcgctgggcctcgtgctcctctacttcttcacctcagaagacgtggtgcatcgcgaagccgtcggcgtcgaacgagatcctggcgcagaacctggactacgcgtgctcccaggtgagctgcgccgtgatccagaagggcgggccgtgctactacccggacagccccgtgttcctgcgccgacgtcggccatgaaacctctaactacccctacaagcggttaggcccccccctgaaaactggctacttccaacaaactccccccgctctgttccggctagttcccaccccccaaggcctaattgggcttcccttggacccaataaccctacctttaaactcaacccgaatatttttctaaagag

SEQ ID NO: 51223 - protein, 124 aa, Zea mays
  misc_feature: Ceres CLONE 1465340-F
  misc_feature (75)..(118): Pfam Name: X8 Pfam Description: X8 domain
  misc_feature: SWISSPROT Homolog: EC 3.2.1.39 Glucan endo-1,3-beta-D-glucosidase
MLSAISTSAISTSLLVVLFGGVRIPTSDRLSKFTAPILVQAHSSGARCGEETGHRRRSSSSRWASCSSTSSPQKTWCIAKPSASNEILAQNLDYACSQVSCAVIQKGGPCYYPDSPVFLRRRRP

SEQ ID NO: 51224 - DNA, 425 bp, Zea mays
  misc_feature: Ceres CLONE 1465417-F
  misc_feature: Encodes the peptide sequence at SEQ ID NO. 51225
  misc_feature (159)..(159): n is a, c, t, g, unknown, or other
  misc_feature (175)..(175): n is a, c, t, g, unknown, or other
cggtggcggccgctctgaatagtggatcccccgggctgaggattcgcacgagaccattacctagaacatcctaatcgaaaaactgtaggccgctgctgctcctctcctcccatctcaccacacaccgcagccccagcaagatcgcgcggagggcatggncgagccccagcctttnctccgccgggcggcaaagccggaccgcgggctgccccacccggtttacagtggccattcggggctgggccaccttaaaccttctatggttgggggttcctttttccctttttggccccgcccctttttggaaacccccccccggggggggaccacccacattggggtgggcccccccccaaaaaaaaaattttttgggggggggggggggggtattttttttttaagagccccccccccccgggggggga

SEQ ID NO: 51225 - protein, 90 aa, Zea mays
  misc_feature: Ceres CLONE 1465417-F
  misc_feature (2)..(2): Xaa is any aa, unknown, or other
  misc_feature (7)..(7): Xaa is any aa, unknown, or other
MXEPQPXLRRAAKPDRGLPHPVYSGHSGLGHLKPSMVGGSFFPFWPRPFLETPPRGGTTHIGVGPPPKKKFFGGGGGGIFFLRAPPPRGG

SEQ ID NO: 51226 - DNA, 674 bp, Zea mays
  misc_feature: Ceres CLONE 1465418-F
  misc_feature (421)..(421): n is a, c, t, g, unknown, or other
aaagctggagctccccgcggtggcggccgctctagaactagtggatcccccgggctgcaggaattcgcacgagaccattacctagaacatcctaatcgaaaaaaaggatgaagttcagatttacacatggaaggatgcgaccctccgcgagctcactgatcttgtgaaagaggttgctcttccagcaagaaaaaggaatgcaaggctttcttttgcatttgtatacccagacaagaatggtcgttttgttgtcagacaggtgggttcgaccttcgcttacggtcatggaagaggcgacgatgccaaaactcttgcagagctcggattccagatcggtgattacttgagcgttgcaatcatgtagacggtgcctgcaccggatgtaattgctgtgatgtcaaaagggctctggttgcaacantaaagcatgattctctgttagcactaggaactgcaacagaaattgtctgtaataccggaagtatcaaatttacctagacacttcaaacgagcaaggcgtctgtaataccggtacttacatgtggggcctgaagcttccaaatcggaaaagcgggggtttttcattgaaaaggtaaatttggctcgggtccctttgaagtcaaacacggaaaatttggcttcttgaacccaaaaaaaaaaaaaaaaagcctatc

SEQ ID NO: 51227 - DNA, 697 bp, Zea mays
  misc_feature: Ceres CLONE 1465419-F
  misc_feature: Encodes the peptide sequence at SEQ ID NO. 51228
  misc_feature (554)..(554): n is a, c, t, g, unknown, or other
ctctagaactagtggatcccccgggctgcaggaattcgcacgagaccattacctagaacaccctaatcgaaaatctccctacccctacgggtcctgtggccactgcctcttgccgcaggcagccctcttctctctcttccgccgtctcgcctcctcacgccattaaaccccacccgcgcgcgcggcggccggcggcgagccctcacccatccgagcaagccgtggaggaagcgagcgcgcgaaagtatcaggaggaggcatgggtaccctggggcgcgcgatcttcacggtgggcaagtggatccggggcacggggcaggccatggaccgcctcggatccaccatccagggcggggctcggggtcggaggaacaggtttcaagggcatcgtacaacccatgaatattttttgagaaaggagcccaggatccatagaggaggtggtgtggttgccccccaggggaggcggccatttgggggaaggtggaagattggctcaagggatccggccagtctggggacggggatccatagttgggggagggtgacggccncccaggcatttccccatttgggatctgtgggcccccacaataaccaagaaaagtttcccctttggtccccttggttcccacaaaggttaaacttttaggggggggaaagggtccctcccccaacccattaatattggggaggg

SEQ ID NO: 51228 - protein, 130 aa, Zea mays
  misc_feature: Ceres CLONE 1465419-F
  misc_feature (99)..(99): Xaa is any aa, unknown, or other
MGTLGRAIFTVGKWIRGTGQAMDRLGSTIQGGARGRRNRFQGHRTTHEYFLRKEPRIHRGGGVVAPQGRRPFGGRWKIGSRDPASLGTGIHSWGRVTAXQAFPHLGSVGPHNNQEKFPLWSPWFPQRLNF

SEQ ID NO: 51229 - DNA, 803 bp, Zea mays
  misc_feature: Ceres CLONE 1465420-F
  misc_feature: Encodes the peptide sequence at SEQ ID NO. 51230
  misc_feature (43)..(43): n is a, c, t, g, unknown, or other
agggggggggccagaagcccggaatgacaacaaccctttcaanaacacaccccccccacacaggggctccccgcggtggcggccgctctagaactagtggatcccccgggctgcaggaattcgcacgagaccattacctagaacatcctaatcgaaaattagctcaaaaaatccaatttaacacatttggtggaaatccagtttgttctgctggtgggttagctgtgcttaaggttcttgacaaggagaaacgccaggcacattgtgctgatgttggatctctcttgtcggagcgtctaaaatcgcttcaggagacgcacgaaatcctaggtgatgttagaggaaggggactgatgcttgggcgtgcaactctttaccggaagcaaaggagaaaacccctgccaagtccagaaaccattggaactgtttgagaaacctcagagaatcttgggggcactaatttggaaaaagggtgggccttgcttggaaaaacatcttaccacacatgaaaccacccccacgggggttttttcgaaggagacccccccacaacttttcttggtgtgggccccccgggggaccagcgcccactggtccgagggcccgtgaaaggaaaacctggctcctgaaggcccacaccaatggtggtcgcctgtgggaaaccaacaatttgcgtggcaacccgccaggagtggcaaggcccctggaaattgaaccctggaaagcggccgacgagatcaccggggggatagccccccccggcgcgggaaaagggcgcgggataatgcgcgcaacttattaca

SEQ ID NO: 51230 - protein, 142 aa, Zea mays
  misc_feature: Ceres CLONE 1465420-F
  misc_feature: SWISSPROT Homolog: EC 2.6.1.44 Alanine--glyoxylate transaminase
  misc_feature (14)..(14): Xaa is any aa, unknown, or other
GGGQKPGMTTTLSXTHPPHTGAPRGGGRSRTSGSPGLQEFARDHYLEHPNRKLAQKIQFNTFGGNPVCSAGGLAVLKVLDKEKRQAHCADVGSLLSERLKSLQETHEILGDVRGRGLMLGRATLYRKQRRKPLPSPETIGTV

SEQ ID NO: 51231 - DNA, 687 bp, Zea mays
  misc_feature: Ceres CLONE 1465421-F
aaagctggagctccccgcggtggcggccgctctagaactagtggatcccccgggctgcaggaattcgcacgagaccattacctagaacatcctaatcgaaaagggtacatggtatcgggttacagtccaaacaggaaattctaaggccgatgaaagataaggatatgggtacagtcacccagtcctgccatgacgcgaaagcttatagaaatcaggtggcataaatactgtgcagggctaaaggttggtgggtcgaacggaccaggccatcaggttatctagaaagctctcatgctcttccatttctaggctagcctaggtctggaccaattaggcacgcaagtatcaatcgattcataagaggaggagaccattcaccgcagctagcgggggagagggcagtcacggcaaacaacgaaagctggtgaacaactttgtcaagcctcaaaagctcatggaagatggcagtgctcccagacggtctactccaccccgcccccagaagcaaatctgccgagttccacaatttttcaaaaagggaggagaagggataagatcccacgagaaactgaaaagcttaccaggagcttcttccaaactgcaaccaagacccgacaaattttcgaaggctggacaaaagcaatcgactacctaaaaatccctttcactaccagcttccaaaggggg

SEQ ID NO: 51232 - DNA, 664 bp, Zea mays
  misc_feature: Ceres CLONE 1465432-F
  misc_feature (376)..(376): n is a, c, t, g, unknown, or other
  misc_feature (474)..(474): n is a, c, t, g, unknown, or other
  misc_feature (481)..(481): n is a, c, t, g, unknown, or other
  misc_feature (486)..(486): n is a, c, t, g, unknown, or other
  misc_feature (637)..(637): n is a, c, t, g, unknown, or other
  misc_feature (651)..(651): n is a, c, t, g, unknown, or other
ctccccgcggtggcggccgctctagaactagtggatcccccgggctgcaggaattcgcacgagaccattacctagaacatcctaatcgaaaaactctactagctaattacctccgtttcggcgccgtatccagccccggcccaccacatatgcccgcgcgcgaggcgcgaccacgcggcaggtctcgctccccgtctaccaactcggtcgcttcgcttcagcggctcgtcgttgctatcacttcgtcgccgcgggtcgatagcaaagcttggccgcttgcgcatcgcggctgccggagccggacgggcggcgcccgcgcgcggccgcctctcccttccgcgtcgacgcctgaggaggcgtataccgtggagcttgnagctgagctgaaccatctcaaggaggagaacgagcgcctcagagcagaagagaagacgattctgctgtcgagaaaaagatgctggtgggagagatgantgaacanggcanggagaatgtgagcgccaagaaggtcggtcgcgggctgcgccggtggggcagcgccatgtggtgaatttgtgacgactgagactcgcgttgtgcagttccagtccgaatggcgcttgcttgcttgcttccatggaaagtgctgtacctgtcngtaccagaacattnggtacagtacgcg

SEQ ID NO: 51233 - DNA, 675 bp, Zea mays
  misc_feature: Ceres CLONE 1465438-F
  misc_feature: Pfam Name: SAM_2 Pfam Description: SAM domain (Sterile alpha motif)
aagctggagctccccgcggtggcggccgctctagaactagtggatcccccgggctgcaggaattcgcacgagaccattacctagaacatcctaatcgaaaaggcatactctcactctctccctcggtccctcctcgtcgttctcccgtgtccgccgtgcactgtctgtctctggtggcggcgactgggcggcctccgccgctgccctacgccaggatcccaggctgcatattccgaggagggcctcgccgcaggttgggtggggaggcggaaatgagccggggccgtcccccggagcccttggatttctcatctggactgtgcaggatgtagggttatgggtggaagaaataaatcttggaagctaccgcccagcttttgaaggaaaatgttgtccatggataatatctagaaagcctgccggtgttccccactgaacaaattctccgctttataaaacggggccatatgaaatggggaaattttatccccctctgtaaagagtttgagaccatcaaaattgccctgcttaaaggggaaccaggaagtccccaggccgtgggtgggccccctcatgcctgtcggtcgttgttcagcggggtggccaggcacaaaccgggattccggggccgtctcccttgaaactgggaacctttacaagttaaccaggctcccc

SEQ ID NO: 51234 - DNA, 664 bp, Zea mays
  misc_feature: Ceres CLONE 1465441-F
  misc_feature: Encodes the peptide sequence at SEQ ID NO. 51235
aaagctggagctccccgcggtggcggccgctctagaactagtggatcccccgggctgcaggaattcgcacgagaccattacctagaacatcctaatcgaaaacccctccctgttctgttcaactctccctcttcctctctcccttccccgcctcctcttgccgtacgccacgtctcgagtccccatcgccctctcctcgcctgcgcgctgatccaccgaccgaccgctcgcgacgagtcaaaggggcgaggacccctcgacctcttcctcccagcaacccagcgagcatgacgtgtaccggcggcggcggcggcggcggctagcactactcgcggcaggtccgcgagctctgcgcgctgctgctcgccatcgtgtccccctccccggcgccgccgcggcagccggtgtcgacgatgtctcctgccagcgcccgcggcatgctccatcgcgcgtcggtggcgctcatgctctgcggctccgtcaccttcgccatcgcttacatcctcatgccctgggccgccggcctcgcgctcctctacggatgagacgggacggtcaacaccctctcctcctcggggctgttcctctgcaggggcagcggcaaccaagaagccccccgccgcgagccccttgaaagcacacgggggtgacggatcgtcatcgg

SEQ ID NO: 51235 - protein, 43 aa, Zea mays
  misc_feature: Ceres CLONE 1465441-F
MSPASARGMLHRASVALMLCGSVTFAIAYILMPWAAGLALLYG

SEQ ID NO: 51236 - DNA, 624 bp, Zea mays
  misc_feature: Ceres CLONE 1465444-F
  misc_feature (200)..(200): n is a, c, t, g, unknown, or other
  misc_feature (201)..(201): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (308)..(308): n is a, c, t, g, unknown, or other
  misc_feature (309)..(309): n is a, c, t, g, unknown, or other
  misc_feature (315)..(315): n is a, c, t, g, unknown, or other
  misc_feature (316)..(316): n is a, c, t, g, unknown, or other
  misc_feature (320)..(320): n is a, c, t, g, unknown, or other
  misc_feature (321)..(321): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (353)..(353): n is a, c, t, g, unknown, or other
  misc_feature (354)..(354): n is a, c, t, g, unknown, or other
  misc_feature (358)..(358): n is a, c, t, g, unknown, or other
  misc_feature (361)..(361): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (381)..(381): n is a, c, t, g, unknown, or other
  misc_feature (382)..(382): n is a, c, t, g, unknown, or other
  misc_feature (405)..(405): n is a, c, t, g, unknown, or other
  misc_feature (409)..(409): n is a, c, t, g, unknown, or other
  misc_feature (415)..(415): n is a, c, t, g, unknown, or other
  misc_feature (424)..(424): n is a, c, t, g, unknown, or other
  misc_feature (459)..(459): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (491)..(491): n is a, c, t, g, unknown, or other
  misc_feature (524)..(524): n is a, c, t, g, unknown, or other
  misc_feature (525)..(525): n is a, c, t, g, unknown, or other
  misc_feature (527)..(527): n is a, c, t, g, unknown, or other
  misc_feature (537)..(537): n is a, c, t, g, unknown, or other
  misc_feature (541)..(541): n is a, c, t, g, unknown, or other
  misc_feature (576)..(576): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (608)..(608): n is a, c, t, g, unknown, or other
tggagctccccgcggtggcggccgctctagaactagtggatcccccgggctgcaggaattcgcacgagaccattacctagaacatcctaatcgaaaaaatcagcaataatctcgccgtctcatcgcaaaacccagcgccccaaagcgaccccaccgaagcgtcccagcccgaccggaatggcgatggcaccgtgcgcacnnccgccctccgtctcctccttcccccgcccgtccagtgacggaacccccctttccccgccttggtccccgggggggnnnncccccccggggggccgcccggggggccnncggggnngggnngggggggnnnnncgcccccccccccccccccnncccnccnccnnnnnnnnnnnncnnncnnccccccccccccccccccccgcncccncccccnccccccccngcgcgggccgcgggggggcgggggggggggggggnggggggggnnnnnncggnnncgnnnnnnnggnccccgccccccccccccccgcccccgccccccnncnccgccgcgcnccgncggcggggggggggggggcggcgggggcgggcggnggcggcgccccccgggcnnnccgccccccccncccgccccgcgcggcg

SEQ ID NO: 51237 - DNA, 671 bp, Zea mays
  misc_feature: Ceres CLONE 1465447-F
  misc_feature: Translation starting site: 173
  misc_feature: Pfam Name: SCAMP Pfam Description: SCAMP family
  misc_feature (582)..(582): n is a, c, t, g, unknown, or other
aaagctggagctccccgcggtggcggccgctctagaactagtggatcccccgggctgcaggaattcgcacgagaccattacctagaacatcctaatcgaaaaaggacgccattagcagcggttggccaccagcccaccacccgacgccggaggcccggaggaggaggcggcgatggcggggaagcacgggcgcaacggcttcgacgacgacaacttcaaccctttcgcgggaggaagtgttccacctgccaccaattctcgtctctcacctctatcacatgaaccggctgatttctacaatgtggacattcctctcgactcatcaagggatctgaagaaaaaggagaaagaactccaggctatggaggctgagctaaacaaaagagaacgggaattgaaaaggaaggaagaggcggcatcccgagctggcgttgtgatagaagagaaaaaactggcctccctttttccccctcatccaccacgacgtttcaaatgaaatacctatccatctacaaaggatgcagtaccttgcattctcatcattcttgggattgataccgggtctcttttggaatgtcatanccactaccacagcctggattaaaggggaaggtgttatgatctggctgcttgccattatctacttccaaaccggtggcccctggggccta

SEQ ID NO: 51238 - DNA, 575 bp, Zea mays
  misc_feature: Ceres CLONE 1465453-F
  misc_feature: Encodes the peptide sequence at SEQ ID NO. 51239
  misc_feature (320)..(320): n is a, c, t, g, unknown, or other
  misc_feature (328)..(328): n is a, c, t, g, unknown, or other
  misc_feature (353)..(353): n is a, c, t, g, unknown, or other
  misc_feature (367)..(367): n is a, c, t, g, unknown, or other
  misc_feature (402)..(402): n is a, c, t, g, unknown, or other
  misc_feature (423)..(423): n is a, c, t, g, unknown, or other
  misc_feature (424)..(424): n is a, c, t, g, unknown, or other
  misc_feature (445)..(445): n is a, c, t, g, unknown, or other
ggagctccccgcggtggcggccgctctagaactagtggatcccccgggctgcaggaattcgcacgagaccattacctagaacatcataatcgaaaaattcctcaccggtgaccttcctcacctgcgtcagacagagaaagccgagattagcggcggcggcgatggcactcccggcgtcaagctccggcctcttccgcttcgtctccccccgcagtcgtccccagtccaccgacatcgtggccgctgcctcctggggagtcttcgccggcaccgccggcctctacctcgtccagccatttgactggataagaagactttcntcgataancctgaccagaggcatgagtctccangcagaaatgctgcnaatctgcaactttggtacaccacttttgtcggggnatgatcctgatgataactcanncaatatatgagaccctctcgnctttccctggtggatttttatcagatggaggcattccttctgcatgttatcttcacggaggagagggggatcatttgacttgttttttcaaaacccaagaaaactgttgggttcaaccgggttaaatggc

SEQ ID NO: 51239 - protein, 90 aa, Zea mays
  misc_feature: Ceres CLONE 1465453-F
  misc_feature (56)..(56): Xaa is any aa, unknown, or other
  misc_feature (64)..(64): Xaa is any aa, unknown, or other
  misc_feature (69)..(69): Xaa is any aa, unknown, or other
  misc_feature (81)..(81): Xaa is any aa, unknown, or other
  misc_feature (88)..(88): Xaa is any aa, unknown, or other
MALPASSSGLFRFVSPRSRPQSTDIVAAASWGVFAGTAGLYLVQPFDWIRRLSSIXLTRGMSLXAEMLXICNFGTPLLSGXDPDDNSXNI

SEQ ID NO: 51240 - DNA, 642 bp, Zea mays
  misc_feature: Ceres CLONE 1465461-F
  misc_feature: Translation starting site: 216
  misc_feature (122)..(122): n is a, c, t, g, unknown, or other
  misc_feature (413)..(413): n is a, c, t, g, unknown, or other
  misc_feature (600)..(600): n is a, c, t, g, unknown, or other
gctcttaactagtggatcccccgggctgcaggattcgcacgagaccttacctagaacatcctaatcgaaaacactgcgactgtgagcttcgttcgttcagttcatccgtgttcttgtttgcnaggtcgagagagagaagatgtcgtgctgcggaggcaactgtgggtgcggctccggctgcaagtgcggcaacggctgcggaggggtgcagcaagatgtacccggacatggctgagcaggtgaccaccaccacccaggctctcatcatgggtgtcgcacccatcaaggggcacgccgagggcggtttcgagccggccgcggagctgaaaacggcgggtgcagtgcggcggcaactgccagtgcgacccctgcaactgcggcagtgagctaggtgctccaccctgcaggccggncccgagaagctagctaattatataagctaaataaagtataccggcgtccctatgtgtgtttcgaggcagtcagccatttagttgcgtgccatggctgggctgccccgaatctgaaatgatgataatgcctgatgcgggcgtcgggcccggaagccctcccctgcccccctcgggggcttctgggggncaaaccaggggttgggtttgggttccgttggtgccccccccc

SEQ ID NO: 51241 - DNA, 680 bp, Zea mays
  misc_feature: Ceres CLONE 1465467-F
  misc_feature: Encodes the peptide sequence at SEQ ID NO. 51242
  misc_feature (244)..(244): n is a, c, t, g, unknown, or other
  misc_feature (261)..(261): n is a, c, t, g, unknown, or other
  misc_feature (269)..(269): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (298)..(298): n is a, c, t, g, unknown, or other
  misc_feature (484)..(484): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
tccccgcggtggcggccgctctataactagtggatcccccgggctgcaggaattcgcacgagaccattacctagaacatcctaatcgaaaaaatcagcaataatctcgccgtctcatcgcaaaacccagcgccccaaagcgaccccaccgaagcgtcccagcccgaccggaatggcgatggcaccgtgcgcacccgcctccgtctcctccttcccgccccgtcagtgcggaccccttccgctgntcgggcgcgcggcgccncgatcccncccccttcnnnncgcgtggaaggttgcanggtgtgggcgcactactggggtggtcgggaaagccgactacctgaggccccggccccggccccgggggggccccaggaaaaaaaccggcccggggcccaagaatttttgggggggcctaacaaaaaaaaaaccccccattggggggcgggagggggaaaaaaggtttttttaaaaaattttacggnttcnnntcccnnnnnnnnnnnncccccccccaaaaaaagcgtctaaannnnnannnnnnnnnnnnnnnnnnnnnnaaccccccccccttttttttaggtggcccccccccccgggggggggggtttttttattaaaaaattttttttcctcccccctttttaaaagagaggaggaaggaagagtttttttttttat

SEQ ID NO: 51242 - protein, 99 aa, Zea mays
  misc_feature: Ceres CLONE 1465467-F
  misc_feature (25)..(25): Xaa is any aa, unknown, or other
  misc_feature (33)..(33): Xaa is any aa, unknown, or other
  misc_feature (36)..(36): Xaa is any aa, unknown, or other
  misc_feature (37)..(37): Xaa is any aa, unknown, or other
  misc_feature (43)..(43): Xaa is any aa, unknown, or other
MAMAPCAPASVSSFPPRQCGPLPLXGRAAPRSXPLXXAWKVAXCGRTTGVVGKADYLRPRPRPRGGPRKKTGPGPKNFWGGLTKKKPPIGGREGEKRFF

SEQ ID NO: 51243 - DNA, 614 bp, Zea mays
  misc_feature: Ceres CLONE 1465470-F
  misc_feature: Encodes the peptide sequence at SEQ ID NO. 51244
  misc_feature (359)..(359): n is a, c, t, g, unknown, or other
ctggagctccccgcggtggcggccgctctagaactagtggatcccccgggctgcaggaattcgcacgagaccattacctagaacatcctaatcgaaaacgttgcaatgctgttactcttatggttctaaatttggccgccactccaattgaactaagcttgatcgtccctttcttgcgtttgggtgaagccgtcactggcagcgggcacttccccttgacagccgacgcattgaagaatgttctcaccggtcatgcctcaaaggatgtgctaatgagcatcgtccatgcgatgctgggttggcttattgctgcaccaattgtactggtcgtgctgtacgccgtttcgttcccttgtttncaggtcctggtcaacagggtttggtggtattccttcgagccccaggaacccaatcaaagcggtgtagccagtgcctggccggatcctctgcagttacatccgtggacatagctgcagatgtgtcgctgacatccggggccggccgtggcgtggcccccaacgtcagtgactcgacgtatttgcagaagaaacggtttcagccagtgaagcatgctgaatgcccctggattgtgtgcacaaatttctttgtgatgc

SEQ ID NO: 51244 - protein, 155 aa, Zea mays
  misc_feature: Ceres CLONE 1465470-F
  misc_feature (119)..(119): Xaa is any aa, unknown, or other
GAPRGGGRSRTSGSPGLQEFARDHYLEHPNRKRCNAVTLMVLNLAATPIELSLIVPFLRLGEAVTGSGHFPLTADALKNVLTGHASKDVLMSIVHAMLGWLIAAPIVLVVLYAVSFPCXQVLVNRVWWYSFEPQEPNQSGVASAWPDPLQLHPWT

SEQ ID NO: 51245 - DNA, 731 bp, Zea mays
  misc_feature: Ceres CLONE 1465471-F
  misc_feature: Encodes the peptide sequence at SEQ ID NO. 51246
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (472)..(472): n is a, c, t, g, unknown, or other
  misc_feature (553)..(553): n is a, c, t, g, unknown, or other
  misc_feature (554)..(554): n is a, c, t, g, unknown, or other
aaagctggagctccccgcggtggcggccgctctagaactagtggatcccccgggctgcaggaattcgcacgagaccattacctagaacatcctaatcgaaaacgttgcaatgctgttactcttatggttcaaaatttggccgccactccaattgaactaagcttgatcgtccctttcttgcgtttggctgaagccgtcactggcagcgggcacttccccttgacagccgacgcattgaagaatgttctcaccggtcatgcctcaaaggatgtgctaatgagcatcgtccatgcaatgctgggttggcttattgctgcaccaattgtactggtcgagtggtacgacgttttccttccctggtttcaagggcccgggtaaaaaggagttggaggctattccctcgaaagccccagaaccccccccccccacacccttttttaacaatgtgcctggggaaagaaannnnccgccnttttatttccgggggaaaaaatttgggaaaccccctctgttttaaattctggtgcccccccccggggatgggtccccccannggcccccctgcgaccccccctattttttttaaaaaaaaaaagggttttcccccccctataagaactttcgttaaaaccccccctccatattatttggttcgcccacacatctttttttttgaacccccgcacacaaaagatagaaaagaggccaccccccgataaatatttttgtcc

SEQ ID NO: 51246 - protein, 125 aa, Zea mays
  misc_feature: Ceres CLONE 1465471-F
KAGAPRGGGRSRTSGSPGLQEFARDHYLEHPNRKRCNAVTLMVQNLAATPIELSLIVPFLRLAEAVTGSGHFPLTADALKNVLTGHASKDVLMSIVHAMLGWLIAAPIVLVEWYDVFLPWFQGPG

SEQ ID NO: 51247 - DNA, 655 bp, Zea mays
  misc_feature: Ceres CLONE 1465480-F
  misc_feature: Encodes the peptide sequence at SEQ ID NO. 51248
  misc_feature (346)..(346): n is a, c, t, g, unknown, or other
  misc_feature (493)..(493): n is a, c, t, g, unknown, or other
  misc_feature (636)..(636): n is a, c, t, g, unknown, or other
  misc_feature (655)..(655): n is a, c, t, g, unknown, or other
tggagctccccgcggtggcggccgctctagaactagtggatcccccgggctgcaggaattcgcacgagaccattacctagaacatcctaatcgaaaaattccattcccacccgtccatccatcctccgaagctcctcggcagacaagcagcagcgagagaaagcaagcaaggcagaggcagttgtgttgctggtcggtccgtccatggcgcccaagagaccagtgtcggcggcggcggcggcggagcagccgaggctgcgcggcgtgcggaagcggccgtggggccggtacgcggcggagatccgcgacccggtgcggaaggcgcgcgtgtggctgggcaccttcnacacgccggagcaggcggcgcgggcgtacgacgccgccgcgcgcaagctccgcgggcccggcgccgccaccaactacccccgcccggagccgacggcggaagcgttggcggaggctccagcggcaagcgggacccggagcgccgtgntgtccaagtcgtcgtcggcgtcggcgtcggcgtcgtcgtgctccctgccgctggcggccccgtcgctggacctcagcctggcgctgccggctgcgggcggcggccgcaaacccgtaccacctgttcccggacccggcgggcgncggccgccgtgaaccccgn

SEQ ID NO: 51248 - protein, 147 aa, Zea mays
  misc_feature: Ceres CLONE 1465480-F
  misc_feature (16)..(67): Pfam Name: AP2 Pfam Description: AP2 domain
  misc_feature (48)..(48): Xaa is any aa, unknown, or other
  misc_feature (97)..(97): Xaa is any aa, unknown, or other
MAPKRPVSAAAAAEQPRLRGVRKRPWGRYAAEIRDPVRKARVWLGTFXTPEQAARAYDAAARKLRGPGAATNYPRPEPTAEALAEAPAASGTRSAVXSKSSSASASASSCSLPLAAPSLDLSLALPAAGGGRKPVPPVPGPGGRRPP

SEQ ID NO: 51249 - DNA, 658 bp, Zea mays
  misc_feature: Ceres CLONE 1465490-F
  misc_feature: Translation starting site: 117
gcggtggcggccgctctagaactagtggatcccccgggctgcaggaattcgcacgagaccattacctagaacatcctaatcgaaaaaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggccgggaaggtggcggcggctgatggggccgtaaaggaagcggggggaggggctcgtcaagacgctgcagctggggtcgctcttcgggctctggtacctcttcaacatctacttcaacatctacaacaagcaggtcctgaaagttctgccataccctataaacttcaccacagtgcagttttgccgttggaaagtgccatttgctttgtttatggtggatcaccggtatccttaaaaggccaaagatttctgggggcccagctttttggctatcctccctcgagctatcgtccataccatggcgaaatcttttcccaaaactg

SEQ ID NO: 51250 - DNA, 661 bp, Zea mays
  misc_feature: Ceres CLONE 1465499-F
  misc_feature: Encodes the peptide sequence at SEQ ID NO. 51251
  misc_feature (634)..(634): n is a, c, t, g, unknown, or other
cgattgggtaccgggcccccctcgagcctggagtggtaaaggaaactcccatccagccgccaccaggtgcagagtctttcgtcatctcttctccggcgaagaacccccagtcgcccaccaaatcacttgttaaactttgttgaggggtgatggcggtttctttcgcaaacctcagctccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtattaatcacattgatgcgctcgtgaggctgagcggaattactgcagagggccaaggtgtgaaggttgaatcgtcagcacttccttcagccccaactccaaatgttgctgaagcacacgccccagttgctgatgaggacgacgacgatgatgttgacctttttggtgaggagaccgaagatgagaagaacgctgctgaagagcgtgctgcagctagcaaggcttctggtcagaacaacgaatctgggaagtcatcagttttacttgatgtgcagccatgcgacgatgatactgacatggctcactcccagaagnctgttagagtgtccaaatgggaggttt

SEQ ID NO: 51251 - protein, 58 aa, Zea mays
  misc_feature: Ceres CLONE 1465499-F
  misc_feature: SWISSPROT Homolog: EC 6.1.1.16 Cysteine--tRNA ligase
MAVSFANLSSEAGLKKLDEYLLTRSYITGYQASKDDLAVYTSFSSAPSSKYINVARWY

SEQ ID NO: 51252 - DNA, 659 bp, Zea mays
  misc_feature: Ceres CLONE 1465502-F
  misc_feature: Encodes the peptide sequence at SEQ ID NO. 51253
  misc_feature (482)..(482): n is a, c, t, g, unknown, or other
  misc_feature (548)..(548): n is a, c, t, g, unknown, or other
cgattgggtccgggccccccctcgagccactgcagtggtaaagggttccgggtcctactcccgccgcctagaggcctcgccctcccccctccggcgaaaaccgattctctccggcgtttcctggtcccttagtgcaagcaaggacaccgctcctctagcgagctccgttctgaagcggcaagaaagatgattaatcttttcaaaataaagggtcaaaagaaagaggaggcagcaagtgctgctggaaaggcccctgttaagaaacagtctgctggggagctccgtcttcataaagatattagtgagctcaacctgccgaagaccacgtcaatttcttttcccaatggcaaggatgatctgatgaattttgagaccaccatccgacctgatgaaggatattacatgggaggcactttcgttttcacctttcaggtgtccccatcttatcctcatgatcctccgaaagtcaaatgcaagaccanggtgtaccatccaaatattgatctggaaggcaatgtatgtctgaacattctgcgcgaagattgaangcccctgttctcacatcacactggtatttatgggcctgatctttcttttacgcaccaaacgacgaagatcctctgaccacgaagctgcagttgtccttcgtgacaatccaa

SEQ ID NO: 51253 - protein, 119 aa, Zea mays
  misc_feature: Ceres CLONE 1465502-F
  misc_feature (33)..(119): Pfam Name: UQ_con Pfam Description: Ubiquitin-conjugating enzyme
  misc_feature: SWISSPROT Homolog: EC 6.3.2.19 Ubiquitin--protein ligase
  misc_feature (99)..(99): Xaa is any aa, unknown, or other
MINLFKIKGQKKEEAASAAGKAPVKKQSAGELRLHKDISELNLPKTTSISFPNGKDDLMNFETTIRPDEGYYMGGTFVFTFQVSPSYPHDPPKVKCKTXVYHPNIDLEGNVCLNILRED

SEQ ID NO: 51254 - DNA, 706 bp, Zea mays
  misc_feature: Ceres CLONE 1465503-F
  misc_feature: Translation starting site: 122
  misc_feature (300)..(300): n is a, c, t, g, unknown, or other
  misc_feature (376)..(376): n is a, c, t, g, unknown, or other
  misc_feature (381)..(381): n is a, c, t, g, unknown, or other
cgattgggtaccgggccccccctcgagccctgcagtggtaaagggaagcagcaacatctcaagctcagagcctcagagcgccagccaagtcttgcggtcccgaagagcaacgcaacacaagatggtgaaggtcgcattcggaagcgtcggtgactccttcagcaccacctccatcaaggcctacgtggccgagttcatcgccaccctcctcttcgtcttcgccggcgtgggttccgccatcgccttcggggcactgacgaatgggcgcgcgctggaccctgcgggtctggtggcgatcgncgtggtgcacgcgctggccctctttcgtggcgtctccgtggccgcgaacacttcggggggcacttgaaccccgccntgacnttcggcctgggcgtggggggggcaattaacggtcctcacgggcctttttaatgggtggcccaattgttgggcccgcccgggggggccctgttccagggttggggcccccggagaggccctcccccacccgggggttcccgggggccccccaagagtgggggggggggtgtaaaaaaataaaactctttggggctttaaaaaggggggcccccccgccccaaccaaaaaagagggcccccccgaaaaacaccccccccatattttgtttttttttgggggaaaaatccctgcggggggggttttttggggggtaacaaaccccccc

SEQ ID NO: 51255 - DNA, 654 bp, Zea mays
  misc_feature: Ceres CLONE 1465512-F
  misc_feature: SWISSPROT Homolog: EC 2.3.1.15 Glycerol-3-phosphate O-acyltransferase
cgattgggtacgggccccccctcgagcactgcagtggtaaaggggttgttcgccggcgacggctgccggccggcactcgggatcggcgggtcaaagatggcgcgctcattcttgacattctgcgaggagcagctcaggcagccattcccagcgcccaacgagacgaacgccccgccgttccggccggtcatcttccacgacgggcgcctcgtgtgccggcccacgccattcatgtccctcgtcatccttctctggctgccgctcggcgtgctggtcgccttcgtccggatcgccgtcgggctcatggtccccatctggaccgtcccctacatcgcgccggtcttcggcggcgccgtgatcacccacggccgcgcgcctccccccgccaagctcggcggcggctccccctcgggggtcctcttcgtctgcacgcaccgcacgctcatggaccccgtggtgctggcccgccgtgctcggccggcgcgtggcggccgtgacgtactccatctcccgcctctcggaggccctctccccgatcccgaaggggcggctgacgcgcgaccgggacgcggacgcggggcgcatgcccgcggaactggcccgcggcggcaaaagggcggggggccccgaaggcaccacgggccgggacccctt

SEQ ID NO: 51256 - DNA, 656 bp, Zea mays
  misc_feature: Ceres CLONE 1465523-F
  misc_feature: Encodes the peptide sequence at SEQ ID NO. 51257
  misc_feature (569)..(569): n is a, c, t, g, unknown, or other
  misc_feature (635)..(635): n is a, c, t, g, unknown, or other
cgattgggtacggggcccccctcgagccctgcagtggtaaaggtccgcctttaccactgcagtggctcgagccactgcactggtacaggggagtacattacaaccgcgcgcggagcacgcggtcacagaacagagacgacggagagcagccatggccgcaggagccgcgttgtactaccacccaggcgccgggaaggtgagcctcgaggcggtcgtcccgtcctctccgtcgctggccctgaggctatcgcagagcatggtgctgtgcgtcagcatcagccggtggtggatgaggcgaagatgggaggggaaggctagcatcgtcagcagcaggtcaagggcaagagcaagcgcaaggcctgccttgttctcccctgtggccatggactggcaggagtgctccaccgagcttgaagttgatgttccatgctcggtggcctatcagtgttactcataacgggagagtattcctcagtggatgccattcatctcgtctgtcaagatccttgaatatcaacctgatctttcgcggtggactctgaactacgaggtgcttgcgcggtatgtanaattttcttggcttgcacgtaacgtgacacctattagaaaccacaagatcccttggcgatctcttngaggtcttgctaatagaggtg

SEQ ID NO: 51257 - protein, 101 aa, Zea mays
  misc_feature: Ceres CLONE 1465523-F
MAAGAALYYHPGAGKVSLEAVVPSSPSLALRLSQSMVLCVSISRWWMRRRWEGKASIVSSRSRARASARPALFSPVAMDWQECSTELEVDVPCSVAYQCYS

SEQ ID NO: 51258 - DNA, 672 bp, Zea mays
  misc_feature: Ceres CLONE 1465532-F
  misc_feature: Translation starting site: 134
  misc_feature: Pfam Name: Cation_efflux Pfam Description: Cation efflux family
cgattgggtaccgggccccccctcgagccactgcagtggtaaaggatcgccccgagatccatcactcgcattctcaccggcgagctaagcatccgcgcgcctcctctccaagcagaccaccaccgccggaagcatggccgcgccgctgcttcggcaatggcgcagcctcgccgtgctcggcgccctcctcgggctccacctcatcgccgccgtggcgcagtcgccgccaactgcacccacgacccctgccgcacccacgacccctgccgcacccacgactccggctacacccacgacccctgccgcacccacgactccggccgcacccacgacccctgccacacccacgactccggccgcaccgacgacccctatcgcacccacgactccggctgcaccgacgacccctgccgccaccccggtcgcgccagcaaacccgccgccggttccgacaacgccagcgcccaccgccaccccagtcgcgccagcgaaaccgcccccggtcgcgacccgcggccgagcccggccaaaccccgccgggggaccccgccacaagtgaaggcctccctcccgttaaggcctccacccggcgaagccgcccgggggtggctcccaacccgcccggggctgcccaccccgctgcaggcccccttcgggcagaatggcacacag

SEQ ID NO: 51259 - DNA, 659 bp, Zea mays
  misc_feature: Ceres CLONE 1465535-F
  misc_feature: Encodes the peptide sequence at SEQ ID NO. 51260
  misc_feature (659)..(659): n is a, c, t, g, unknown, or other
cgattgggtaccgggccccccctcgagccactgcagtggtaaaggaaatcctaagctagccagctgagctcgctcccagtccaagtgccggccccaccaccgcagctcgatcacaccatgagcaaggagaagcaccaccgcgactggatcctccggcgctgctgcggctccatcgccgcctgcatcctgacgctggccgccgtcttcggcttcatcgtgctcgtcatcttcctggcgctgcgcccctccaagccgtccttctacctgcaggacgtgcagctgcgctccatcgacctcagcgacccagcgctctccctcgacctccaggtgacgatcgcatctcggagcccaaacgagcgggtgggcgtgtactacaagacgctggacgcgttcaccacataccgcgacgaggctgtgacagtacccgtgtcaatgccagcgatctaccatggccacaagaacgtgtcagtgtgggtcactggtcatgtcgggcgacgcggtccccgtgccgcagtacgtggcgcacgccatgaagcatgacatctaagcgggatacgtgctgcttcacgtcaggctggactgacgcgtcaagtgtccggtcggcagctgggtctcgggcaaataccacctcttcgtcaattgccccgcgctgctcgccn

SEQ ID NO: 51260 - protein, 140 aa, Zea mays
  misc_feature: Ceres CLONE 1465535-F
  misc_feature (38)..(139): Pfam Name: Hin1 Pfam Description: Harpin-induced protein 1 (Hin1)
MSKEKHHRDWILRRCCGSIAACILTLAAVFGFIVLVIFLALRPSKPSFYLQDVQLRSIDLSDPALSLDLQVTIASRSPNERVGVYYKTLDAFTTYRDEAVTVPVSMPAIYHGHKNVSVWVTGHVGRRGPRAAVRGARHEA

SEQ ID NO: 51261 - DNA, 649 bp, Zea mays
  misc_feature: Ceres CLONE 1465557-F
  misc_feature: Encodes the peptide sequence at SEQ ID NO. 51262
cgattgggtacgggccccccctcgagccctgcagtggtaaaggggtctctccggtgcgctcgccgctgtcgaggtccacctcaacagcgagcgccgccaccacgtgttccgccgggagcacgacgcgctccggggcggccggcacccgtgcatcatctgcctcctagacttctgcgaccaacaagatgaaggcgtgctggtgctctacttctcggagaacggtaacctgcacgagcggctccacggaggtggcaaggccgcggggacgatgccgtgggcacggcgggtgtcagtggcgctgcatgtgacgcgcgcgctcgagcacctgcacgaccgctgcgagccgcatgtggtgcacggcgacgtgaaggcgtcaaatgtgctcctgcacgcgtccatgtccaccaagctgtgctacttcgggtcgccgcggatgggattctcggccgccgtccgcccgcgctcgtccgaatgcaccatgttgggctcgccaggctacatctatctgcactacatccgctgcggcgtggtcaccaacaagagcgacgtgtacagcttacgggatctgctcctgcagctgctcacggagatggaggctttctgcgctgaagtacgtcggcttctcagctcggtcgtcgcgccggaaata

SEQ ID NO: 51262 - protein, 127 aa, Zea mays
  misc_feature: Ceres CLONE 1465557-F
  misc_feature: SWISSPROT Homolog: EC 2.7.11.1 Non-specific serine/threonine protein kinase
MPWARRVSVALHVTRALEHLHDRCEPHVVHGDVKASNVLLHASMSTKLCYFGSPRMGFSAAVRPRSSECTMLGSPGYIYLHYIRCGVVTNKSDVYSLRDLLLQLLTEMEAFCAEVRRLLSSVVAPEI

SEQ ID NO: 51263 - DNA, 494 bp, Zea mays
  misc_feature: Ceres CLONE 1465572
  misc_feature: Encodes the peptide sequence at SEQ ID NO. 51264
atggggatctcgagcatgccggagccgcgggacagcctgctggggtacctggtgtacaacgcggtggtgtcgatcgcggcgctggcggggctggtgcgggcggcgctggtgttcctggacctgcaggccgcgcagctgcccgggggcgcgggcgcgggcgcggacgacgaccgtctcgcggcgtcgggccccggcctgggcctggcggagcggttcctgagggccttccggccggcgctgtacggggtgctggtgtccacggcgtgcggcgcggcggaggcggccgcgggcgacgacgactgcagcgtgtgcctggccgggttcgaggcggaggccgtggtgaaccggctcccctgcggccacctcttccaccgcgcctgcctcgagacctggctccggtacgagcgcgccacgtgcccgctctgccgcgcccacgtgcccctccccgccgacgagacgccggtgctccgctacccggagctcgagtgatccgg

SEQ ID NO: 51264 - protein, 157 aa, Zea mays
  misc_feature: Ceres CLONE 1465572
  misc_feature (96)..(137): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MPEPRDSLLGYLVYNAVVSIAALAGLVRAALVFLDLQAAQLPGGAGAGADDDRLAASGPGLGLAERFLRAFRPALYGVLVSTACGAAEAAAGDDDCSVCLAGFEAEAVVNRLPCGHLFHRACLETWLRYERATCPLCRAHVPLPADETPVLRYPELE

SEQ ID NO: 51265 - DNA, 705 bp, Zea mays
  misc_feature: Ceres CLONE 1465574-F
  misc_feature: Encodes the peptide sequence at SEQ ID NO. 51266
ctccccgcggtggcggccgctctagaactagtggatcccccgggctgcaggaattcgcacgagaccattacctagaacatcctaatcgaaaaaaaaaatcccagacgccacgccacccaacacatacaaacacacgcacgcgcgcgcgcgcgcctcccgctgttccgcaaaacaaaggaaacgaaggagaggaggccatggcgccgagaacgtcaaagaaaaccatggcaccggcggcggccgctgccacggggctcgcgctcagcgtcggcggcagcggcggggccggcggcccgcactacagaggcgtgaggaagcggccgtggggccggtacgcggcggagatccgcgacccggcgaagaagaagcgggtgtggctcggcacctacgacacggccgaagacgccgcgcgggcctacgacgcccgcgcgcgcgagtaccgcgcgcccaggccagaaccacttcccctaccccttcgggcgggcccttctccccagccgggttgccggaaaacaaacggaagccccggtaaggtctttcaaagggaccgcaagggccccatggagggcatggccctcccccccttccctgaaatgggacttgttcccccggggggggggcccggccccagggaaagggggccttccccccctaaacttttccttttgggaagatcccccgtaacccccccgtaaaatttttttg

SEQ ID NO: 51266 - protein, 165 aa, Zea mays
  misc_feature: Ceres CLONE 1465574-F
  misc_feature (33)..(84): Pfam Name: AP2 Pfam Description: AP2 domain
MAPRTSKKTMAPAAAAATGLALSVGGSGGAGGPHYRGVRKRPWGRYAAEIRDPAKKKRVWLGTYDTAEDAARAYDARAREYRAPRPEPLPLPLRAGPSPQPGCRKTNGSPGKVFQRDRKGPMEGMALPPFPEMGLVPPGGGPGPRERGPSPPKLFLLGRSPVTPP

SEQ ID NO: 51267 - DNA, 739 bp, Zea mays
  misc_feature: Ceres CLONE 1465578-F
  misc_feature: Encodes the peptide sequence at SEQ ID NO. 51268
  misc_feature (318)..(318): n is a, c, t, g, unknown, or other
  misc_feature (354)..(354): n is a, c, t, g, unknown, or other
aaagctggagctccccgcggtggcggccgctctagaactagtggatcccccgggctgcaggaattcgcacgagacaattacctagaacatcctaatcgaaaagatctggctgcctcggtcgatttctaattctcctcgcgagcccaaaccctaaacctaaacctttcacccgccgccgccgccaccaccagcactgccactccgccaccaccgtcccgaagccccctcccagcgccatcgacttcatctcggattgaagcaatgtcgtcggacgatgaggtcagggaggagaaggagctcgacctctcctccacgacngtgtcaccaagtacaaggctgcccgcgaaatcctcnacacgctctgaagatgttgtgtctcagtgcaagccaaaagtcaagattgtttgacttttccaagaagggcgactcttttcataagaaaagcaactggggaatgtttacaaaaacgccaaaaaggaaaattgaaggggggtatggtttcccaaaccgggggatcccgccaaaggaacagttttgcccctttctccccgcttggaacccaaaaaagccccttctgggaaaaaaaagacaggggaaaaattaaaaagggggggccaaataaaggggttttttggggggggggcgccccaacctttgaaaaaaaaaagggccccccccacaaaaaaagctggttttaattttttttttttccccaaacacaaaaaaaaaacgcgggggg

SEQ ID NO: 51268 - protein, 48 aa, Zea mays
  misc_feature: Ceres CLONE 1465578-F
MSSDDEVREEKELDLSSTTVSPSTRLPAKSSTRSEDVVSQCKPKVKIV

SEQ ID NO: 51269 - DNA, 697 bp, Zea mays
  misc_feature: Ceres CLONE 1465582-F
  misc_feature: Encodes the peptide sequence at SEQ ID NO. 51270
aaagctggagctccccgcggtggcggccgctctagaactagtggatcccccgggctgcaggaattcgcacgagaccattacctagaacatcctaatcgaaaaacagcttaccgaacctcgagtcctctaccagcacccaaatcgattaattcttcccccctctccgatctcgacgcgcaccgatgcgggcgatgtcgtcggcggataatggcatgctgctggcacggctgcccggggcatcgcgcgttcctggcggcggccgcaagggggccagttggtggacgagcccacgtcaacaggaacgccccaaggggtacctcttctaccggccgccgccgcctccgggggaatctctcaagtgggaggattgggagctgccctgctacatgacctccttcctcaccgtcgtactcctctgcgacggcctcaacgcttaatcccaaccttacaatcgaaacatgcgggcaccacaaggtgctcgagcgcctccagcattcaggagctcggcgctgccgacgcccaggccgagtgatccgcgcgtctcaggtcctctagaactctcggctgcctctgatttgattccactaacatggtcacaatgtgcggtcctgaatgtgctggacttctggtattgatggaacattagctgtacactctgctgctaggtttgctgctctgcttagatctctgccagtga

SEQ ID NO: 51270 - protein, 84 aa, Zea mays
  misc_feature: Ceres CLONE 1465582-F
MRAMSSADNGMLLARLPGASRVPGGGRKGASWWTSPRQQERPKGYLFYRPPPPPGESLKWEDWELPCYMTSFLTVVLLCDGLNA

SEQ ID NO: 51271 - DNA, 775 bp, Zea mays
  misc_feature: Ceres CLONE 1465592-F
  misc_feature: Encodes the peptide sequence at SEQ ID NO. 51272
  misc_feature (341)..(341): n is a, c, t, g, unknown, or other
  misc_feature (436)..(436): n is a, c, t, g, unknown, or other
  misc_feature (442)..(442): n is a, c, t, g, unknown, or other
aaagctggagctccccgcggtggcggccgctctagaactagtggatcccccgggctgcaggaattcgcacgagaccattacctagaacatcctaatcgaaaaacaagaaaccaaaccgtgacgcagcgcagccatggggaagcagctctgcgacatgcaccgctcgcgccgccgcgcccgcatcgtcgccgccgccctcctctccgccttcgccgctgctgccgccgcgctcacggtgtacctcgtcttccgtccgctgaagccgcaggcctccgtggtgcgcgtcgccgtgtaccgcatggccacggccgccgggaactcctcggaggggcgggcccggncgccgtacacgctcgcggcgagcgcgcggttcacggggctgctgcacaacccgagcgacggcgcgtgggtgttctacgacggcctcttcccctangtgacntaccccgggaaaatggtgggccccccccgggcccctccccggggtggccagagccccggggcccaatttgggcttgccccccaattcgccttttgggggggcggtgccctttccggtgtccaaaaacccccccaaaatctttgaagggcaaattccccggggccccgggaaaaaaccccctctctttttggggggcgggtaaaaattaataggcgggccattaaaaaaagggaggggggggataaaaccggcggagaaaaccccccccccctgggggggggccccccccccgggaaaaaaaaaaggggggggaggtcccccgttcccaacccc

SEQ ID NO: 51272 - protein, 150 aa, Zea mays
  misc_feature: Ceres CLONE 1465592-F
  misc_feature (70)..(70): Xaa is any aa, unknown, or other
  misc_feature (101)..(101): Xaa is any aa, unknown, or other
MGKQLCDMHRSRRRARIVAAALLSAFAAAAAALTVYLVFRPLKPQASVVRVAVYRMATAAGNSSEGRARXPYTLAASARFTGLLHNPSDGAWVFYDGLFPXVTYPGKMVGPPRAPPRGGQSPGAQFGLAPQFAFWGGGALSGVQKPPQNL

SEQ ID NO: 51273 - DNA, 687 bp, Zea mays
  misc_feature: Ceres CLONE 1465593-F
  misc_feature: Translation starting site: 159
  misc_feature: SWISSPROT Homolog: EC 3.1.27.1 Ribonuclease T(2)
ctccccgcggtggcggccgctctagaactagtggatcccccgggctgcaggaattcgcacgagaccattacctagaacatcctaatcgaaaaagagttgtggtacagttgtactgagctgagctgccggaggcagaataggagaggcaggcgatgacgatggcgacgaaggcggcgtgcgtgctggcggtgtgggtgctcgtcgcatcgggcctgtccgacctgggctcagcgcgcgcgcccctgggcagcaagccgcagcgggagttcgactacttcgcgctctccctccagtggcccggcaccatctgcgcctccacccgccactgctgcgccaccaacggctgctgccgctcggagcctctccagacgttcacgatccacgggctatggccggactacgacgacgggacctggccgtcgtgctgccgccgcacccaattcgagatggacaagatattgctcactgaaggaggtgcttgacaagtactggccgtccctctactgctccaaatctggaacatgcttcagcggcaagggactcttctgggctcacgagtgggagaaacatggaaccctgctctgccccttgtggttcaggatgaattacagtatttcacccttggccttggacttctacttccacgttatacgttacggaaatggctgtcagtggatgggatacagt

SEQ ID NO: 51274 - DNA, 750 bp, Zea mays
  misc_feature: Ceres CLONE 1465594-F
  misc_feature: Encodes the peptide sequence at SEQ ID NO. 51275
  misc_feature (392)..(392): n is a, c, t, g, unknown, or other
  misc_feature (435)..(435): n is a, c, t, g, unknown, or other
caaagctggagctccccgcggtggcggccgctctagaactagtggatcccccgggctgcaggaattcgcacgagaccattacctagaacatcctaatcgaaaaatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagggcgcgctcctgtcgggccccatcgccgtcaacttcatctggtacnggcgacttctcggcgccgcagcgggcggcgatcaccggactcntctccgtcctgaagggcgggggcccccggcggggggcaaccggaaacgttcgggggcaccttggtcaagacgggggcgaaaaaaacccccgcctcaaaggggcgtttcggggggtgggcctcgttccccaagcctaaaaaggaattgccccccccagagggccccaaagaaaaaggaattttcttgctctcccccccgggggaaccccaaggccccttataagggggtttaccgccccacaaaggggggggggggggggttttaaaaaaccgggggggggaggggggggcccccccgggcgccctcctggtgtgc

SEQ ID NO: 51275 - protein, 161 aa, Zea mays
  misc_feature: Ceres CLONE 1465594-F
  misc_feature (60)..(60): Xaa is any aa, unknown, or other
  misc_feature (74)..(74): Xaa is any aa, unknown, or other
MACYNTASLAATLLAFALTFQACLAGRRLTALVQEPAITMRYHKGALLSGPIAVNFIWYXRLLGAAAGGDHRTXLRPEGRGPPAGGNRKRSGAPWSRRGRKKPPPQRGVSGGGPRSPSLKRNCPPQRAPKKKEFSCSPPRGNPKAPYKGVYRPTKGGGGGF

SEQ ID NO: 51276 - DNA, 728 bp, Zea mays
  misc_feature: Ceres CLONE 1465602-F
  misc_feature: Encodes the peptide sequence at SEQ ID NO. 51277
  misc_feature (393)..(393): n is a, c, t, g, unknown, or other
  misc_feature (440)..(440): n is a, c, t, g, unknown, or other
aaagctggagctccccgcggtggcggccgctctagaactagtggatcccccgggctgcaggaattcgcacgagaccattacctagaacatcctaatcgaaaaatcggattcacggaccaatcctcgtcttctcccaattctcattgcatcgaatcgggctcgatgctgcccctctccctcttcgtttccctcttggtgctccctctcccccacgcatccgccgacggcgacatctgcatcatcggcggtggcatctccggcgcctccaccgccttcttcctcaccagctacaccagcaccctcggtggagcgcagctgcacgtttttgagcgccgtcagaaggtgggcggccgcctgggcaccgtcactctcgcgggcgacagcttgcaaggncgagggctcatcatccacccccgcaaactccaggaggcgcagttacnccgaccatctgggactcgccgtgaaaaccggtcgctaaggcaaacgctaacactgggtagggatctgggaaaggaaaaagtttcgttttcaaaacggcccgcccacttcctgccgggactttctggggggggggcaaagttgaaaaattcccacaaatcggtggtgttgttaagggaaaatggccctgccccggcaaaaaaaggaaaattttttcaagaaaagtgttggggggtttaacccttttaaaaggggaggggaaccccccccgggtttcccccgggagaaaa

SEQ ID NO: 51277 - protein, 171 aa, Zea mays
  misc_feature: Ceres CLONE 1465602-F
  misc_feature (93)..(93): Xaa is any aa, unknown, or other
MLPLSLFVSLLVLPLPHASADGDICIIGGGISGASTAFFLTSYTSTLGGAQLHVFERRQKVGGRLGTVTLAGDSLQGRGLIIHPRKLQEAQLXRPSGTRRENRSLRQTLTLGRDLGKEKVSFSKRPAHFLPGLSGGGAKLKNSHKSVVLLRENGPAPAKKGKFFQEKCWGV

SEQ ID NO: 51278 - DNA, 689 bp, Zea mays
  misc_feature: Ceres CLONE 1465603-F
  misc_feature: Encodes the peptide sequence at SEQ ID NO. 51279
acaagctggagctccccgcggtggcggccgctctagaactagtggatccctcgggctgcaggaattcgcacgagaccattacctagaacatcctaatcgaaaatcttcctctcactatcctttctcgatcttgttccttgcaaccaccgtcggtcgcgccccacgcccgccccaccacccgcccgccgcgcccgcccccacccaccgtgggctttccccgcaccgccgacgcccccatccgccagtcggccgccgcgcccccgcccgccgtgcccctcaccgccccgccccaccgcgcccctcgtcggttggtgctcgtggccatggcggtggcaaaggtcaaatcggtcgccgtctccgttagtcacaagtgtcggaatatcttggccaccggttgggaagcgcacctcaacactgtcaaggctgacaacaagggaagcaagaatgagatttacacgtcgagggtgcactacatgatccataagggcacaccctacttgattgtccccgagaacgacatgcacaacattaacattataatcgatgagcgggggtctcttgcagtattcagtctgattcgtgaccgagttgcgagcttattgaagccatcgaaggatgagattgaagctgctcgaatggcagcgatcaacaagaaattaagcgtgtattgactgaagtcctttcgaagc

SEQ ID NO: 51279 - protein, 115 aa, Zea mays
  misc_feature: Ceres CLONE 1465603-F
MAVAKVKSVAVSVSHKCRNILATGWEAHLNTVKADNKGSKNEIYTSRVHYMIHKGTPYLIVPENDMHNINIIIDERGSLAVFSLIRDRVASLLKPSKDEIEAARMAAINKKLSVY

SEQ ID NO: 51280 - DNA, 663 bp, Zea mays
  misc_feature: Ceres CLONE 1465613-F
  misc_feature: Encodes the peptide sequence at SEQ ID NO. 51281
tggagctccccgcggtggcggccgctctagaactagtggatcccccgggctgcaggaattcgcacgagaccattacctagaacatcctaatcgaaaagctcgcaccgcttaatcaacaacctgacaagttagctacccgcgcagcgccgcgcgccatggctacgatgaaccaccgcattgtgcccctcctgctggtcgcagccacactgctcgcgcaggccgcggcctgcccctactgcccgacgccgaagccgccgccgcctccgccgccgtcgtcgtcgtccacgccgtgccctcccccgccctactcgccgtcgccgtccacgccgacgggtaagtgccccgtgaacacgctcaagctgctcgcgtgcgtggacgcgctcaacggcctcgtgcacgccgtcatcgggaccaaggccagcgacacctgctgcccgctgctctccggcgtggccgacctcgacgccgcgctctgcctctgcaccaccatcaagggcaaggcgctcagcgtcagcctcgtgctccccgtcgccatctcggtgctcgtttacgagtcgggaagcatgttgcctccagcctccagtgcccgtaatacatcagctgcatatatgtgccactatgatgtatcccccccactaatcttatccggatggctgcatcatg

SEQ ID NO: 51281 - protein, 169 aa, Zea mays
  misc_feature: Ceres CLONE 1465613-F
  misc_feature (62)..(148): Pfam Name: Tryp_alpha_amyl Pfam Description: Protease inhibitor/seed storage/LTP family
MATMNHRIVPLLLVAATLLAQAAACPYCPTPKPPPPPPPSSSSTPCPPPPYSPSPSTPTGKCPVNTLKLLACVDALNGLVHAVIGTKASDTCCPLLSGVADLDAALCLCTTIKGKALSVSLVLPVAISVLVYESGSMLPPASSARNTSAAYMCHYDVSPPLILSGWLHH

SEQ ID NO: 51282 - DNA, 849 bp, Zea mays
  misc_feature: Ceres CLONE 1465616-F
  misc_feature (11)..(11): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (849)..(849): n is a, c, t, g, unknown, or other
ttttgctcctntattcgttaggggagtcaccnnnnnnnnnnnnnnnnnnnnnnaaaaactggagctccccgcggtggcggccgctctagaatagtggatcccccgggctgcaggaattcgcacgagaccattacctagaacatcctaaccgaaaaagaggagaatcttccgtctgctcccgccgccgccgcagccaccgcctgcctcgagccgccgtcgccatggggagaacacctgggaggtgctatcgcgagataaagaggaaggcgtaccccatgtcaaggtattgccttggagggcgtgaccctagaagcaggatctctgatgggggcctaaggaagaagggtgtgcaggagtaggtttcactgtgtggcagattgtcgtgatgggagaaacgagaaaggggtgcatgtgaagggtctttgatggttggcccgcaccggccccgcgggggtgggggttgatttaatatttgtcgggaaaaccccccccccctcccccccccaacgggccatgtggttgacacccgagtcccattgggcctctcgggagtgaaacaacggttggcttttcaccggggcgcggggccggggaacgaggaaatccaaatctgggaaatccacgtcccgcaagggtgaggcgaattccggagaaaggcaggccctgcggccatctctggaagtcactaagtgaacgggacctctgccttgcgcaggtggaggagattatatgccagaggaaggggagcagccgccgaggaccgaggaaagggagatcaacaggcaccaatccgtgccaccagtgtagcgccttgaggcgtggcacacaggctcccggccgcaaacacan

SEQ ID NO: 51283 - DNA, 805 bp, Zea mays
  misc_feature: Ceres CLONE 1465618-F
  misc_feature: Encodes the peptide sequence at SEQ ID NO. 51284
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (61)..(61): n is a, c, t, g, unknown, or other
tgttgaatgaagagtgggcccccccaggatatnnttnnaaatntnnnnnnntttaattttnttcaaactgggactccccgcggtggcggccgctctatactagtggatcccccgggctgcaggaattcgcacgagaccattacctagaacatcctaatcgaaaaaccacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggaagaggtggctaagactgtaaatgggaaaaagctcagtggtgaagaagggaaaccttcgggctggttgaaaacaaaaatgggattgggggttcccccccccttttgggggcactttgtttccccccttgggaaaaaagggggaaacccccgaaaaaaacaaaaaaaatttggaaaaccctttacagggaaatatccgggggaaaacttccgaggggaaaaggggccaaaatttgggggggaggggaaacttaagaaggtggggtagcccccccccaggggggcccctcccccggggggggggaaaaataagaggcttttccccccccacaagaaaggggggggactgtacacccgggttcttggggaaaaaataaaaaaaacggcgcccaaaaaaaaaaaaaaaattttctttaaaaacacaaagagggggcggccaaaagaaggggccaccaaaaaaattcgttgggcaagaa

SEQ ID NO: 51284 - protein, 114 aa, Zea mays
  misc_feature: Ceres CLONE 1465618-F
MSREENVYMAKLAEQAERYEEMVEYMEEVAKTVNGKKLSGEEGKPSGWLKTKMGLGVPPPFWGHFVSPLGKKGGNPRKKQKKFGKPFTGKYPGENFRGEKGPKFGGEGKLKKVG

SEQ ID NO: 51285 - DNA, 691 bp, Zea mays
  misc_feature: Ceres CLONE 1465619-F
  misc_feature: Encodes the peptide sequence at SEQ ID NO. 51286
  misc_feature (377)..(377): n is a, c, t, g, unknown, or other
ctggagctccccgcggtggcggccgctctagaactagtggatcccccgggctgcaggaattcgcacgagaccattacctagaacatcctaatcgaaaaattctttcttcctgccctgccctggtgtcctgacctgtccacctctcctccaactccgatcctctccgccatttccctgcgcttctggaactgttgttctaatcccccaaaccctaacggtctatcctctgcgctgctggcgtcaccaccgccggagctgcggccatgaaagccttccggttcctcggggacatgaccctactcttctcgatcctcgtgctcttcctcaagatctacgccaccaagtcctgctcaggtctgtcaaagtatacgcacganctgtacttgttggtggtcatagacgagtacctcgacctactcacggactacgtctcgctctacaactcagtgatgaagatgtgtccatcaacagactcgcggcgattgtgtggtgcatgctcccgcgcccgcaggttcggaggacttactactaggagcaagacaccttccgccaagcggtgctactcgccaccgcgttactgtttacgttgatgttccacgaaccggtcaccttgcaagagatatgccggggcttttcccatctttttagaaggcaggggcaattcccccaccggttggtgttaccccgaaca

SEQ ID NO: 51286 - protein, 108 aa, Zea mays
  misc_feature: Ceres CLONE 1465619-F
  misc_feature (1)..(109): Pfam Name: ER_lumen_recept Pfam Description: ER lumen protein retaining receptor
  misc_feature (38)..(38): Xaa is any aa, unknown, or other
MKAFRFLGDMTLLFSILVLFLKIYATKSCSGLSKYTHXLYLLVVIDEYLDLLTDYVSLYNSVMKMCPSTDSRRLCGACSRARRFGGLTTRSKTPSAKRCYSPPRYCLR

SEQ ID NO: 51287 - DNA, 706 bp, Zea mays
  misc_feature: Ceres CLONE 1465620-F
  misc_feature: Encodes the peptide sequence at SEQ ID NO. 51288
  misc_feature (393)..(393): n is a, c, t, g, unknown, or other
aagctggagctccccgcggtggcggccgctctagaactagtggatcccccgggctgcaggaattcgcacgagaccattacctagaacatcctaatcgaaaaattgccgacgcaagctgcgactgaacctccgtggcgacggaggagacggccatggtggcagcgatggagctcgagatcctaggcatgaatttcgggtgcgtcctcgcggctctgtccgacgccaagatccccgacaagggctgcctgctcccgctcatctctaagctgctcggctacgccatcgtcgccgcatccaccaccgtgaagcttccccagatactgaaaattttgaagcatggaagtgttagaggactaagtgtggcatcctttgaacttgaggttgtcggctacncaattgctttggcatattgtatccataagggacttcccttttctccttatggggagctagcttttctgttaatccaagaaattattttggttgcagtcatttactattactcccccccatggggaaccaaaacatggatgaaagctttattatatgtgggaatggctccaacggcttttgggtggaaaaataaatcctgctctttttggaagtcctttttgcttcacagaatgggtatcttcttttttgctacactcccccggatatgggaaaattcttcgaaaaaaagggaccgggggagctaatcttcctt

SEQ ID NO: 51288 - protein, 181 aa, Zea mays
  misc_feature: Ceres CLONE 1465620-F
  misc_feature (33)..(99): Pfam Name: PQ-loop Pfam Description: PQ loop repeat
  misc_feature (81)..(81): Xaa is any aa, unknown, or other
MVAAMELEILGMNFGCVLAALSDAKIPDKGCLLPLISKLLGYAIVAASTTVKLPQILKILKHGSVRGLSVASFELEVVGYXIALAYCIHKGLPFSPYGELAFLLIQEIILVAVIYYYSPPWGTKTWMKALLYVGMAPTAFGWKNKSCSFWKSFLLHRMGIFFFATLPRIWENSSKKRDRGS

SEQ ID NO: 51289 - DNA, 671 bp, Zea mays
  misc_feature: Ceres CLONE 1465621-F
  misc_feature: Encodes the peptide sequence at SEQ ID NO. 51290
aagctggagctcaccgcggtggcggccgctctagaactagtggatcccccgggctgcaggaattcgcacgagaccattacctagaacatcctaatcgaaaaacctgtgcccgactcaaccaatctactcgctgctacaacagagtttgcctgttgccttgcttccacctcccggctgcagctgcacctgctgctcgatcggatcggccgcgcgcggcatgtcgaccaccacccccaccaacgccgcctcccagcagggcgacgacgctgcggctggccgcgcggacaagaagccggcgcaagagacggtgacgaagacggtgcagacggtggaggtgcggtcctcggcagggcagcccgacgaggagggcgtgctcaagcccgtgaaggtggtgcacgagatccccgccaaggacagctccggcgtcaagcaggactaggactagctaagctgcctagctcgatcgatcatctagctaggatcgatgctgctgctgctaaactgagtggatttgatgctgctgcggtcaaaaatcttatcgtcatttccaccccccaaccagatcccagctagaatttgcaaaaaaacaaatgttgcgttggatccctaagtgaaattagggaatctgggcggcctgcccccttcatttgaaaaacatgtaactaaaaaaa

SEQ ID NO: 51290 - protein, 73 aa, Zea mays
  misc_feature: Ceres CLONE 1465621-F
MSTTTPTNAASQQGDDAAAGRADKKPAQETVTKTVQTVEVRSSAGQPDEEGVLKPVKVVHEIPAKDSSGVKQD

SEQ ID NO: 51291 - DNA, 691 bp, Zea mays
  misc_feature: Ceres CLONE 1465634-F
  misc_feature: Translation starting site: 166
cagctggagctccccgcggtggcggccgctctagaactagtggatcccccgggctgcaggaattcgcacgagaccattacctagaacatcctaatcgaaaaagctggagggcaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtaaaacgcgcgcgcgtgcgcctgtgctgcctgatccggatgcgcgcctaattaatctgccgcatatgcgcgcctttctgggttttactttgcaggtgggcggagctggagagcggagcaacaaccatcgcgttcacgccgctgcaccagcgggagacggacgagctgtcgggggcggtgcagctgccggactcgtcggccgccggccggggctccgtggaggtctgctttccctacgcggacgtcgacgccgcgtacaagcgcgccggggacaacggggcggtggccgtgagccccccggaagacagccctggggacaaaaatcccgcttcgtggggaacatggacggcaactccgggggcttgggagctacgtgcgagaatagtccaattccgctg

SEQ ID NO: 51292 - DNA, 667 bp, Zea mays
  misc_feature: Ceres CLONE 1465647-F
  misc_feature: Encodes the peptide sequence at SEQ ID NO. 51293
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
acccgcggtggcggccgctctagaactagtggatcccccgggctgcaggaattcgcacgagaccattacctagaacatcctaatcgaaaaatgctcttcgcccctcgcgcttaccgctgccgcgcctcccgacttgccgcctccgcctagctccgggctctccaatggcctccatgctcgccatcctcaggccctccgcgccggccccgctcgcggggcgccgggccagggctgccgcgccggcgaccgcgagggtggcgctatcttccagatctaggtattcgtcggtcagggtgtcgctcggctccgaggttgcagtgggcgccgacgcgctcttcgccgactataagcccaccaccgctttcctcttcccggnnncaggtgcccaacccgtgggaatggggcagaagcctcaaagggttccaccagctaccaaattgttcaacccagcaaaatgaaacccttgaattaactggcgggatctttgccccaatgggacaaaaaaaaagtttgcctccaaaaatggacaccccccccgttaatttttccccccccctttgcacaaataaaggcccccaccgcccccccggggggggcccacaaggggaataacccccggaaaaggccccagggggccccccctgggggaaaaaaaacccccctcttt

SEQ ID NO: 51293 - protein, 97 aa, Zea mays
  misc_feature: Ceres CLONE 1465647-F
  misc_feature (71)..(71): Xaa is any aa, unknown, or other
  misc_feature (72)..(72): Xaa is any aa, unknown, or other
MASMLAILRPSAPAPLAGRRARAAAPATARVALSSRSRYSSVRVSLGSEVAVGADALFADYKPTTAFLFPXXGAQPVGMGQKPQRVPPATKLFNPAK

SEQ ID NO: 51294 - DNA, 586 bp, Zea mays
  misc_feature: Ceres CLONE 1465649-F
  misc_feature (236)..(236): n is a, c, t, g, unknown, or other
  misc_feature (237)..(237): n is a, c, t, g, unknown, or other
ggagctccccgcggtggcggccgctctagaactagtggatcccccgggctgcaggaattcgcacgagaccattacctagaacatcctaatcgaaaaagggctcaaaactaacttcaaaaaaatcacccactaaaagcaccttcctcttcctcttcctccgcccccaatccccctcgtctcacaaccctagctgcccccgaatcatggatcctacaaatccaggaccccgccgccgnnctcagtcatggttgccccgttgcctaccctccgcggcttaccctcccggtggtggccgccgggccgggccctacccggccaagttttaaccaccgccgggtggtggccgggcccaaaagggggggggccgcccaaaaaaaaaaatttaaaatttctggggggaaaaatccccccgaaatgagggcccccccccccttttaaaaaaaaaaacccccccggttggcccgtttccaaaaaaatttgaaaccccccaaaaaaaaaccccccaaattaccccccccaaaaacccccccgggggtgtcccccccgcgcccgcccaaaaatgttctccccccaggaaccccccccc

SEQ ID NO: 51295 - DNA, 691 bp, Zea mays
  misc_feature: Ceres CLONE 1465651-F
  misc_feature: Encodes the peptide sequence at SEQ ID NO. 51296
tccccgcggtggcggccgctctagaactagtggatcccccgggctgcaggaattcgcacgagaccattacctagaacatcctaatcgaaaaagattcatagatccttcacactgatcggcaattgaaattattgaagatttccttctcaaaacagaagggaatacactgtaattgtcgatgggttccatgggccaaaaggtaaagtggagctggagctcagccttaatcggagcagcatctgcggcagcagcaacttctctcctcagcgccaagccaaaggatccaactttccaccttatctccatagacctaacctcactcaaactcaacctcccagtcctcgacgctgaattaatgctcaccgtacacgtcacaaaccctaacatcgcagccatccattactcctccacaacgatgtcgattctatacgacggcacggtccttggcacggcggaggtcaaagctggttcgcagccggcgagatcgtgtcagcttcttaggttaccggcacgtctcgacgggatggagcttgcgcatcacgcgcggaagtcttttgctgacttgccaaaaagggaaatgaagcttgaggctaagcttgatatcaaaggaccggctaaggttttgtggggggaccatatgttttaggggggcccggggataggttttgttacctgttgatcccggtctttt

SEQ ID NO: 51296 - protein, 76 aa, Zea mays
  misc_feature: Ceres CLONE 1465651-F
MSILYDGTVLGTAEVKAGSQPARSCQLLRLPARLDGMELAHHARKSFADLPKREMKLEAKLDIKGPAKVLWGDHMF

SEQ ID NO: 51297 - DNA, 685 bp, Zea mays
  misc_feature: Ceres CLONE 1465654-F
  misc_feature: Encodes the peptide sequence at SEQ ID NO. 51298
  misc_feature (362)..(362): n is a, c, t, g, unknown, or other
  misc_feature (370)..(370): n is a, c, t, g, unknown, or other
tggagctccccgcggtggcggccgctctagaactagtggatcccccgggctgcaggaattcgcacgagaccattacctagaacatcctaatcgaaaaacgccagaaactaatccagatagctagcctttgatttctcacttcaatctgacgaagtgcacacctaggcaacaaactcgaacgcgcgcggtagtggagccgagatgcagggaggggcgacggccaagcagcaggcgcgagacggtgaccgcggcgcggcgagaacgccgacgacggaggggaagggcgacgccgccggcgcctaggctagcgccaacgtggcgaagggcgacgcccgcgtcgccaaggctgctggggacgaacntcttcttnggaaagggcgacccaagcaacaaggccgggcccggggccatggaccagggcctgtcggccggggaagggaaagatcccaaaacattttcccgttgaaatccccggggaaacctttgggcccccccccgggggaaactcgagagaaccccccccaaacattttgggggggaacccctgtggggcccaaaatttttcccccccaaagggccccggggaaaaaaaacccccccccccagttggggggggtaaaaaaatttccctttttttaacgaaagaaaaagggtttttttcccggggaagaaaccccccgggggg

SEQ ID NO: 51298 - protein, 33 aa, Zea mays
  misc_feature: Ceres CLONE 1465654-F
MQGGATAKQQARDGDRGAARTPTTEGKGDAAGA

SEQ ID NO: 51299 - DNA, 668 bp, Zea mays
  misc_feature: Ceres CLONE 1465657-F
  misc_feature: Translation starting site: 271
  misc_feature: SWISSPROT Homolog: EC 2.3.1.48 Histone acetyltransferase
ggagctccccgcggtggcggccgctctagaactagtggatcccccgggctgcaggaattcgcacgagaccattacctagaacatcctaatcgaaaaaataatgtccttattttggagctcgcgccgcccgccgcccgccgccgcgcccgaacgcagccatcgattccccatttctttcccgcctcctcactcccgcctcttctactcccaaaatcccaaaaccctagctcgctaacgaccccaggcagacgcgccgtcctcccctcccccatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccattttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaagaattcctgcatacatttt

SEQ ID NO: 51300 - DNA, 682 bp, Zea mays
  misc_feature: Ceres CLONE 1465659-F
  misc_feature: Encodes the peptide sequence at SEQ ID NO. 51301
  misc_feature (484)..(484): n is a, c, t, g, unknown, or other
  misc_feature (487)..(487): n is a, c, t, g, unknown, or other
  misc_feature (492)..(492): n is a, c, t, g, unknown, or other
  misc_feature (510)..(510): n is a, c, t, g, unknown, or other
tggagctccccgcggtggcggccgctctagaactagtggatcccccgggctgcaggaattcgcacgagaccattacctagaacatcctaatcgaaaaaactgcacgtctcccgctttgtgctattcccgcagccagaaaaccctaacttcccggccgccgctttcctttccctcgatccacagctcgcgccgttcctgcaagtgcgcacccatcgtcccacctacgcactgccgcccaacgatctacgagctgccatggctaactcagcggcaccgggaggaatgaggtcgttcctgcaggccgtgtctacggtcaccgaggaggcgccgacgccactccgcgtcgtccagatggagggcctggctgtactgaaaatcatcaagcactgtgaggagtttgcgccagctttagttacaggtcaattgcttggtttggatgttggtagtgttctggaagtgaccaactgttttccggttcctatcnggnaagangatgatgaagcagatgcngattggtgcaattatcagcttgagatgatgaggtgtttgagggaagtaaatgtgacaacaatgctattggatgggatcagtcttgcttgcttggatctttccaaactggggaactgattgaaacttttatgaactatcaggagagcatccggagatgtgggtgcttggccaa

SEQ ID NO: 51301 - protein, 123 aa, Zea mays
  misc_feature: Ceres CLONE 1465659-F
  misc_feature (77)..(77): Xaa is any aa, unknown, or other
  misc_feature (78)..(78): Xaa is any aa, unknown, or other
  misc_feature (79)..(79): Xaa is any aa, unknown, or other
MANSAAPGGMRSFLQAVSTVTEEAPTPLRVVQMEGLAVLKIIKHCEEFAPALVTGQLLGLDVGSVLEVTNCFPVPIXXXDDEADADWCNYQLEMMRCLREVNVTTMLLDGISLACLDLSKLGN

SEQ ID NO: 51302 - DNA, 683 bp, Zea mays
  misc_feature: Ceres CLONE 1465661-F
  misc_feature: Encodes the peptide sequence at SEQ ID NO. 51303
  misc_feature (465)..(465): n is a, c, t, g, unknown, or other
  misc_feature (628)..(628): n is a, c, t, g, unknown, or other
aagctggagctccccgcggtggcggccgctctagaactagtggatcccccgggctgcaggaattcgcacgagaccattacctagaacatcctaatcgaaaagcaactactcatcctttccatcaaaactgagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggancacgatttccttggaatcgccaccgggcagacgaatccgcagattgcattcattcgaggggcgattaaaatcaaggggagcatcagtgcggcgcataagttcacccctgacatcttccccaagcctgctaagctgtagaaggttagattgtgtattacttggncgaagtgaataatatgttggcaagcttcatttactatgtacgagaatacatgggg

SEQ ID NO: 51303 - protein, 122 aa, Zea mays
  misc_feature: Ceres CLONE 1465661-F
  misc_feature (12)..(117): Pfam Name: SCP2 Pfam Description: SCP-2 sterol transfer family
  misc_feature: SWISSPROT Homolog: EC 2.3.1.176 Propanoyl-CoA C-acyltransferase
  misc_feature (77)..(77): Xaa is any aa, unknown, or other
MDSSSLKSAQLLELMRQHLATDAGKEVTKKVGLVYQLNIAPKKIGVDEEIFVVDLKKGEVTKGPYQGKPDATFSFTXHDFLGIATGQTNPQIAFIRGAIKIKGSISAAHKFTPDIFPKPAKL

SEQ ID NO: 51304 - DNA, 687 bp, Zea mays
  misc_feature: Ceres CLONE 1465663-F
  misc_feature: Translation starting site: 268
  misc_feature (598)..(598): n is a, c, t, g, unknown, or other
  misc_feature (687)..(687): n is a, c, t, g, unknown, or other
tggagctccccgcggtggcggccgctctagaactagtggatcccccgggctgcaggaattcgcacgagaccattacctagaacatcctaatcaaaaaaggatgacaaaatttcccactccactcgaattaaaaccctagcggcaaaaccttcgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcggcggctcatcgagcgctacattgaggaccatggcaagtgccccatcaccaaggatgagcttactatggatgatatcgtgctggtcaataccaacaaggtcgtgaagcccaggcctttgcaggctgcaagcattccaggactccttgggatttttcagaacgagtgggatgctctcatgctttctaattttgctttggagcagcagctacacacagcaagacaagaacttagtcatgcactctaccagcatgacgctngcctgccgtgttatagccaggttgaagaaggaaagagatgaggctagagcacttttggctcaagctgagagacagattccagcatcagn

SEQ ID NO: 51305 - DNA, 685 bp, Zea mays
  misc_feature: Ceres CLONE 1465665-F
  misc_feature (412)..(412): n is a, c, t, g, unknown, or other
  misc_feature (480)..(480): n is a, c, t, g, unknown, or other
aaactggagctccccgcggtggcggccgctctagaatagtggatcccccgggctgcaggaattcgcacgagaccattacctagaacatcctaatcggaaaatatatcgtcttctgttttcccaacagacgatggaacgtgtgtcttctgcgaatctcctgtcctcgatcgatagcgaccgacaagtaccggtgtaacttcacgggaaaaccaaattccgtcgtggatcttatcaagatgagcaacgaactcctcgacatcgatcctatcgactttcagttccgttttgaattgaagaagcagatctcttcgactctctatttggctacaagacggacgattatgtctccttcaaggtaaatgacgagtccgaagagtattgtgttaggcctaaactggtgtcgttcttcccnatcctcttctgagctctagtgacttgcagcggaaacgaatctctgctgatatgcgtgcaggacaattnctgctcagtgtgtgtcctagtccggacccctgctacgatgttactctgaaatgttaccaaagggcttggccctatttgaggaaaataattgaaagttggttagttgatccccgcggccccgtccccgttcgggaaggttccaagagaggttttccggaaaacttttgtttaaaaaaggggaaaggtttctattttaaacgccccc

SEQ ID NO: 51306 - DNA, 726 bp, Zea mays
  misc_feature: Ceres CLONE 1465666-F
  misc_feature: Encodes the peptide sequence at SEQ ID NO. 51307
  misc_feature (413)..(413): n is a, c, t, g, unknown, or other
  misc_feature (435)..(435): n is a, c, t, g, unknown, or other
  misc_feature (444)..(444): n is a, c, t, g, unknown, or other
  misc_feature (448)..(448): n is a, c, t, g, unknown, or other
  misc_feature (464)..(464): n is a, c, t, g, unknown, or other
  misc_feature (467)..(467): n is a, c, t, g, unknown, or other
  misc_feature (522)..(522): n is a, c, t, g, unknown, or other
  misc_feature (546)..(546): n is a, c, t, g, unknown, or other
aagctggagctccccgcggtggcggccgctctagaactagtggatcccccgggctgcaggaattcgcacgagaccattacctagaacatcctaatcgaaaaacctcaaaattcacagtagccagatccagcagaattgagtgacaggctcaaacacaagctagaagataggtgcttagtgagttaaccagtgggatgtcgctggaagatagtttgaagaagagggtggccaagtgccgcagggagtatgacattatttacaagcagctaccggtgctgctagagaagatggaaattctatttcctacggggaagaagatggagagctccgagccggagaacaaatccgaagcaaagggggagccggtcgacccgctgcgagccatgacgccggcagaaataggggagcgctancagggatctggcgacaccgtcnagggatccntcanggatctggacaagccnganaaggaaatcgtcgcaggcacgagccaggcggcaacgccacctggcttcgtgggangacaagtaattatcaggagcagcngcgccccacccgcccaggaaaagggagggcctggatcttcatcagggagggcatcatcccggccaaaaaaaattcccccgaaaaagttttcctttccccaggcctgtttccccagtgggtaacccctcgggggggggggggaaatttacctggtccggggggggtggaatcccaacacac

SEQ ID NO: 51307 - protein, 157 aa, Zea mays
  misc_feature: Ceres CLONE 1465666-F
  misc_feature (73)..(73): Xaa is any aa, unknown, or other
  misc_feature (81)..(81): Xaa is any aa, unknown, or other
  misc_feature (84)..(84): Xaa is any aa, unknown, or other
  misc_feature (85)..(85): Xaa is any aa, unknown, or other
  misc_feature (91)..(91): Xaa is any aa, unknown, or other
  misc_feature (110)..(110): Xaa is any aa, unknown, or other
  misc_feature (118)..(118): Xaa is any aa, unknown, or other
MSLEDSLKKRVAKCRREYDIIYKQLPVLLEKMEILFPTGKKMESSEPENKSEAKGEPVDPLRAMTPAEIGERXQGSGDTVXGSXXDLDKPXKEIVAGTSQAATPPGFVGXQVIIRSSXAPPAQEKGGPGSSSGRASSRPKKIPPKKFSFPQACFPSG

SEQ ID NO: 51308 - DNA, 667 bp, Zea mays
  misc_feature: Ceres CLONE 1465667-F
  misc_feature: Encodes the peptide sequence at SEQ ID NO. 51309
  misc_feature (464)..(464): n is a, c, t, g, unknown, or other
ggagctccccgcggtggcggccgctctagaactagtggatcccccgggctgcaggaattcgcacgagaccattacctagaacatcctaatcgaaaaatccactcccaagtcccaacacccgtcggcgtcgagcagcggcggcgatgacgacgagcctgaagaagaaccggaagaagcgcgggcacgtgtcggcggggcacggccgcatcggcaagcaccggaagcacccgggaggccgcggcaacgccggcggcatgcaccaccaccgcatcctcttcgacaagtaccacccgggctacttcggcaaggtgggcatgcgctacttccacaggctccgcaacaagttccactgcccgtcggtcaacgtggagaggctctggtcgatggttcccgccggcaaggccgcggaggcggtcggcgcggaccaggccccgctcgtcgacgtgacgcagttcggctacttncaggtgctcggcagggggatgctgccgtccaggcccatcgtcgtcaaggccaagctcatctccaaggtcgccgaagagaagatcaaggctgccggaggcgccgtcctgctgaccgcttaggtcctttttgatcttgttttcactatctgcgctaaaaaatattctatcttttttgggtggatttatggagccctgggtttgaa

SEQ ID NO: 51309 - protein, 146 aa, Zea mays
  misc_feature: Ceres CLONE 1465667-F
  misc_feature (108)..(140): Pfam Name: L15 Pfam Description: Ribosomal protein L15
  misc_feature (107)..(107): Xaa is any aa, unknown, or other
MTTSLKKNRKKRGHVSAGHGRIGKHRKHPGGRGNAGGMHHHRILFDKYHPGYFGKVGMRYFHRLRNKFHCPSVNVERLWSMVPAGKAAEAVGADQAPLVDVTQFGYXQVLGRGMLPSRPIVVKAKLISKVAEEKIKAAGGAVLLTA

SEQ ID NO: 51310 - DNA, 727 bp, Zea mays
  misc_feature: Ceres CLONE 1465669-F
  misc_feature: Encodes the peptide sequence at SEQ ID NO. 51311
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
acccgcggtggcggccgctctagaactagtggatcccccgggctgcaggaattcgcacgagaccattacctagaacatcctaatcgaaaactcacacctcgacgcctctctctctttccccgagctctcgaaaccctaggtgcgtgccgaccggcggcggcggcgaggtgatggcgatggacccggacgcggtggcgaaagccttcgtggagcactactaccggacgttcgacaccaaccgcgcggcgctggtggggctgtatcaggagacctccatgctcaccttcgagggccagaagttccagggcccatccgccattgccgggcagctcggatctcttcccttccagcctgcgagcaccagatcgtcaccgtcgactgccagcggtcggggccccagggacccaccctccctttcgttctcgggttcatccggcaccggccccgagaagccccccatcaagttctcccgggatttccatttgctggcggggagtgggtcctttttccggcaaaaaggactgttccccccggaacttgggttaaaacccccaaaactctggaaaaacatttttagggtttttgtaaacaaaaaaccaggggccccccccctctcttttcccccctggnnnaannnaaaaggtttttttaattggccctgagacagtcgtnnnnnnnnnnnnnnnnnnnnnnnnnnnnnnnnnnnnnnnnnnnnnnnnnnnnnnnt

SEQ ID NO: 51311 - protein, 163 aa, Zea mays
  misc_feature: Ceres CLONE 1465669-F
  misc_feature (8)..(121): Pfam Name: NTF2 Pfam Description: Nuclear transport factor 2 (NTF2) domain
  misc_feature (154)..(154): Xaa is any aa, unknown, or other
  misc_feature (155)..(155): Xaa is any aa, unknown, or other
  misc_feature (156)..(156): Xaa is any aa, unknown, or other
MAMDPDAVAKAFVEHYYRTFDTNRAALVGLYQETSMLTFEGQKFQGPSAIAGQLGSLPFQPASTRSSPSTASGRGPRDPPSLSFSGSSGTGPEKPPIKFSRDFHLLAGSGSFFRQKGLFPPELGLKPPKLWKNIFRVFVNKKPGAPPLSFPPWXXXKGFFNWP

SEQ ID NO: 51312 - DNA, 741 bp, Zea mays
  misc_feature: Ceres CLONE 1465670-F
  misc_feature: Encodes the peptide sequence at SEQ ID NO. 51313
aaagctggagctccccgcggtggcggccgctctagaactagtggatcccccgggctgcaggaattcgcacgagaccattacctagaacatcctaatcgaaaaaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatggaaaatccttccgtggaggtgactgaggaaaaccgtgatgcttccaagaaacaaagggcaagctatgggacccatttctggaaggaaactggaagatgctattaacccctttcccacgccaaaagggcctgaatccctcccccccaatcctggatggggactaaagccaccttggttttaaaaaaataaaaaaaacccggtgggggcccttttgggggggccaagggcgtgcctaaaaaaatcccccccaaactctcggaaagggggtattaaacctccgggagggtggcgaatccccccgtgtgg

SEQ ID NO: 51313 - protein, 143 aa, Zea mays
  misc_feature: Ceres CLONE 1465670-F
MDASKLRELRDFVEACKKNPSLLADPNLSFFRDYLQSLGAKIPAAAPSFESPKRSSMDDIDDDGDDDDDLDMRDPTPERDELDEEIVESDLELEGEIVQSDHDDPPQKMENPSVEVTEENRDASKKQRASYGTHFWKETGRCY

SEQ ID NO: 51314 - DNA, 700 bp, Zea mays
  misc_feature: Ceres CLONE 1465674-F
  misc_feature (440)..(440): n is a, c, t, g, unknown, or other
aaagctggagctccccgcggtggcggccgctctagaactagtggatcccccgggctgcaggaattcgcacgagaccattacctagaacatcctaatcgaaaagctgcttttttatctcattcttcacggttttcttctttctctctacgactaccatcctcaaatatcaccaaattggacctttgaaacttgtatttgatccagtggtcttctgtggcaagaaagacaaggagtgaatgaagaagctaaataagtgggaggaagaggacaaggagatgatggagaagaaacagaaggagcttgcggcggagaaatagcgaacagaagaggtggaaaagaggcgtgttgctgcttacaaggaggagaagcgaagaggcttgagcgtgcacgccgtgtgaagcagcaatggaggagaacctccatgcttttcagaaggaaangtggcctcgttgcactcagtagctcgtagtttgggtagttttaaattgattaagtctcgaacatggtattgactaatgcctttttactatccttaaataaggcctcgaaataaggttttaaggattgcacttttaaactttagttaactaggggcgggtttaatttggaattggtggagcaagggcgaaaatggcccttcaacaaaaaaaaaaaaatttttttcattcctccaccccgggggggcccggaccatttccct

SEQ ID NO: 51315 - DNA, 713 bp, Zea mays
  misc_feature: Ceres CLONE 1465677-F
  misc_feature: Encodes the peptide sequence at SEQ ID NO. 51316
ggagctccccgcggtggcggccgctctagaactagtggatcccccgggctgcaggaattcgcacgagaccattacctagaacatcctaatcgaaaaaatactgttggtctagccggcggcggccgcgtccctcatccagtcatcccctttccgcgatcaaaaccgagctagggttttaggtgcgggggagagggtgaggagcggacggaggcgcgccatggacaaccccgagatgcagcggttccttcagcaagagcagcaaaaggcgatgatgaacgagatggttggcaagctaacgagcgtgtgctgggacaagtgcatcactagcgctcccgggagcaagttcagttccggggaatcaacctgcctgaccaactgcgcccggaggtttctcgacatgagcgtgatgatcgccaaacgctttgagatgaagtgaggcgtcgacgccgaaagctgttacctagtcaatcacccggagttttttacccttttgatttgagggtccctttgagcacttcgaacggatccaacagagtttaaatgaccttttctatatggaacccaccggcctcgtggggcaacggggttgaaattgggatttggagccgggtggaaactggaattattgtacccttttctgggcccggagtttaaacaaaaggtttacgccgggggccccgaaaatttggtttgaaaaatccaaatggggggta

SEQ ID NO: 51316 - protein, 72 aa, Zea mays
  misc_feature: Ceres CLONE 1465677-F
  misc_feature (7)..(72): Pfam Name: zf-Tim10_DDP Pfam Description: Tim10/DDP family zinc finger
MDNPEMQRFLQQEQQKAMMNEMVGKLTSVCWDKCITSAPGSKFSSGESTCLTNCARRFLDMSVMIAKRFEMK

SEQ ID NO: 51317 - DNA, 678 bp, Zea mays
  misc_feature: Ceres CLONE 1465680-F
  misc_feature (566)..(566): n is a, c, t, g, unknown, or other
  misc_feature (612)..(612): n is a, c, t, g, unknown, or other
  misc_feature (678)..(678): n is a, c, t, g, unknown, or other
tggagctccccgcggtggcggccgctctagaactagtggatcccccgggctgcaggaattcgcacgagaccattacctagaacatcctaatcgaaaattccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctgtgttggggttctccggggttccttgcgctggagggaggtttcgttctcgctggccatggtttggctgagaagcagcagcggcagcatcttgatgccaaatctctgagctttatgaagatcgccactcacctgcgccgctcctgcttcctcactccttctcggttgtcttcctctactggttttatgtgatctcataacttgccctcccccgggatcgccattcccccgtgccctctctccgtcccctcaaccttctccctccttttcttgctccctcaancatcgccaaataacagcactagcggcagcggtagaagaatctttcnaggtaagctaggccgggcgggttccctgcgggaaaaaaaaaaaaaaaaagcttatcgataccgtcn

SEQ ID NO: 51318 - DNA, 684 bp, Zea mays
  misc_feature: Ceres CLONE 1465690-F
  misc_feature: Encodes the peptide sequence at SEQ ID NO. 51319
tggagctccccgcggtggcggccgctctagaactagtggatcccccgggctgcaggaattcgcacgagaccattacctagaacatcctaatcgaaaagtgtctagcaggagagagcgcgatggggaagatgcggcagctgatctgcctcgtggccgccgtcgccgccgcggccatcctcctgacagcgtcggccaagaagtccggcgacgtcaccgagcttcagatcggcgtcaagtacaagcctgagtcatgtacgctgcaagcacacagaggagacaaaattaaggttcactatcgtgggacactgactgatggatcagttttcgatgctagctatgacagaggtgacccgtttgtattcacccttggaaacggccaagtgataaaaggttgggaccaaggatccccccctatgtgcgtgggtgaaaagaggaagctaaagatacttgcaaagatgggttatggtgagcgaggctccccaccaaagattccaggtggagcaactctgatcttccacacggagcttatcgccgtcaacgggaagacatccgggggtgcaaaggccgagagtgatagtgagctctgatacaaggcattgaagagttccaaagctcgagagggagtataacagcgtcccattattccttaaggggaaaggtttgctgtttcccccccctagccgg

SEQ ID NO: 51319 - protein, 155 aa, Zea mays
  misc_feature: Ceres CLONE 1465690-F
  misc_feature (43)..(137): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGKMRQLICLVAAVAAAAILLTASAKKSGDVTELQIGVKYKPESCTLQAHRGDKIKVHYRGTLTDGSVFDASYDRGDPFVFTLGNGQVIKGWDQGSPPMCVGEKRKLKILAKMGYGERGSPPKIPGGATLIFHTELIAVNGKTSGGAKAESDSEL

SEQ ID NO: 51320 - DNA, 712 bp, Zea mays
  misc_feature: Ceres CLONE 1465693-F
  misc_feature: Encodes the peptide sequence at SEQ ID NO. 51321
atagctggagctccccgcggtggcggccgctctagaactagtggatcccccgggctgcaggaattcgcacgagaccattacctagaacatcctaatcgaaaaggaggcattgaggaagtcattgctaaggccgagaaaatcgccaaggagtctgcttcataaggaggcttcttgcttgttgaatcctgtacaatcaagttccatttttggattttaagcgattgtttatgcttttcacagttaggcagcacgagttggagatccatctcctgctgagatgcttgttttctctttgttgttcaaacacttcacacccaaataagcaactgcagtgacattaattttggctgcaccaaagttacatgaactgaagaaacttgtggcctgtgtgacccggatccatcaaaacataaagttacggcttctggttggtaaattatgctactcttcaggttctgttcccgcattgtggaggtatcttgttctggactggctctgccgaaactagtttccgtggttttccatgtagttcattttatggttgtgcaacttctcgccgggaacagtttaatgtttatcgactttgattggagatgacccgaaaaaaaaaaaaaaaaaagcttatcgataccgtccaacctcgaagggggggcccggttacccaattcgccctaatagtgagtcctattaacgcgcgcctccactggccgtc

SEQ ID NO: 51321 - protein, 53 aa, Zea mays
  misc_feature: Ceres CLONE 1465693-F
IAGAPRGGGRSRTSGSPGLQEFARDHYLEHPNRKGGIEEVIAKAEKIAKESAS

SEQ ID NO: 51322 - DNA, 690 bp, Zea mays
  misc_feature: Ceres CLONE 1465697-F
  misc_feature: Translation starting site: 142
aaagctggagctccccgcggtggcggccgctctagaactagtggatcccccgggctgcaggaattcgcacgagaccattacctagaacatcctaatcgaaaaaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgtcaagagcacgccaacgcggtctcggcggcggcggtcgacaggcccaagcgcgtctgcgcggaccaccgcacgtcaaggtgaaaccaatgtgaaaaagcgggaccgcgggacgtcatctgcgacgccgccaaaagatggccgcggacctgctcgtcatgggcaccctgggtaccgctttctccagagggcgttctttgggaaggttcagaacccttggcccgaaaaatgaaaaggcccggtcctattttccaaagggcccaaggaaaaaaaaggcccccccaaggacccctgcccttaaaccaaaaatgtttcgggggcaaccatt

SEQ ID NO: 51323 - DNA, 730 bp, Zea mays
  misc_feature: Ceres CLONE 1465698-F
  misc_feature: Encodes the peptide sequence at SEQ ID NO. 51324
aaagctggagctccccgcggtggcggccgctctagaactagtggatcccccgggctgcaggaattcgcacgagaccattacctagaacatcctaatcgaaaaggttctttaattgcgcgccaatctgttttatatatacggagagagcactcctgttttgtggcaaattctattactagctgcaaaagggcgtgtttgagactagcggaccgaccttgaagttgaagttgaaaaggccggcctgcgcggcgatggatgtcaagtgccggcgtctggaggggaaggtggccatcgtgacggcgtccacgatggggatcggcctcgccatcgccgagcgcctcggtctgaagggcgccgccgtcttcatctcctcccgcaggcaaaagaacgtgaacgaaggcgttgaggggcctcaggggccaagggaatcaccgcggtttggtggccgtctgccacgttttcgaacgcaaagcagcggcaagaaccctcatcgaaaacgcgcgccaaaaacttttgggccacaaaaattttttggccccaaaggcggccccaaaccttttgtgaaaaagcaccttagaaaaaaaaaaccttttccccaaaaatttggggaataaaaacggagggttcttttcttctttttcagggagttcccccctcccctcggaggggccccgcgggaaaaatttttcccaggggggggaaacccccaaaagggggggggggggggggg

SEQ ID NO: 51324 - protein, 120 aa, Zea mays
  misc_feature: Ceres CLONE 1465698-F
  misc_feature: SWISSPROT Homolog: EC 1.1.1.184 Carbonyl reductase (NADPH)
MDVKCRRLEGKVAIVTASTMGIGLAIAERLGLKGAAVFISSRRQKNVNEGVEGPQGPRESPRFGGRLPRFRTQSSGKNPHRKRAPKTFGPQKFFGPKGGPKPFVKKHLRKKKPFPQKFGE

SEQ ID NO: 51325 - DNA, 739 bp, Zea mays
  misc_feature: Ceres CLONE 1465699-F
  misc_feature: Encodes the peptide sequence at SEQ ID NO. 51326
  misc_feature (357)..(357): n is a, c, t, g, unknown, or other
  misc_feature (378)..(378): n is a, c, t, g, unknown, or other
  misc_feature (414)..(414): n is a, c, t, g, unknown, or other
  misc_feature (552)..(552): n is a, c, t, g, unknown, or other
  misc_feature (679)..(679): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaacttcctcccttcttacagccgccgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtangcgccgctcggctcgtacggnttcctcatccttcctgctctccgtatgcttatgctnctgatggtactagtttcgttgttcgcaggcagaagaagaaccttctgtagattcgggtttgttgtccatgtgctcaaatgggaacttgaaattgtatgaattggaaaattggggaaattagccgaggaattttataangcctaatggtgcccccccgaaccggttttttttagacccttccccaaaaattttgaccccgaaaaaaaaaaaaaaaaaaaaaaaaaattttttctttccctcccccggggggggccgggccattccnnaaagaaaaacccccgggcgtttacgggaacgcccatgccaccctccgagaaacgccccc

SEQ ID NO: 51326 - protein, 114 aa, Zea mays
  misc_feature: Ceres CLONE 1465699-F
  misc_feature (3)..(61): Pfam Name: Ribosomal_S30 Pfam Description: Ribosomal protein S30
  misc_feature (63)..(63): Xaa is any aa, unknown, or other
MGKVHGSLARAGKVRGQTPKVAKQDKKKKPRGRAHKRMQYNRRFVTAVVGFGKKRGPNSSEKXAPLGSYGFLILPALRMLMLLMVLVSLFAGRRRTFCRFGFVVHVLKWELEIV

SEQ ID NO: 51327 - DNA, 710 bp, Zea mays
  misc_feature: Ceres CLONE 1465701-F
  misc_feature: Encodes the peptide sequence at SEQ ID NO. 51328
  misc_feature (376)..(376): n is a, c, t, g, unknown, or other
  misc_feature (461)..(461): n is a, c, t, g, unknown, or other
  misc_feature (483)..(483): n is a, c, t, g, unknown, or other
ggagctccccgcggtggcggccgctctagaactagtggatcccccgggctgcaggaattcgcacgagaccattacctagaacatccaatcgaaaagttggatcgtaactaacgctagagaagcactccgaagacctgctctccttcgttctgtttgttgtttttcttctcccgtccgcagtccgcttggcgtgcgcgacggctagggcgaccgccgccgccctacgccctacttcgagctgcccctgtcttcttcggcccctttgtcggctggaactcaccagatcaataatcgttctgccaaccggcgcacgtctggatatagggctgataaggctaattactcctacaataatgatggatacagtattattgtnccaacattaaaaagccttccttcttttgttcgataccaaccccccttctgcattgttatgaatggactgtatcaaacaggattcntgctttcgcagggatggtctgnctgggagggttccgagctccctcttggatcgctgagactgctgacacccgcaatgaaacaagggacaaaatatttgcccccttcaaagacccttggtaatgttttgggggagttcttccgccccgtcacggagttcaccggaaaagcatccccattaaataagaatttcttttcaaggagaatttcacccgggcagggcgcaccgccccaccgcccttctaggttcc

SEQ ID NO: 51328 - protein, 92 aa, Zea mays
  misc_feature: Ceres CLONE 1465701-F
  misc_feature (10)..(10): Xaa is any aa, unknown, or other
  misc_feature (17)..(17): Xaa is any aa, unknown, or other
MNGLYQTGFXLSQGWSXWEGSELPLGSLRLLTPAMKQGTKYLPPSKTLGNVLGEFFRPVTEFTGKASPLNKNFFSRRISPGQGAPPHRPSRF

SEQ ID NO: 51329 - DNA, 726 bp, Zea mays
  misc_feature: Ceres CLONE 1465702-F
  misc_feature: Encodes the peptide sequence at SEQ ID NO. 51330
  misc_feature (582)..(582): n is a, c, t, g, unknown, or other
  misc_feature (620)..(620): n is a, c, t, g, unknown, or other
  misc_feature (630)..(630): n is a, c, t, g, unknown, or other
  misc_feature (631)..(631): n is a, c, t, g, unknown, or other
  misc_feature (645)..(645): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (724)..(724): n is a, c, t, g, unknown, or other
ggagctccccgcggtggcggccgctctagaactagtggatcccccgggctgcaggaattcgcacgagaccattacctagaacatcctaatccaaaaatcggatccgaaggggcatgggtctggtcagattggggtttcccgtgttcttcttcctcgcagcggcggagttcgcggcggggacgcggtcgccgtcggctttcatacaaaacgccatatactccaaccgcatcaccatcttctccaagacttactgcccctactccatgcgtgctaggcacatatttcgagaccttaaggaagatccatatgttgttgaactagatacccgagtggatgggcgtgacattcaaagtgttctcgtggacctagttgggcgtcctactgtgccacaggtgtttgtcaatgcacaccatattggtggctcagacgatacagtaaatgcgctttcaaatggacagctccagaaacttctcgggaagagtcagtcataatgatgggtcgctggacaagcttgcactgtcaagaacacgtgagtatatgtttgggaggggggttcttttgagtttggggttaaaaagaatntggggtttgggccccccacctgcgccgtgggagaatgnggatttatgnncactggcccccacnatgtttgttgctttgtaaaaaaaaaaaaaaaaacacaagtgtttnnntttccccccacccccctgctggggggggccgnag

SEQ ID NO: 51330 - protein, 125 aa, Zea mays
  misc_feature: Ceres CLONE 1465702-F
  misc_feature (39)..(101): Pfam Name: Glutaredoxin Pfam Description: Glutaredoxin
  misc_feature: SWISSPROT Homolog: EC 1.11.1.15 Peroxiredoxin
MGLVRLGFPVFFFLAAAEFAAGTRSPSAFIQNAIYSNRITIFSKTYCPYSMRARHIFRDLKEDPYVVELDTRVDGRDIQSVLVDLVGRPTVPQVFVNAHHIGGSDDTVNALSNGQLQKLLGKSQS

SEQ ID NO: 51331 - DNA, 721 bp, Zea mays
  misc_feature: Ceres CLONE 1465704-F
  misc_feature: Encodes the peptide sequence at SEQ ID NO. 51332
ggagctccccgcggtggcggccgctctagaactagtggatcccccgggctgcaggaattcgcacgagaccattacctagaacatcctaatcgaaaaacctcaaaattcacagtagccagatccagcagaattgagtgacaggctcaaacacaagctagaagataggtgcttagtgagttaaccagtgggatgtcgctggaagatagtttgaagaagagggtggccaagtgccgcagggagtatgacattatttacaagcagctaccggtgctgctagagaagatggaaattctatttcctacggggaagaagatggagagctccgagccggagaacaaatccgaagcaaagggggagccggtcgacccgctgcaagccatgacgccggcagaaataggggagcgctacaccgatctggcggacaccgtcaagggattcctcaaggatcttgaccaagcccgaaaaggagatcgtcccaggaccgagccaggggggaacccccccctgctttcggggaagacaattattattcaaaaccgccgccgcccaacccgcccaggggaaagggagcccgtgattttccttggggagggccccccccccccctaaaaaaaaaaaccccccaaaaaagtttcctttttcgcgggctgggtttcccccttgtggaaacacccgggggggggggggggaaaaatatacccgttcgcggggggttggaaac

SEQ ID NO: 51332 - protein, 139 aa, Zea mays
  misc_feature: Ceres CLONE 1465704-F
MSLEDSLKKRVAKCRREYDIIYKQLPVLLEKMEILFPTGKKMESSEPENKSEAKGEPVDPLQAMTPAEIGERYTDLADTVKGFLKDLDQARKGDRPRTEPGGNPPLLSGKTIIIQNRRRPTRPGEREPVIFLGEGPPPP

SEQ ID NO: 51333 - DNA, 721 bp, Zea mays
  misc_feature: Ceres CLONE 1465706-F
  misc_feature: Encodes the peptide sequence at SEQ ID NO. 51334
  misc_feature (558)..(558): n is a, c, t, g, unknown, or other
aagctggagctccccgcggtggcggccgctctagaactagtggatcccccgggctgcaggaattcgcacgagaccattacctagaacatcctaatcggaaaagttcgccactctcgccatcggggacgagggactgggagccaggatacttctgccgcgcggcgaccggtcgagcgaaatcgatctaccccaggtgcggcgggcgcggctttattctcaagattttttctgtgttctttagagagcagccatggacgagtggattcgccaaaccgaggtgtgggtgcaccaaaccgacagctggatccggcagcagcccccggagcagatctatgtagcggccgcggtggttgccgtcacaatcctgttgcttatcgtagcatcttgtctgagatcgtctagaccaaacaccatagttctatctgggcttagtggcagtggcaaaaccactatttactaccagcgccggggatggatcatcacatcaaggaactggtactttcatggaagaaaacagtgatactttttgtgctgcattcggaagcagaaagaaagacnaagtaaaacctgggcataatattgattgtcctgggccatgctaggctcaaacccaacttggatgaagtcctgccaaaggcgcggcgggtggctttggtggggaggccaaaaattcctggcaacaggaaaggtggtgggaaagaccttttgacattttggccag

SEQ ID NO: 51334 - protein, 89 aa, Zea mays
  misc_feature: Ceres CLONE 1465706-F
MDEWIRQTEVWVHQTDSWIRQQPPEQIYVAAAVVAVTILLLIVASCLRSSRPNTIVLSGLSGSGKTTIYYQRRGWIITSRNWYFHGRKQ

SEQ ID NO: 51335 - DNA, 710 bp, Zea mays
  misc_feature: Ceres CLONE 1465708-F
  misc_feature: Encodes the peptide sequence at SEQ ID NO. 51336
  misc_feature (423)..(423): n is a, c, t, g, unknown, or other
  misc_feature (527)..(527): n is a, c, t, g, unknown, or other
  misc_feature (532)..(532): n is a, c, t, g, unknown, or other
caaagctggagctccccgcggtggcggccgctctagaactagtggatcccccgggctgcaggaattcgcacgagaccattacctagaacatcctaatcgaaaaggctgtagtgcagccagtaccagtaccagtaccagtaccccagcagccggtgaggagaggagacggagagagcgagcggaggagggccatggaaggcgacagcttctccggcggcgccatggcgaacggcggcggcggaggcggcggcggcggcgggcaggtggtggacgggaagctgatccacacgttccacaggagcttcgtgcaggtgcagagcctgctggaccagaaccggatgctcatcagcgagatcaaccagaaccacgagtcccgcgcggcccgacacctcaccccgcacgtcggcctcatccgcgagctcnacaaacacatccgccgcgtcgtcgggctctacgcggacttctcccgctctttcgggcggacatggaccacgcgtccttccgagggcgactcttcgggaccgggnaaaanggccgggccggggccggggcccggccaaaagggggcccgccccgcaaaaaagcttttaaatttttcccctcctcccgggggggccaactggggggggaaaaccccgggggttcccttcgccccaaggggggttttttttttttttttcggggggtttttttggggccccctttttaaa

SEQ ID NO: 51336 - protein, 173 aa, Zea mays
  misc_feature: Ceres CLONE 1465708-F
  misc_feature (23)..(112): Pfam Name: DUF1313 Pfam Description: Protein of unknown function (DUF1313)
  misc_feature (78)..(78): Xaa is any aa, unknown, or other
  misc_feature (114)..(114): Xaa is any aa, unknown, or other
MEGDSFSGGAMANGGGGGGGGGGQVVDGKLIHTFHRSFVQVQSLLDQNRMLISEINQNHESRAARHLTPHVGLIRELXKHIRRVVGLYADFSRSFGRTWTTRPSEGDSSGPGKXAGPGPGPGQKGARPAKKLLNFSPPPGGANWGGKTPGVPFAPRGVFFFFFGGFFWGPLFK

SEQ ID NO: 51337 - DNA, 774 bp, Zea mays
  misc_feature: Ceres CLONE 1465710-F
  misc_feature: Translation starting site: 146
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
aagctggagctccccgcggtggcggccgctctacaactagtggatcccccgggctgcaggaattcgcacgagaccattacctagaacatcctaatcgaaaacttttcaacttcgccgaaaccctaaccctcccggcgaagtcgccatgtcgaacccgaagggctccaagatgctccagttcatcaactaccgcatgcgggtgacgatccatgacggtcgccagctcgtgggcaagttcatggcgttcgaccgccacatgaacctcgtcctcggcgactgcgaggagttccgccgcctcccgccctccaagtcctccaaggccaccggcgaacgcgaggagcgccgcacgctcggcctcctcctgctccgcggcgaggaggtcgtctccatgaccgtcgagggcccgccgccccccgaggagtcgcgcgccaaggccgcggcggcgggcggagcccttccggccctggcggagccgcgccgctgggccggtcggtggnnnnnnnnnnnnnnnnnngnnnnnnnnnnnnnnnnnnnnnnnnnnnnnnnnnccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttgnnnntcaatnnnnnnnnnnnnnnn

SEQ ID NO: 51338 - DNA, 728 bp, Zea mays
  misc_feature: Ceres CLONE 1465717-F
  misc_feature: Encodes the peptide sequence at SEQ ID NO. 51339
  misc_feature (342)..(342): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (365)..(365): n is a, c, t, g, unknown, or other
  misc_feature (366)..(366): n is a, c, t, g, unknown, or other
  misc_feature (407)..(407): n is a, c, t, g, unknown, or other
  misc_feature (450)..(450): n is a, c, t, g, unknown, or other
ctccccgcggtggcggccgctctagaactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtaccccntcgcgnnnggctcctcggcgccnngcgctttgggtacctcttctgctagatccgcgctggaaacntggtttcctgctccaaatatgaatcgttctgggctggcccccnggggtccagcctcgggggtcggggggtcctctttggaaaggtgcccccggccgttttttatttatggaatccccccccccccccccacccaaaaaaaggggcccccggggggggggaaccctcctccccccccctgtttgtccggggaaaaaataaaacccccggggggttttgggggaaaccgggggaattttttttggtccaaaaaaaaaaaaaaaaatttttttctccccccccctcgggggggggcccggagccccatttcccccaaagaggga

SEQ ID NO: 51339 - protein, 57 aa, Zea mays
  misc_feature: Ceres CLONE 1465717-F
  misc_feature (42)..(42): Xaa is any aa, unknown, or other
  misc_feature (44)..(44): Xaa is any aa, unknown, or other
  misc_feature (45)..(45): Xaa is any aa, unknown, or other
  misc_feature (50)..(50): Xaa is any aa, unknown, or other
MAGLRMKFVAVAAMAAALVASAAAAEAPAPAPASDAAAAVPXRXXLLGAXRFGYLFC

SEQ ID NO: 51340 - DNA, 680 bp, Zea mays
  misc_feature: Ceres CLONE 1465722-F
  misc_feature (536)..(536): n is a, c, t, g, unknown, or other
aagctggagctccccgcggtggcggccgctctagaactagtggatcccccgggctgcaggaattcgcacgagaccattacctagaacatcctaatcgaaaacggtgaagatgctcaagctaatgaattcaaagagcgccttggtcaacttaaggccattggtgatccgattcttttcagattgagtgaattaaaagcccgaccagctgcctgtgaaaatgctcgattgtatcttgatgagctgcaaaagattgtgaacaagtgggagacaaataaaccatggctccccaaaaagagagtagatgaggttgtgagtcaagcagagaaagtgaaagcttggctggaggagaaggaaaacctgcagaaaaatacccctgtctatagctcaccagttttcacatctgaacaagtttatgagaaagttctggacttacaagataaggtctcaagtgtcaacagaattccaaaaccaaaacccaaggtcgagaagaaaacagcagaggaagagcctgctagcaaggggaaaacacatcttcngaatctgcacccaacgagggagagtacacgaaacgtctcaggaacctaggctcgagaggggatcattcagcatcagccaacgtagtgatttagatctgaatctccgacgagttgtgagtaccagatccatgaaacagtaggaaa

SEQ ID NO: 51341 - DNA, 684 bp, Zea mays
  misc_feature: Ceres CLONE 1465724-F
  misc_feature: Encodes the peptide sequence at SEQ ID NO. 51342
  misc_feature (131)..(131): n is a, c, t, g, unknown, or other
  misc_feature (144)..(144): n is a, c, t, g, unknown, or other
  misc_feature (312)..(312): n is a, c, t, g, unknown, or other
aaagctggagctccccgcggtggcggccgctctagaactagtggatcccccgggctgcaggaattcgcacgagaccattacctagaacatcccaatcgaaaaaacgacaagtgggtgtcccagatgccccngcttcgactacgntgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctgnagcgcctgcgagggcgcgtcatcgtgcgcatgctctccccgatgtcgcacttcgagaacgggacctgggacccacggcggcgactgcaggcgcacgcagcctgctccggccaaacaagaacggccatggagggccggcgacctggactttctccaccgggcaaattggaggagttccgcccccccgaaaaaaggccgccccccaaaagggggccggcccctgattgttcatgggaccccccggcgggaaattttaatatgggccgaagggccacccccacccctttaggggaactgggcccaaaaagaagggggggtttttaaaaagaatgggatcccctgggggcccccccgggacccaaaaaaaaaatag

SEQ ID NO: 51342 - protein, 97 aa, Zea mays
  misc_feature: Ceres CLONE 1465724-F
MLSPMSHFENGTWDPRRRLQAHAACSGQTRTAMEGRRPGLSPPGKLEEFRPPEKRPPPKRGPAPDCSWDPPAGNFNMGRRATPTPLGELGPKRRGGF

SEQ ID NO: 51343 - DNA, 722 bp, Zea mays
  misc_feature: Ceres CLONE 1465728-F
  misc_feature: Encodes the peptide sequence at SEQ ID NO. 51344
  misc_feature (618)..(618): n is a, c, t, g, unknown, or other
aagctggagctccccgcggtggcggccgctctagaactagtggatcccccgggctgcaggaattcgcacgagaccattacctagaacatcctaatcgaaaactcgcctcgcctcgcctcgccccaccggatctcgtagccgccctctgtcgtgtttgttcctcgctagttctcgtcggcgccgtctctcccacgccgccctctgccaccagcccaccacctcctgcgccggcgctcctccgagacgcagttcgcctccggaattcgatcacttcgccgccgctctcgcctccgcccccagctggctaaatacaacaatgatggagaacaggatgactttgaatccaactgatcttgatgattttgacaagagaaaattgccatcacctaggttccaggttgaggttgtcctgctagattacgatggctcgcaaccaccaaaaccagccgctggagcagttgataataaatctgatgccgattccctcgctagcacggctgtgaaagaaatagtgttgcgcctgcaaaatccaacaggggactggaaagcatgataaggatgaagtattctcggacagtgacgacggggaagatggattctttctagggaaagaagganaggacttgctggcgcgttggtcaaggcattgtaaatgctgctaaaccatctcaaacaagcaacgtggaggaggaggccatcgccgctgctaacagacttgataa

SEQ ID NO: 51344 - protein, 78 aa, Zea mays
  misc_feature: Ceres CLONE 1465728-F
MMENRMTLNPTDLDDFDKRKLPSPRFQVEVVLLDYDGSQPPKPAAGAVDNKSDADSLASTAVKEIVLRLQNPTGDWKA

SEQ ID NO: 51345 - DNA, 698 bp, Zea mays
  misc_feature: Ceres CLONE 1465729-F
  misc_feature: Encodes the peptide sequence at SEQ ID NO. 51346
  misc_feature (397)..(397): n is a, c, t, g, unknown, or other
  misc_feature (591)..(591): n is a, c, t, g, unknown, or other
  misc_feature (601)..(601): n is a, c, t, g, unknown, or other
gtcgcggatccacaaacaggattccccgggttgcgggataccccacgagaccattacctagaacatcctaatcgaaaaaagggctacacaagaatagcttgagagctcctctccgatcccgacccaccgcctgcaactcttcttctctcctacgtgttcgtcagcccgctaagtgttaagatggcttcaagcgatggtcagacagaagctgcggccccatctgtccccaaaaaccctgctatggcatcatgccggaagaagaaaacggatgatgctaccttcctcgaagatctgaaagaccacatcgatgagttcatccatgcctccatggatgagcacaagacctgctttaagaaaacgatccagaacatgtttgggatgtcgaaggctgttgcanacacatccgcggcagaagcgaaggaagctggagttgaaagtgctttgccacttcagaccagtgtctcgcagtagaatttcacgttggtagtttcttgcttgacgccggcctttttttatacaagggttttgttgctctgggttgtctgaaacgtataagcgtctcaggggcatgtttttcaaacctgttattgnattgtttgtnatcattctccgaaagttgttgtggggaataatgcctttaaatatacccagtggtagttttggcttcaaaagaaaaaaaaaaaaaagccttctcccgc

SEQ ID NO: 51346 - protein, 96 aa, Zea mays
  misc_feature: Ceres CLONE 1465729-F
  misc_feature (73)..(73): Xaa is any aa, unknown, or other
MASSDGQTEAAAPSVPKNPAMASCRKKKTDDATFLEDLKDHIDEFIHASMDEHKTCFKKTIQNMFGMSKAVAXTSAAEAKEAGVESALPLQTSVSQ

SEQ ID NO: 51347 - DNA, 690 bp, Zea mays
  misc_feature: Ceres CLONE 1465730-F
  misc_feature: Encodes the peptide sequence at SEQ ID NO. 51348
  misc_feature (586)..(586): n is a, c, t, g, unknown, or other
aaagctggagctccccgcggtggcggccgctctagaactagtggatcccccgggctgcaggaattcgcacgagaccattacctagaacatcctaatcgaaaaaagcgttagcttgtcgtttccaacttcttttgggggcatcatcctgaacccccgtgggccgtgggcagcattacgcctttgcctacaaaccttcagctatgcattatgtcttttcttgcgccactgacacatcgagcgctaaaacatttataccagctatgcgcttcggcgatttacaacctgacgcttctttgcttgtttagcagattacaattcattcgaggttttctttcctttggctgctattgatgctttctacttgctgtaggataccctggatttcgtccgtggcgagtggctaccgcttctgctccttttgtgacagctgaatctttgtggttcgaaggcgattgacttgggttcactgacgcggtgacgcccaatgagctcccacgtctccacatcgcggggtcttcatcccccaggcaagcttgggacgttggactcacccggtgcgtggcagccgccagcacctatggctcancccgaagcaggccgcggtgatgaccaggaggtcaggctgttgtcggttgcttggaatcaggactgtggatgcttcgctgcccgtaccagtaaacgatcaggatc

SEQ ID NO: 51348 - protein, 68 aa, Zea mays
  misc_feature: Ceres CLONE 1465730-F
  misc_feature (34)..(34): Xaa is any aa, unknown, or other
MSSHVSTSRGLHPPGKLGTLDSPGAWQPPAPMAXPEAGRGDDQEVRLLSVAWNQDCGCFAARTSKRSG

SEQ ID NO: 51349 - DNA, 725 bp, Zea mays
  misc_feature: Ceres CLONE 1465736-F
  misc_feature: Encodes the peptide sequence at SEQ ID NO. 51350
  misc_feature (593)..(593): n is a, c, t, g, unknown, or other
ctggagctccccgcggtggcggccgctctagaactagtggatcccccgggctgcaggaattcgcacgagaccattacctagaacatcctaatcgaaaaaaaagaccaaaaccctagccgtcacagcgccgcccccgaaccataaacctccacctcgccggcggccatggcgttctccggcaggatccaggagctcgtgaggaagtatggcaaggtggccatttgcgtccacctatccgtctcctgcgcctccatcgccggcctttacgtcgccatcaacaacaacgtcgacgtcgaagccgttttccggaggttcggtatctcccccggcgttaccgtaggcggcgaggcctcacccgcccccgtttcccgcgatgaacacctgcgcgacgtccccctgccgcccatggccaaccaggtactgcaagaaaagacgagcgagagcggcagccccgcaacaggacgatggagctcgtggcgtcaagtggcggcgcgttcgcgctcgctgtcgtctgcaacaaggcactattcccccgtgagggtccccatcaccatcgcgctcacgccgcccgtcgccggggccctaacccgctngaggctccgtcaaaacctgatctgggttttttttcgtcccaactgcctctgcaaatatggggggcatcccccctcccgggaaaccaagaaaaaaaattcgccccgggtttgtttttttggggggcatgggaa

SEQ ID NO: 51350 - protein, 186 aa, Zea mays
  misc_feature: Ceres CLONE 1465736-F
  misc_feature (143)..(143): Xaa is any aa, unknown, or other
MAFSGRIQELVRKYGKVAICVHLSVSCASIAGLYVAINNNVDVEAVFRRFGISPGVTVGGEASPAPVSRDEHLRDVPLPPMANQVLQEKTSESGSPATGRWSSWRQVAARSRSLSSATRHYSPVRVPITIALTPPVAGALTRXRLRQNLIWVFFRPNCLCKYGGHPPSRETKKKNSPRVCFFGGHG

SEQ ID NO: 51351 - DNA, 691 bp, Zea mays
  misc_feature: Ceres CLONE 1465739-F
  misc_feature: Encodes the peptide sequence at SEQ ID NO. 51352
ggagctccccgcggtggcggccgctctagaactagtggatcccccgggctgcaggaattcgcacgagaccattacctagaacatcctaatcgaaaagcgaacgaagcgacggacgactggacgagacgaggcacggaacggagggaggggagggaccgagggagccagtgagcgagccagactacccacctactaggtccagcggcaatgaggggcagcgagatgttgaccgcctcggggggcaccggcacggccccgtccacagcctcctcgtcgtcggcagcggcggcggacctggttgccggagccgggggcttgggcgccatcggcgtgggcggaggaggcggcaacttccccctcggcgttgctctcctcgccttcgcctgcgccaacttcatcaacctcccccccctctggttaaaagagaagaggtgggatgcaaggaattttcttacttcagctggagtcatgtcatctctttctgcaactgtggggagcttggccgttgctgtgggtcaacgagaaggcgcagatagctctgcatttgccctcgcttggttttttgctgcagttgtaatgtatgatgcatcagggattaaaatggcccacaggccgccaagctgcgttgttaaatcaaatagtctgtgatttcccgcaaaacttccattcttttcaccttttggcccctacg

SEQ ID NO: 51352 - protein, 146 aa, Zea mays
  misc_feature: Ceres CLONE 1465739-F
MRGSEMLTASGGTGTAPSTASSSSAAAADLVAGAGGLGAIGVGGGGGNFPLGVALLAFACANFINLPPLWLKEKRWDARNFLTSAGVMSSLSATVGSLAVAVGQREGADSSAFALAWFFAAVVMYDASGIKMAHRPPSCVVKSNSL

SEQ ID NO: 51353 - DNA, 750 bp, Zea mays
  misc_feature: Ceres CLONE 1465741-F
  misc_feature (425)..(425): n is a, c, t, g, unknown, or other
aagctggagctccccgcggtggcggccgctctagaactagtggatcccccgggctgcaggaattcgcacgagaccattacctagaacatcctaatcgaaaagcgtatctctctcctccctggctctcgtcccccccaccgagtcgtcgccccctcgctttcaccccacgcggaagcaagaattcgtcgtcaaattcccagcttgcgcgtgtttctgtggatttcttcccgcttccctgctcctgcctcctatgggcctttgatccggggcttcgtggatcttgggaagaggaggtgcggtgggcgcctcggcggcgatctggcggggaggatatggccagcggggaggagccgatcgaggtcaggtttcgtcttttcgacggcacggatatcggacctacgaagtaggatccccccccccgcggnctcctcgttaaaggagatcattcctcgcttcgtgggccgcaagaaaaaggatttgccccccaaaaactggttaatggacttggaagctttatccatggtggaaaggaaatttggaaaaaaaaacgggaaaacttggcaaagatcccctttttcccaaaagagagaaaggtccccaggggggggaaaatacacagggcctggggggaaggggcgccccctccacagtgtaaaaaaaaacagggggaaaaggtttttgcgcaattccccccaaaaaaaaaaaaaatggggaggccccccttctctttaaaaaagggcgccttctctg

SEQ ID NO: 51354 - DNA, 736 bp, Zea mays
  misc_feature: Ceres CLONE 1465742-F
  misc_feature: Encodes the peptide sequence at SEQ ID NO. 51355
  misc_feature (376)..(376): n is a, c, t, g, unknown, or other
  misc_feature (377)..(377): n is a, c, t, g, unknown, or other
aaagctggagctccccgcggtggcggccgctctagaactagtggatcccccgggctgcaggaattcgcacgagaccattacctagaacatcctaatcgaaaaaggccgagagttgtcaacgacgacgtctgccggcagtgctcctgctcctcctcctcctccttcccggccgccgcgcgagcttggtgggttagtgtctcttcttcgcggagacttgtgagaggagccatcatcatggccgccgttgagactgttgtcctcaaggttgctatgtcatgcaagggttgcccgggggcggtcaaaagattgctctcccagatggaaggatttgaaaccttcgacatagacctcagggaccaaaaggttactttttaannccatgtcaagcctgacgaccttttctggagggccccccgggcgggaaagagtaccctcttactgggagggcaaaaccccgccccccaacaccttataatggtctctggaaacaaaccacctccctggcaacccgggcaaaagcgccctcctgcttgctgctcccgggcggcgccagaagatccccccagcccaaagcgtgacccccggattccccccggttttttattcacttcacagtgggattgctttgtttttcaaacctcccaacccttaaaatccaaaaaaaattcttgggggaatggggttttgattattgaatttggagtttcttgccggggtctagcccgggggaatttag

SEQ ID NO: 51355 - protein, 46 aa, Zea mays
  misc_feature: Ceres CLONE 1465742-F
MAAVETVVLKVAMSCKGCPGAVKRLLSQMEGFETFDIDLRDQKVTF

SEQ ID NO: 51356 - DNA, 719 bp, Zea mays
  misc_feature: Ceres CLONE 1465749-F
  misc_feature: Encodes the peptide sequence at SEQ ID NO. 51357
  misc_feature (357)..(357): n is a, c, t, g, unknown, or other
  misc_feature (378)..(378): n is a, c, t, g, unknown, or other
  misc_feature (394)..(394): n is a, c, t, g, unknown, or other
ctggagctccccgcggtggcggccgctctagaactagtggatcccccgggctgcaggaattcgcacgagaccattacctagaacatcctaatcgaaaagaagagattgcggaaaaggaagataaggaggactataagaagttttgggagagctttggcaagtttgtcaagcttggttgcatcgaggacacagggaatcacaagcgccttgctccattgttgcgcttccactcttctaaaaacgagggagatttgataagtcttgatcaatatgtagagagcatgcctgaaagtcaaaaggcaatctactacatcgctacagatagtctccagagtgcaaagactgctcctttcctgnaaaagctggtccagaaagatnatgaaagtctctaccnttatgagccgatagatgacgctgcatttcgaactggcagacctacaaagagaagaaatttgtgatatcagcaaagaggatctggaattggttgatgaagaaaaagaagcctaaggaacccaacggggggtccctcccctatggggaatgggttaaaacaaccctttgccaacagggttcgaaaagcccaaaattcaaggggttaaaatccccccccgtggggcccccaacccggaaaaattcggtgggcccccccaatttgaagaggcctgagagggccccaacccttggggaccaccacttttttggaatttctgggggggaaa

SEQ ID NO: 51357 - protein, 151 aa, Zea mays
  misc_feature: Ceres CLONE 1465749-F
  misc_feature (119)..(119): Xaa is any aa, unknown, or other
  misc_feature (126)..(126): Xaa is any aa, unknown, or other
  misc_feature (131)..(131): Xaa is any aa, unknown, or other
GAPRGGGRSRTSGSPGLQEFARDHYLEHPNRKEEIAEKEDKEDYKKFWESFGKFVKLGCIEDTGNHKRLAPLLRFHSSKNEGDLISLDQYVESMPESQKAIYYIATDSLQSAKTAPFLXKLVQKDXESLYXYEPIDDAAFRTGRPTKRRNL

SEQ ID NO: 51358 - DNA, 784 bp, Zea mays
  misc_feature: Ceres CLONE 1465752-F
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
cttacaatccccccctcccccccccnnnnnnnnnnnnnnttaannnnncccgagctggagctccccgcggtggcggccgctctagaactagtggatcccccgggctgcaggaattcgcacgagaccattacctagaacatcctaatcgaaaaatacctttctcggccttttggctaaaatcaagtgtagtatctgttcttatcagtttaatatctgatatgtgggccatgtgctcacttcgatattaaatttatttttttgtgggggagggtccactactaatggcttgccattaggggccctcacgcgtcgtccagctattgcactgctggccggacgtggcgcaccccaaccaagacaaattgcaatttctctgtttgggaactcttcggtgccatgaggctggtctcggcgaattaaagcaactggagtggttctggttctgttagatatattatgcgccccacgagctattgccatgtgtagtagatgagcatgtgggcttgaggagatataaatataggtcatgtgtattagatgagcatgtgggcttgaggagatataaatataggccaaaaaaaaaaaaaaaaaagcttatcgataccggtcgacctcgaggggggggcccgggtacccaattccgccctataggtgagtcggtattaaggggccgctccgctggcccgttcgttttaccaacggccgtggactggggaaaaacccttgggcgtctaccccaactttaaatcggcctttgcaggaacattcccccccttttcgcccg

SEQ ID NO: 51359 - DNA, 753 bp, Zea mays
  misc_feature: Ceres CLONE 1465759-F
  misc_feature: Encodes the peptide sequence at SEQ ID NO. 51360
  misc_feature (421)..(421): n is a, c, t, g, unknown, or other
  misc_feature (441)..(441): n is a, c, t, g, unknown, or other
agagctggagctccccgcggtggcggccgctctagaactagtggatcccccgggctgcaggaattcgcacgagaccattacctagaacatcctaatcgaaaaggcaagttcgatccagattatagcagctagctcaccgtcaccgacatacagtacaatagcagcttattagcttgtgtcagtgatgttctaggtaatgggcgactacttcgcgaccattatatctttatccatggcggcgctgctagtgccactccgcgtacagtgcaaagaagcagcaagagctgctgctgccagaagctgcaatgtgggaaccggagcttctgcttctgcactatccgcagcagcaacgtggaaaatgagctagcgactcggcaggccggaaaccagcaaccacaagcggcaggcatattccagttcngaagttcgctggtggacaanggaaaaaacgaattttctaaattgctcccgggtgcggggagactacctccccctaggcgtggaatttcgcacttggcccctccgggccttttctcaaattgtccgaaaggtcataaaacctttttggggaagttcctagggtcccccgggggttccggggaatctttttccccaaaccccgaaccccgggggggccccggggccccccttcggcgggttataaatttcccctctcgggcggctccggggtttctggaaaaccaacgggaaaagtgccccggaaaaagggggggagggggggcgcccccaaaa

SEQ ID NO: 51360 - protein, 56 aa, Zea mays
  misc_feature: Ceres CLONE 1465759-F
MGDYFATIISLSMAALLVPLRVQCKEAARAAAARSCNVGTGASASALSAAATWKMS

SEQ ID NO: 51361 - DNA, 639 bp, Zea mays
  misc_feature: Ceres CLONE 1465762-F
  misc_feature (385)..(385): n is a, c, t, g, unknown, or other
  misc_feature (455)..(455): n is a, c, t, g, unknown, or other
aaagctggagctccaccgcggtgggcggccgctctagaactagtggatcccccgggctgcaggaattcgcacgagaccattacctagaacatcctaatcgaaaaaccgtgccagaatcgcaatccgcgcctccccaaccacgcgcttccatccatggcacacggtttggtcctttcctccccaaccgcgcccctccatccatgacagtcaccagcgcccttccatccatggaagcgcgcccacactcacgcctccatctccccccttctctctccctcaatcgccctgatccagatacccaagcacgcgcgtggcgaagagacgggtgtaacctcccagatgatcagggtcgatggcgtgaatcgaaaaatgaccggcgccttgncgtcatccaacagcgccgagctcatcgcaacaaatcgagtgccctcgctccctgtccggtcagcgacccngtcgggcaaatacgcagaaactcccccccgtcgggagaagcacccgatttatttccaaaaactccgggaaaaaaagggggttcccaaaaccggggtcacggaaaatttcgcttatacccgggtccaaaaaaaggggccccatgcctcaatttgggggcccggaaaagcccctttccctctggga

SEQ ID NO: 51362 - DNA, 727 bp, Zea mays
  misc_feature: Ceres CLONE 1465824-F
  misc_feature: Encodes the peptide sequence at SEQ ID NO. 51363
  misc_feature (575)..(575): n is a, c, t, g, unknown, or other
aagctggagctccccgcggtggcggccgctctagaactagtggatcccccgggctgcaggaattcgcacgagaccattacctagaacatcctaatcgaaaaatatgtttccagtataagttggccatgtgctcatttccacaaaaccctatccgaattgcgccgcgttgatatatatctttcatcagctctcgcaggaagctgttagtggcattttcaatcggagacgatgaagttcaacgtccctaatcctaccactggttgccagaagaagctcgagatcgatgacgatcaaaagctccgtgctttttacgacaagaggctctcccacgaagttagcagaaatgctttggccgacgagttcaaggggtacgtcttcaagatcatgggaggttgcgacaagcaaggtttcccaatgaaacagggagttctcacccctggtcgtgtccgccttttgcttcaccgaggtactccttgtttcatatgacactcaacgaggactgcagagacgagaagaaagtctgtccgaggctgcattgtcagccaagatctctctgttcctaaccttatcattgncaagaagggtgaaaaggatcttacccgggcttaaccgacacccgaaaagccaaaggtggagaggctcccaagacaggcttctaggatccggaaagctgttcaaccctcggaaaaggatgattaagtccgggaattttgtcaaacccttcccc

SEQ ID NO: 51363 - protein, 85 aa, Zea mays
  misc_feature: Ceres CLONE 1465824-F
  misc_feature (1)..(84): Pfam Name: Ribosomal_S6e Pfam Description: Ribosomal protein S6e
MKFNVPNPTTGCQKKLEIDDDQKLRAFYDKRLSHEVSRNALADEFKGYVFKIMGGCDKQGFPMKQGVLTPGRVRLLLHRGTPCFI

SEQ ID NO: 51364 - DNA, 681 bp, Zea mays
  misc_feature: Ceres CLONE 1465901-F
  misc_feature: Encodes the peptide sequence at SEQ ID NO. 51365
ggatcccccgggctgcaggaattcgcacgagaccattacctagaacatcctaatcgaaaaatcgaccaagtagccggcagccgcgcggcgtccgcgtcactccaatcccctcgccccgcggcgcctccgttcacagcgccatggcggggtggatctcctccaagctcaaagcagccgagaccctcctccaccagatcgatcagcaggcggcggaatccctcggcaagtccccatccgcttccgacctcgccacgctgcactccacaacatctcgctccgccgatgacctccttgacgtgccgctcccgcgcaggcagccgccgtccgggccgtctccctcactcggcctccgtctcgcagcgaagcgccgctccccgccttcccaagggccccgtcgctccgcatcggcggctgcgatgctcgcggtgcaagatcaagccggtggtgaaccaacggtggggggtggtggccgaggtgaaacccggaaacggatccgaggggatcgcgaggacggcaagagtgtccgcgtccgagagcgggagcgatgaggactccgatgggtcagggagcgaagattcggaggattcccaggaagaaaagggcgaagggaggaaggagaaggacaccgccgcccggcttgaagcggctttgcggcccatggcccccacgcccttattggcg

SEQ ID NO: 51365 - protein, 135 aa, Zea mays
  misc_feature: Ceres CLONE 1465901-F
MAGWISSKLKAAETLLHQIDQQAAESLGKSPSASDLATLHSTTSRSADDLLDVPLPRRQPPSGPSPSLGLRLAAKRRSPPSQGPRRSASAAAMLAVQDQAGGEPTVGGGGRGETRKRIRGDREDGKSVRVRERER

SEQ ID NO: 51366 - DNA, 675 bp, Zea mays
  misc_feature: Ceres CLONE 1465902-F
  misc_feature: Encodes the peptide sequence at SEQ ID NO. 51367
  misc_feature (438)..(438): n is a, c, t, g, unknown, or other
  misc_feature (439)..(439): n is a, c, t, g, unknown, or other
  misc_feature (444)..(444): n is a, c, t, g, unknown, or other
  misc_feature (446)..(446): n is a, c, t, g, unknown, or other
  misc_feature (447)..(447): n is a, c, t, g, unknown, or other
  misc_feature (450)..(450): n is a, c, t, g, unknown, or other
  misc_feature (460)..(460): n is a, c, t, g, unknown, or other
  misc_feature (629)..(629): n is a, c, t, g, unknown, or other
  misc_feature (637)..(637): n is a, c, t, g, unknown, or other
aagctggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcanngccgncnngangaagctagcntattattataagctaaataaagtatagcggcgtcgctgtgtgtgtttcgagtcagtcagtcagttagttgcgtgccatggcctgcatgctctgagtctgaaatgatgatgatgcctgatggccgcctcgtgtcctgtaatcctcccctgccccctcgggcgctcttgcngcaaacanggggttgggttgggttggggggggccacacggtaaccg

SEQ ID NO: 51367 - protein, 82 aa, Zea mays; identical to SEQ ID NO: 43085
  misc_feature: Ceres CLONE 1465902-F
  misc_feature (1)..(80): Pfam Name: Metallothio_2 Pfam Description: Metallothionein

SEQ ID NO: 51368 - DNA, 709 bp, Zea mays
  misc_feature: Ceres CLONE 1465906-F
  misc_feature: Encodes the peptide sequence at SEQ ID NO. 51369
  misc_feature (399)..(399): n is a, c, t, g, unknown, or other
  misc_feature (418)..(418): n is a, c, t, g, unknown, or other
  misc_feature (421)..(421): n is a, c, t, g, unknown, or other
  misc_feature (459)..(459): n is a, c, t, g, unknown, or other
  misc_feature (460)..(460): n is a, c, t, g, unknown, or other
  misc_feature (484)..(484): n is a, c, t, g, unknown, or other
  misc_feature (487)..(487): n is a, c, t, g, unknown, or other
  misc_feature (490)..(490): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (507)..(507): n is a, c, t, g, unknown, or other
  misc_feature (583)..(583): n is a, c, t, g, unknown, or other
ctggagctccccgcggtggcggccgctctagaactagtggatcccccgggctgcaggaattcgcacgagaccattacctagaacatcctaatcgaaaaggattaaggacacgtcatcttcaccccccaacacgccacggtacggtacagcctcatcgccacgccaccgacgaaagaaagcttggacgagtgaagggagatgccgccgccagctccgcgccgaataatcctgctggccgcggcgtcggcggcggcgctgctgctgtggccggccgcctgcgtaacggccgacgacggcagcacggcattcttgccgccgccgccaccggagcccgcgtcgccgttcccgttctgcccggcgcggccgcctggggtgtcgtcggggccgttcccctggtcngcgtcgccgccgcccgcgnccngcgcgtcgtcggtggcgatgttacctcaggacccgggnntctttgcgtcgggggcgtgccccntcngcngcccgnnncgcgtggcntggctgctgctgccgctgctcgctgggctctctgctttcttgctgctttcgaaggactctcgcggtgctgccctgnatggatgtgatgtgccctaaccttgttcagttggaatcgaaatcaaaaattactattttttttgggaccaaccttagaaaaaggcccctttctgggttggcttcttttctttctttttttcaaggg

SEQ ID NO: 51369 - protein, 134 aa, Zea mays
  misc_feature: Ceres CLONE 1465906-F
  misc_feature (74)..(74): Xaa is any aa, unknown, or other
  misc_feature (75)..(75): Xaa is any aa, unknown, or other
  misc_feature (88)..(88): Xaa is any aa, unknown, or other
  misc_feature (96)..(96): Xaa is any aa, unknown, or other
  misc_feature (97)..(97): Xaa is any aa, unknown, or other
  misc_feature (98)..(98): Xaa is any aa, unknown, or other
  misc_feature (100)..(100): Xaa is any aa, unknown, or other
  misc_feature (129)..(129): Xaa is any aa, unknown, or other
MPPPAPRRIILLAAASAAALLLWPAACVTADDGSTAFLPPPPPEPASPFPFCPARPPGVSSGPFPWSASPPPAXXASSVAMLPQDPGXFASGACPXXXPXRVAWLLLPLLAGLSAFLLLSKDSRGAALXGCDVP

SEQ ID NO: 51370 - DNA, 735 bp, Zea mays
  misc_feature: Ceres CLONE 1465909-F
  misc_feature: Encodes the peptide sequence at SEQ ID NO. 51371
  misc_feature (617)..(617): n is a, c, t, g, unknown, or other
aagctggagctccccgcggtggcggccgctctagaactagtggatcccccgggctgcaggaattcgcacgagaccattacctagaacatcctaatcgaaaactccgacccccaacaatggatgaggcgcaagttgtggagtcaaaggatggaaccatctcggttgcttctgcatttgctggttttcaggaagctgtgcaagacaaggatcacaaattcttgacaaaagcagtggaagaagcatatcgaggagtcgattgcggtgacggaggtccatttggagcagttgtcgtccgtaatgacgaagtagtagttagctgccataacatggttctaaagcacactgacccctactgcgcatgctgaagtaactgaaatttaagaagcttgcaaaaaactgggaaaattgagctctccgacccgcaaatttacgcgtccttggagccatgcccaatgggctttggggcaattccccccccccaaacaaaagcttgttttaggggcccaaggaaaagccccccccccccttgggttttgatcactttttttgaaaaacctccaaaaaggcttgggtttccccccaagggccccctttgaaaaaaaaaaaatccttaagcnaagggggctttttcccctaaaaaaatttttttaaaaaaaacaaaaaaaagatccccacatttttctcttcgcttaaaaaaaaagagaaacccccaatattttcataggcggttcccca

SEQ ID NO: 51371 - protein, 82 aa, Zea mays
  misc_feature: Ceres CLONE 1465909-F
  misc_feature: SWISSPROT Homolog: EC 3.5.4.3 Guanine deaminase
MDEAQVVESKDGTISVASAFAGFQEAVQDKDHKFLTKAVEEAYRGVDCGDGGPFGAVVVRNDEVVVSCHNMVLKHTDPYCAC

SEQ ID NO: 51372 - DNA, 878 bp, Zea mays
  misc_feature: Ceres CLONE 1465910-F
  misc_feature: Encodes the peptide sequence at SEQ ID NO. 51373
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (21)..(21): n is a, c, t, g, unknown, or other
  misc_feature (27)..(27): n is a, c, t, g, unknown, or other
  misc_feature (45)..(45): n is a, c, t, g, unknown, or other
  misc_feature (46)..(46): n is a, c, t, g, unknown, or other
  misc_feature (668)..(668): n is a, c, t, g, unknown, or other
  misc_feature (669)..(669): n is a, c, t, g, unknown, or other
  misc_feature (673)..(673): n is a, c, t, g, unknown, or other
  misc_feature (780)..(780): n is a, c, t, g, unknown, or other
  misc_feature (878)..(878): n is a, c, t, g, unknown, or other
nnnttttcccggggggggacntcctancgtcggtcgaggcgcctnntgtttatttggaaactagaactccacgcggtggcggccgctctagaactagtggatcccccgggctgcaggaattcgcacgagaccattacctagaacatcctaatcgaaaagaggaggagaagatggtggtgctggtggtggccacgacgtcagacccggcgtccattgggcccgccgccgccttcctcgccatgcccggatggtccccccggcccgcccatcgccgaggcgatggagagttttactaatggggatgtttcgattactggagcatggagcgtaacattgtcccaaaagatgatctttgaccagcaatggcgggaaacccctggaaaagttggtttttaagggtcattttccttcacaaaaccccctggagttttccaaaaggttcggggctttccgtggggttccaaattgggggtggggcgggtggtgggaggagggaaaaaaaaaccccccccccccctgggagagagaaatcccctggggtggggagcgaaattccccaaggcccccccaaattggagacccctgtgccccccggggggagccacaaaaaaaaaagatatttaaaaaaaaaaggcccttttttcccccaaaaataatggagagtttgnnggtnggggggggccccccccggggggggagggatgcccccccaccccccacccccttttttttgttaggggtgggagggggagaaaaaaaagacgggggtgggctagaaanagacgccccgggggaggtggtttctttttctttatagaaaaaatatcttgtctcaggcagaagaaaaaattatttttatttctctcctagacaaaaan

SEQ ID NO: 51373 - protein, 96 aa, Zea mays
  misc_feature: Ceres CLONE 1465910-F
  misc_feature (6)..(6): Xaa is any aa, unknown, or other
  misc_feature (8)..(8): Xaa is any aa, unknown, or other
  misc_feature (14)..(14): Xaa is any aa, unknown, or other
FPGGDXLXSVEAPXVYLETRTPRGGGRSRTSGSPGLQEFARDHYLEHPNRKEEEKMVVLVVATTSDPASIGPAAAFLAMPGWSPRPAHRRGDGEFY

SEQ ID NO: 51374 - DNA, 703 bp, Zea mays
  misc_feature: Ceres CLONE 1465911-F
  misc_feature: Encodes the peptide sequence at SEQ ID NO. 51375
aagctggagctccccgcggtggcggccgctctagaactagtggatcccccgggctgcaggaattcgcacgagaccattacctagaacatcctaatcgaaaacttttgtggtaactggcggcggccgacgccgacgccctagctcacgtcttcgtcggtcccttcccagccttcgtcgcgtccttcgccgtcgacgagaacacacgaggaattcaaggaaacacttgcaggactgaagaatagagaaacatgtcgtctggtggtgtgaaagatttttaccggcagaaaaagaaaggaggcgtggcgaagacagcttcatcctcaaagaataagacacggcattacactgtggggcttctgttggtgcctcagatgcagctcagacatcagctctagtttctcatggctcctgggatctcaaagatgactttggtgatgaagaagagcagctgcgacagtttgacgtggacatgaagtttggtccttgcatcggtgttactcggcttcagcgctgggagcgagcctctgccatgggcctcccagcagcagctcatctccgggacctcctactgcacgcggcatcgacaaagaatcgcggtggcggtagcccctctgtcgagtgcctttggggaggtaaagtctagaagaaatatcttctatccctcatcccaggtcaacttcaggtggtaactggagacgcttgg

SEQ ID NO: 51375 - protein, 57 aa, Zea mays
  misc_feature: Ceres CLONE 1465911-F
MKFGPCIGVTRLQRWERASAMGLPAAAHLRDLLLHAASTKNRGGGSPSVECLWGGKV

SEQ ID NO: 51376 - DNA, 703 bp, Zea mays
  misc_feature: Ceres CLONE 1465912-F
  misc_feature: Encodes the peptide sequence at SEQ ID NO. 51377
  misc_feature (542)..(542): n is a, c, t, g, unknown, or other
  misc_feature (543)..(543): n is a, c, t, g, unknown, or other
  misc_feature (592)..(592): n is a, c, t, g, unknown, or other
  misc_feature (623)..(623): n is a, c, t, g, unknown, or other
  misc_feature (630)..(630): n is a, c, t, g, unknown, or other
  misc_feature (671)..(671): n is a, c, t, g, unknown, or other
ctggagctccccgcggtggcggccgctctagaactagtggatcccccgggctgcaggaattcgcacgagaccattacctagaacatcctaatcgaaaagctctaccagtctacctctaccccgcgccccctccgagatcggaatcgcggcgccccgccgccctcctccgccatggcgccgtctctgctcgggggcttcaccaagtcgctggccatgacggtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcacgtaaatggactcatcatgtgaccactctattgttctttgtatttggtatttggtcattgtgggaaggcttcaaggaagatggagattcagaagaattggctgaagttgaagcagagctggatgctgtctttaagagtaataaaggcgaatctaaaactaaaactannggcaacgatgatacgaagaaacagcaaagaccatttctcatgcaattcnttctcacaatttttcataaggcattttctantacattncttggtgagtggggtgacaagagccagattgctactatggnctgggctgctgatgaaacccattttggtgttg

SEQ ID NO: 51377 - protein, 177 aa, Zea mays
  misc_feature: Ceres CLONE 1465912-F
  misc_feature (9)..(84): Pfam Name: UPF0016 Pfam Description: Uncharacterized protein family UPF0016
  misc_feature (124)..(124): Xaa is any aa, unknown, or other
  misc_feature (141)..(141): Xaa is any aa, unknown, or other
  misc_feature (151)..(151): Xaa is any aa, unknown, or other
  misc_feature (153)..(153): Xaa is any aa, unknown, or other
  misc_feature (167)..(167): Xaa is any aa, unknown, or other
MAPSLLGGFTKSLAMTVLSEVGDKTFFAAAILAMRHPRKLVLAGCLTALIVMTALSASLGWVAPNLISRKWTHHVTTLLFFVFGIWSLWEGFKEDGDSEELAEVEAELDAVFKSNKGESKTKTXGNDDTKKQQRPFLMQFXLTIFHKAFSXTXLGEWGDKSQIATMXWAADETHFGV

SEQ ID NO: 51378 - DNA, 621 bp, Zea mays
  misc_feature: Ceres CLONE 1465916-F
  misc_feature (463)..(463): n is a, c, t, g, unknown, or other
aagctggagctccccgcggtggcggccgctctagaactagtggatcccccgggctgcaggaattcgcacgagaccattacctagaacatcctaatcgaaaacctctagcctggtttctttgtggcgatgagctgagcaacaagtctggtttgtgtgaaggtatttctttctgtaaaatcacaaagccagcccatcacctgcagtcctcacactgacatttcactctcggctgctggagtgtcggccgctgccatctgcctgccgctcactcccacgcgccgcaatgtgccactccccactcggcgccgccacccaccacgcgggggcgctagcgctcctcttcctccctgcgctagcctcggcccgcgccgccggcggctgcaaccgcggcgaaggcgacgcccaacatcaccggcgctcatgtccaaaggacgggtgcaaaggcgttcgccgtccctgcttnacaagtccccccaaaccttctgtccgcgtttcaatccgccgtgaaacggcggctttaacggccttcctgcccaaacgaaaaaggcctgggccggtgtcattcccccgttcccggaaccttaaccccgaaacggaaaggcttccctttttgcttttccc

SEQ ID NO: 51379 - DNA, 690 bp, Zea mays
  misc_feature: Ceres CLONE 1465923-F
  misc_feature: Encodes the peptide sequence at SEQ ID NO. 51380
aaagctggagctccccgcggtggcggccgctctagaactagtggatcccccgggctgcaggaattcgcacgagaccattacctagaacatcctaatcgaaaaaaaatcgagaggacgcccgggccgattctctgcgtgacttggggcgtcgtcgcctagttttctccggccgagggcggcgcgaccggacaaccagcgtgagcgcgaccggcgacatgactcgcggcaaccagcgtgaccgcgaccgtgagcgcgcggcggctcggaagcccaacgccaagaactcccgtgacgggctcaccccggagcagcgcctcgagagggacaagaaagctctggaggagaaggcggccaagaaggcgcaccaggcagcggccggcggcaccggtacctccacggacaacaacaagaacaaggcatgtggcaagaagtaggaggcagtggcgcgccgccacctctgtacgattaatcgatgccttgagcttgtaacttgttcgcatccgtgtaagtgcgatgcttgttgggtcataaactctgatgatatcgagatttggcgatgacgaatatgcgtcgctgtctggctttctggtcaaaacaaaaaaaaaaagcttatcataccgtcgacctcgagggggggcccggtaccaaattcgccctatagtgagtcggattaccgcgctccctggccgt

SEQ ID NO: 51380 - protein, 72 aa, Zea mays
  misc_feature: Ceres CLONE 1465923-F
  misc_feature (1)..(56): Pfam Name: 4F5 Pfam Description: 4F5 protein family
MTRGNQRDRDRERAAARKPNAKNSRDGLTPEQRLERDKKALEEKAAKKAHQAAAGGTGTSTDNNKNKACGKK

SEQ ID NO: 51381 - DNA, 709 bp, Zea mays
  misc_feature: Ceres CLONE 1465924-F
  misc_feature: Encodes the peptide sequence at SEQ ID NO. 51382
aaagctggagctccccgcggtggcggccgctctagaactagtggatcccccgggctgcaggaattcgcacgagaccattacctagaacatcctaatcgaaaaaatccattataaatctacctggggctggggtgtccctctcccccgtcacctcaaaaacctctccaaccccaccggtccaccaccgccagccacctctccctcgctctcactcaggtcccccgcaacacgacgagaggcagcaggaccggaaggcgccatggccaccacccgcgacgtctccgccgcctccgcggccgccatgttccacgtgtaccagcccatgccgatgccatccacggcggcggcccccgcgaaggcgggcaagaaggagggcggcaaggaccggcacagcaaggtgaacgggcgcgggcggcgcgtgcggatgccgatcgtgtgcgcggcgcgcgtgttccagctgacccgcgagctggggctcaagtcggacgggcagaccatcgagtggctgctccgccaggccgagccctccatcgtggccgccacgggctccggcaccaccccggccgtcttcgtctcctcctccgcgccgtccacgtcctcctcctcccactcccactaacagcagcagcagcagcagcagcaggccacccgtcgtcgtcctgggcaagcgcccgcgcgaggagggcggcgacgccgcggcggcgtccgt

SEQ ID NO: 51382 - protein, 119 aa, Zea mays
  misc_feature: Ceres CLONE 1465924-F
  misc_feature (24)..(116): Pfam Name: TCP Pfam Description: TCP family transcription factor
MATTRDVSAASAAAMFHVYQPMPMPSTAAAPAKAGKKEGGKDRHSKVNGRGRRVRMPIVCAARVFQLTRELGLKSDGQTIEWLLRQAEPSIVAATGSGTTPAVFVSSSAPSTSSSSHSH

SEQ ID NO: 51383 - DNA, 847 bp, Zea mays
  misc_feature: Ceres CLONE 1465927-F
  misc_feature (24)..(24): n is a, c, t, g, unknown, or other
  misc_feature (26)..(26): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (452)..(452): n is a, c, t, g, unknown, or other
  misc_feature (453)..(453): n is a, c, t, g, unknown, or other
  misc_feature (600)..(600): n is a, c, t, g, unknown, or other
  misc_feature (601)..(601): n is a, c, t, g, unknown, or other
  misc_feature (735)..(735): n is a, c, t, g, unknown, or other
tttccccccccccctccctccccnanctcccctccttnngggggatntattaaagctggagctccccgcggtggcggccgctctagactagtggatcccccgggctgcaggaattcgcacgagaccattacctagaacatcctaatcgaaaaatcgcgatttgccctcgcagtctctcgcgcgcgccggcatggagacgcggcgcgcggggatatcgagagcctaaatacggtccgccccctcgcttcgcggaggaggatccggcggcggggatggggacgggggttaccccgcgcgcgttgagacgattcgcactgagaacggcttcttgcgggcccgcgtgggtaggccgcaggttcggggggcgaagagccttgcgtcctcccttggtcgtgctgagacgggaagcaggctggggtagaagggggtttgggtttgccgggacccccatnnaaaaggcttccggggggcttccgggggccggggggggtgcacacccagaggcccaagttggggcattggggggggggtgggggggtgcccctcctcgctaaaacttttccgtgttattgggcccccggccccccgggggggcgtttnntgagagtgtgggggaatggccgcttgggggggggggtggactgtgacaaatatgtgttccggtggtgtggataggggggcgggggggttctacggggaaaaagaaaaatgtgaggggtcgggataggggtcttngttgggtagtcggcgtgtctgccccatagacctctgagagggtgaagggcggcgcgcgctcggcgagagccgcccatcctgtcccgcagccgggcactcacagagaactaca

SEQ ID NO: 51384 - DNA, 793 bp, Zea mays
  misc_feature: Ceres CLONE 1465931-F
  misc_feature: SWISSPROT Homolog: EC 4.4.1.5 Lactoylglutathione lyase
  misc_feature (13)..(13): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
gggggtggctccncccgccccttcctnnnnccnnaanncaggtttnnnnnaaaaactggagctccccgcggtggcggccgctctatactagtggatcccccgggctgcaggaattcgcacgagaccattacctagaacatcctaatcgaaaactgttccagaagggcgagctccgcctcagctcaaaccccgtgcacaagaaggtgaccgtgctcatccaccacggagagcccagtctgcaagtccctcgtcgtcgtggagtacgtctatgaggtctggcccagcgccgccgcaagcatcctccccgccgacccccacggtcgcgccaccgctcgcttctgggccgcctaaatcgacggcaagctgtgtccggcgtggacggggatcatgaaagcagccactgactgaagggagggctgataatctagattaaaacacacgcctcggtcctcagcctggagaaggcccccccccgatatcaggtctagctccaacaacgacggcgcgacctatcttcgggggccgactccttgttgttacctgggaactcgcggctcagaggcttccctggcggggtagggggggggctaagcggccatgttccgagcgtaaaaatcaggtgatgccgaaccaagcttccgcttcctcggtggggaggagcccggagcgtaattgggggaacaccccccggtggccctaaggaaggggcgtgcccgcgttcctgaaataaggctcttggacccccccccccatgagaaatctcagggcctactgtggcggcttttgtcttata

SEQ ID NO: 51385 - DNA, 698 bp, Zea mays
  misc_feature: Ceres CLONE 1465932-F
  misc_feature: Encodes the peptide sequence at SEQ ID NO. 51386
aagctggagctccccgcggtggcggccgctctagaactagtggatcccccgggctgcaggaattcgcacgagaccattacctagaacatcctaatcgaaaaaccagatcggactaggtagaccacacttcccttcacctctcatcggcgctctttcccttcctcgcagtcccaggtctcggctcccctctcagtcaagccgtttcatttcctccctcctacaaatatcctgatatggacgacgacgacgactccccgcctcatgagtcggcggcggcggcggcggcagacctatcgctgacactggcgccggcgccggcgctggcgcctcccgcgccgcctccggcgctgcccgccgtcgcctccgacggaggcgtgacgaccgcgcgcgtggacggcaaggacgtgcgcctgttcccgtgcctcttctgcaacaagaagatcctcaagtcgcaggcgctcgggggccaccagaacgcgcacaagaaggagaggagcgtcggctggaaccactacttctacatgagcccgccgcacccgcagctcaatgcggcgcctgcgaggcccagcgacacgccgcccgcctacgcggcgggcggacgcatctccggggcgtaggcggcacaaggataaccaccagagccggtggcgccggaggaaacataattacacgaaggtctcgcaaaggtgcaccatggt

SEQ ID NO: 51386 - protein, 127 aa, Zea mays
  misc_feature: Ceres CLONE 1465932-F
MDDDDDSPPHESAAAAAADLSLTLAPAPALAPPAPPPALPAVASDGGVTTARVDGKDVRLFPCLFCNKKILKSQALGGHQNAHKKERSVGWNHYFYMSPPHPQLNAAPARPSDTPPAYAAGGRISGA

SEQ ID NO: 51387 - DNA, 700 bp, Zea mays
  misc_feature: Ceres CLONE 1465941-F
  misc_feature (258)..(258): n is a, c, t, g, unknown, or other
  misc_feature (621)..(621): n is a, c, t, g, unknown, or other
aagctggagctccccgcggtggcggccgctctagaactagtggatcccccgggctgcaggaattcgcacgagaccattacctagaacatcctaatcgaaaaacagacgagacacgagaggcagcgagccagcgaccggcaacagttttctcggaaggcagcctcttcctcgtcgccgccgacgtcacccgccgcggctgtcgagatgccggtcagggtgggtcgatacgcacgccttcctcgcagccctcccagggcnagaaagcaatactggacaccatctcctcctagatgtcactcctaagtgctggaagatcttttgctggaactcaaattgtttcaagctctccaaaaggattaaccctgggaaaggggatggcccccttcccggggttgcgaactttaaaacggggtttcttttgggggacaaatggaaaccccttaaggttccctttaaaaaaaacccccgggggggcccttttggggggggggggaaaaggggggtccccaaaaattcaccccttttttcccggggcggggggggggggcgccccccccggagggaaataaaaaaaaaaagggggccccaccccccccacttttttgccccctctccccgggnccaaaaaggtgaccacaagagggggggggcctcccctgggttatttataaacccacccctctctctccattttagagag

SEQ ID NO: 51388 - DNA, 726 bp, Zea mays
  misc_feature: Ceres CLONE 1465945-F
  misc_feature: Encodes the peptide sequence at SEQ ID NO. 51389
  misc_feature (199)..(199): n is a, c, t, g, unknown, or other
  misc_feature (203)..(203): n is a, c, t, g, unknown, or other
  misc_feature (205)..(205): n is a, c, t, g, unknown, or other
  misc_feature (227)..(227): n is a, c, t, g, unknown, or other
  misc_feature (245)..(245): n is a, c, t, g, unknown, or other
  misc_feature (257)..(257): n is a, c, t, g, unknown, or other
  misc_feature (353)..(353): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (409)..(409): n is a, c, t, g, unknown, or other
  misc_feature (413)..(413): n is a, c, t, g, unknown, or other
  misc_feature (709)..(709): n is a, c, t, g, unknown, or other
acaaacgggggtctccccgcgggcggccgctctagaactagtggatcccccgggctgcaggaattcgcacgagaccattacctagaacatcctaatcgaaaaaggtcattcggtcattccacttccaccaatctgtctcccaatctttcttgctgctccaattcgctctctttactcggccagcggaaggggagagganggcnanatgacggtggagaaggtggacnccgggctttccaacttcnacccccacttcnatcgcctcttcgcttccccgggagccgcctccgaccgcaagggggaagtgctggtcttcctggtctattgtaagcctgggtcctccctctcctggngccctttttttttcccccccccacggggaaaagcaagggggannnnnnnncncccncacnccccccaacggggggatataagaacacaaaaaaatcaggaacaagcacgggggggggggggcccctgcccccccccgcggagggggggagccagactaaggggtctgagggcgggggcacgctgtagacgcgtcgtggggggaatggaaggacagagccccgcgctcctgcggcgggactctggaggggtcccgctgccgcccgcggggaggagccgggcaccggcgttcgcacgtcgtcccatgcgcccaggcggaggcgctgcatcccgcaacacaagaacacctcccttcggncggagagtccccgccca

SEQ ID NO: 51389 - protein, 173 aa, Zea mays
  misc_feature: Ceres CLONE 1465945-F
  misc_feature (8)..(8): Xaa is any aa, unknown, or other
  misc_feature (14)..(14): Xaa is any aa, unknown, or other
  misc_feature (18)..(18): Xaa is any aa, unknown, or other
  misc_feature (50)..(50): Xaa is any aa, unknown, or other
  misc_feature (64)..(64): Xaa is any aa, unknown, or other
  misc_feature (65)..(65): Xaa is any aa, unknown, or other
  misc_feature (66)..(66): Xaa is any aa, unknown, or other
  misc_feature (67)..(67): Xaa is any aa, unknown, or other
  misc_feature (70)..(70): Xaa is any aa, unknown, or other
MTVEKVDXGLSNFXPHFXRLFASPGAASDRKGEVLVFLVYCKPGSSLSWXPFFFPPPRGKARGXXXXPHXPQRGDIRTQKNQEQARGGGGPCPPPRRGGARLRGLRAGARCRRVVGGMEGQSPALLRRDSGGVPLPPAGRSRAPAFARRPMRPGGGAASRNTRTPPFGRRVPA

SEQ ID NO: 51390 - DNA, 710 bp, Zea mays
  misc_feature: Ceres CLONE 1465946-F
  misc_feature: Encodes the peptide sequence at SEQ ID NO. 51391
aagctggagctccccgcggtggcggccgctctagaactagtggatcccccgggctgcaggaattcgcacgagaccattacctagaacatcctaatcgtaaactttgcgccgccgcagccccaaaccctcatcccccatcaatctcaggggcgccccagccaccccacccttcactcacctaaccatggcggagcgcggcggcgagcgtggtggagagcgcggcgggttcggccgtggcttcggtcgcggcgggcgcggtgaccgtggtgggcgtcgcggcggccgccgtggcccgcgccaagaggaagagaagtgggttcccgtcaccaagctcggccgccttgtcaaggagaacaagatcaccaagatcgaggagatctacctgcactcgctccccgtcaaggagcaccagatcgtcgagaccctcgtcccggggctcaaggacgaggtcatgaagatcacgcccgtccagaagcagacccgtgccgggcagcgcacccgcttcaaggccttcgtcgttgtcggcgatggcgacggccacgtcggcctgggagtcaagtgcgccaaggaggtggccaccgccatccgcggcgccatcatcctagccaagctctccgtcgtccccgtcaggagggggtactggggggacaagatcggacagccccacaccgtgccctgcaggtcaccgggcagtgtggctccgtcactgt

SEQ ID NO: 51391 - protein, 175 aa, Zea mays
  misc_feature: Ceres CLONE 1465946-F
  misc_feature (84)..(150): Pfam Name: Ribosomal_S5 Pfam Description: Ribosomal protein S5, N-terminal domain
MAERGGERGGERGGFGRGFGRGGRGDRGGRRGGRRGPRQEEEKWVPVTKLGRLVKENKITKIEEIYLHSLPVKEHQIVETLVPGLKDEVMKITPVQKQTRAGQRTRFKAFVVVGDGDGHVGLGVKCAKEVATAIRGAIILAKLSVVPVRRGYWGDKIGQPHTVPCRSPGSVAPSL

SEQ ID NO: 51392 - DNA, 766 bp, Zea mays
  misc_feature: Ceres CLONE 1465951-F
  misc_feature: Encodes the peptide sequence at SEQ ID NO. 51393
  misc_feature (1)..(1): n is a, c, t, g, unknown, or other
  misc_feature (2)..(2): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (48)..(48): n is a, c, t, g, unknown, or other
  misc_feature (80)..(80): n is a, c, t, g, unknown, or other
  misc_feature (246)..(246): n is a, c, t, g, unknown, or other
  misc_feature (362)..(362): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (427)..(427): n is a, c, t, g, unknown, or other
  misc_feature (428)..(428): n is a, c, t, g, unknown, or other
nnaatctnnnnccatccctggagctcaccgcggtggcggccgctctanaactagtggatcccccgggctgcaggaattcncacgagaccattacctagaacatcctaatcgaaaaaccaaacagaaaactgagtcagagaggtgcagatcaatgcggcggtggtggtgctcctcccgcggcctcgcccgctgcgtcctctcgtcctccacctccgccataggatcccatgcccgcccgctgccggnacccctgatgcccaaatctccctcctttaccgtccctttctccttgtcctgtcttcggccccagtcgggcgcgggattcttccccctggttttttcttcttccttccgccctccgncggnnntttttttttttccccccccccccggaaaagaaaaggggccccccnnnccnnnncccccnnttttgttgttttataaaaaaaaaaaagaaaggcccccgggggcggggccccccgatcccaaccccccaaccccggccacgttcccgcttgtggcggccccttcatgcccctcagtgccccccttctgtctttaccggcccttcctgtttctccccccgtcctccctgggtcccccctgccccacctcgaccccctttggcctacctctccttcccctctctctccctcccctctcccttcggcccccgctggtccctctccctccccggccccctttccctcctcccgtgtctgcccccgctttccgccgtcctcccctttctcctccctcccctccg

SEQ ID NO: 51393 - protein, 205 aa, Zea mays
  misc_feature: Ceres CLONE 1465951-F
  misc_feature (32)..(32): Xaa is any aa, unknown, or other
  misc_feature (71)..(71): Xaa is any aa, unknown, or other
  misc_feature (72)..(72): Xaa is any aa, unknown, or other
  misc_feature (73)..(73): Xaa is any aa, unknown, or other
  misc_feature (88)..(88): Xaa is any aa, unknown, or other
  misc_feature (90)..(90): Xaa is any aa, unknown, or other
  misc_feature (93)..(93): Xaa is any aa, unknown, or other
MRRWWCSSRGLARCVLSSSTSAIGSHARPLPXPLMPKSPSFTVPFSLSCLRPQSGAGFFPLVFSSSFRPPXXXFFFPPPPGKEKGPPXPXPPXLLFYKKKKERPPGAGPPDPNPPTPATFPLVAAPSCPSVPPFCLYRPFLFLPPSSLGPPCPTSTPFGLPLLPLSLPPLSLRPPLVPLPPRPPFPPPVSAPAFRRPPLSPPSPP

SEQ ID NO: 51394 - DNA, 677 bp, Zea mays
  misc_feature: Ceres CLONE 1465952-F
  misc_feature: Pfam Name: Adenylsucc_synt Pfam Description: Adenylosuccinate synthetase
  misc_feature: SWISSPROT Homolog: EC 6.3.4.4 Adenylosuccinate synthase
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (582)..(582): n is a, c, t, g, unknown, or other
  misc_feature (583)..(583): n is a, c, t, g, unknown, or other
ggagctccccgcggtggcggccgctctagaactagtggatcccccgggctgcaggaattcgcacgagaccattacctagaacatcctaatcgaaaaggttgtcagaaattaaggtgggtgtttcttatacccagactgatggacagaagctgcaatccttccctggggatcttgatacccttgagcaagtacaggtcaactatgaggttctgcctgggtggcaaagtgacatttcttctgttcgaagatacgatgaacttccccaagctgcccgcctctatgtggagaggatagaagaacttgttggtgttcccgtgcactacattggtgttggacctggcagagatgctctcatatacaagtaaaagcaactttatttggtccttggttgggcggaaaccctgccgggactcgggagcatttgcattttcttggcgtggtagcttttgatacggtgaagtcactgactcgtggagtgatgttgctcaataatcagaaactnnngtctatacagccgctgagacatcagctaaagcgaaatagggaaggatgagtcatttgcaccatgtttgaccaccaatnngtagtggcccaaaattttggaactaattgggaaacttggggctttgatctcaatgaatactttgcgggggcagggtttgggttacatggttaaa

SEQ ID NO: 51395 - DNA, 703 bp, Zea mays
  misc_feature: Ceres CLONE 1465953-F
  misc_feature: Encodes the peptide sequence at SEQ ID NO. 51396
  misc_feature (292)..(292): n is a, c, t, g, unknown, or other
  misc_feature (360)..(360): n is a, c, t, g, unknown, or other
  misc_feature (363)..(363): n is a, c, t, g, unknown, or other
  misc_feature (366)..(366): n is a, c, t, g, unknown, or other
  misc_feature (423)..(423): n is a, c, t, g, unknown, or other
aaagctggagctccccgcggtggcggccgctctagaactagtggatcccccgggctgcaggaattcgcacgagaccattacctagaacatcctaatcgaaaatttttggtttggctagggaaggaaccgtggtggggggagcggacggacatgatgcacgccaagtcggagtcggacgtgacgagcctggcggcgtcgtcgccgccgcggtcgccgaagcggggcggcggcgccggcaacggcggctactacgtgcagagcccgtcgcgggagtcgcacgacggcggctacnagtcctcgtcgatgcagcccacgccggtctacaacagcccccacgagtcgccgtcgcaccccttctanggncgncaatcccggttcctccttcgttagcccgcttctcccggcaacctccgaaggggcgcngcccgggaaccccaagggtgctcaaccgacaaaggggtggcccgaattgcacctccttccaaggaaggaagggccccttacaagggaccctccccggggaaataggggccttttcccccccgttggcaaaaaaaaaattggggtttcccacaccttttgggcccccccttttaccgggttttttgcgccttattttgtgggggcccccccccggccgcttaaaaaccccaagggtcttctctccaaggttttaacccctttggtgttccccgcccccccc

SEQ ID NO: 51396 - protein, 79 aa, Zea mays
  misc_feature: Ceres CLONE 1465953-F
  misc_feature (48)..(48): Xaa is any aa, unknown, or other
  misc_feature (70)..(70): Xaa is any aa, unknown, or other
MMHAKSESDVTSLAASSPPRSPKRGGGAGNGGYYVQSPSRESHDGGYXSSSMQPTPVYNSPHESPSHPFXGRQSRFLLR

SEQ ID NO: 51397 - DNA, 795 bp, Zea mays
  misc_feature: Ceres CLONE 1465955-F
  misc_feature: Encodes the peptide sequence at SEQ ID NO. 51398
  misc_feature (1)..(1): n is a, c, t, g, unknown, or other
  misc_feature (19)..(19): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (795)..(795): n is a, c, t, g, unknown, or other
ntttttttgttggcggggncttgctccctcttcnnnngaggnnnnnttcatactggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgtttttacaactgccagtgcgacccctgcaactgcggcaagccacctatgtgctccaccctgcaggccggccggaggaagctagctaattattataagctaaataaagtatagcggcgtcgctgtgtgtgttttcgagtcattcagtcatgttaggtgggtgccatgggctggcatgcttctgagtttgagatgatgatgatgcctgaagggcgggttccatgccctgggagtcctccccctgcccccctcggggcgcttcttggcgggtaaaaaagagggccctgagactctgctctcaatgggtgggctgcgacgggttacaaagggctaaacccattggggcccctcggctttggtgttcttgtcccccn

SEQ ID NO: 51398 - protein, 105 aa, Zea mays
  misc_feature: Ceres CLONE 1465955-F
  misc_feature (1)..(80): Pfam Name: Metallothio_2 Pfam Description: Metallothionein
MSCCGGNCGCGSGCKCGNGCGGCSKMYPDMAEQVTTTTQALIMGVAPSKGHAEGGFEAAAGAENGGCKCFYNCQCDPCNCGKPPMCSTLQAGRRKLANYYKLNKV

SEQ ID NO: 51399 - DNA, 747 bp, Zea mays
  misc_feature: Ceres CLONE 1465961-F
  misc_feature: Encodes the peptide sequence at SEQ ID NO. 51400
  misc_feature (724)..(724): n is a, c, t, g, unknown, or other
aagctggagctccccgcggtggcggccgctctagaactagtggatcccccgggctgcaggaattcgcacgagaccattacctagaacatcctaatcgaaaaaccaacaaaaaacctcggagctagcagcaagatcttagcacaaacaccacaccccacaggctgattaatcactccaagactaatcaaacgaacgcttagctaatagcgcgcgatctttttttcccctccccctcttgagcgtgcgagaagagatggcgctgaacggcggcaagacgttggtgcaggacgaggagaagcagcagcttctcctagagaagcacaccgagaagcacttcaccgccggcgaggtggtccgggacatcatcatcggcgtctccgacggcctcaccgtgcccttcgcgctcgccgcggggctgtccggcgccaaacgcctctccgcgctcgtgctcaccggggggctcgccgaagtcgccgccgggcgcatctccatggggctcgaagggtaccctggcggcaaaaagcgaggctgaccactacacccgggaactgcacccccggcagggacaaaattgaaaccttcccccaaattcaagccccccaaaaattcccaaaactcctgtcccaaatcagggggtggggcccggaaagaaacccgccccctgggggaccccccccccgaaaaaaccccaaggggggggggggggatccattaaaaaaaatcnccgcccccggggttaaaaagcac

SEQ ID NO: 51400 - protein, 92 aa, Zea mays
  misc_feature: Ceres CLONE 1465961-F
MALNGGKTLVQDEEKQQLLLEKHTEKHFTAGEVVRDIIIGVSDGLTVPFALAAGLSGAKRLSALVLTGGLAEVAAGRISMGLEGYPGGKKRG

SEQ ID NO: 51401 - DNA, 761 bp, Zea mays
  misc_feature: Ceres CLONE 1465964-F
  misc_feature: Encodes the peptide sequence at SEQ ID NO. 51402
  misc_feature (328)..(328): n is a, c, t, g, unknown, or other
  misc_feature (329)..(329): n is a, c, t, g, unknown, or other
  misc_feature (379)..(379): n is a, c, t, g, unknown, or other
  misc_feature (380)..(380): n is a, c, t, g, unknown, or other
  misc_feature (473)..(473): n is a, c, t, g, unknown, or other
aagctggagctccccgcggtggcggccgctctagaactagtggatcccccgggctgcaggaattcgcacgagaccattacctagaacatcctaatcgaaaaacccaacaaattcccgagacgccattctcaccatccacacaaagccacagcccaagagcagagtcgtcgtcgtcgtcgggcatggcggggttcaaggtgacgcggatctcggagggccccgtgaagccggcgtcggcgacgcccgaggagacgctgccgctggcttgggtggaccggtacccgacgcaccgtggcctggtggagtcgatgcacatctttccgtcggnncgcggccaagcccccgccgtgatcgggggcgcgctggccaaggcgctggnncttctctacccgctggcgggccccatcgtggaagggggagccacccgggggggccccgcaatccgctggaccgccgagggggttttacttccnggagcccaagggcgactgcacccccgaaagaacttgccctttctgagaagggcccctggtggtgccacaggaggaaccttgtggcctaacccgggaaaaaacctgggggcccttaaacccccaaaaaccccttgtgggggggggaaaaccccattttcccccgggggggtttttgaaaggggcccgggtttaaccacccccccaaaaaaaaaaattggggccccccagtatttaaaaaaccggggggggaaaaatcgcggggggggtgggggacaacaaaggggtccc

SEQ ID NO: 51402 - protein, 193 aa, Zea mays
  misc_feature: Ceres CLONE 1465964-F
  misc_feature (49)..(49): Xaa is any aa, unknown, or other
  misc_feature (66)..(66): Xaa is any aa, unknown, or other
MAGFKVTRISEGPVKPASATPEETLPLAWVDRYPTHRGLVESMHIFPSXRGQAPAVIGGALAKALXLLYPLAGPIVEGGATRGGPAIRWTAEGVLLPGAQGRLHPRKNLPFLRRAPGGATGGTLWPNPGKNLGALKPPKTPCGGGKTPFSPGGVFERGPGLTTPPKKKIGAPQYLKNRGGKNRGGGGGQQRGP

SEQ ID NO: 51403 - DNA, 707 bp, Zea mays
  misc_feature: Ceres CLONE 1465970-F
  misc_feature: Encodes the peptide sequence at SEQ ID NO. 51404
aagctggagctccccgcggtggcggccgctctagaactagtggatcccccgggctgcaggaattcgcacgagaccattacctagaacatcctaatcgaaaaccttttccattttttctagcgccctctgcctccatccatcgacgcggcgcccgacgcccgacgccgcactcacctcgcctcgctgaatcgtccccgccagacgtcgggtgcccgacgctgcagcacggcagccgcacaaccgcagctcccaccgctgccgcgctcctccgctggataaatcttcttgggacatatccaagtttgctatggtagcattagttgacatggactctgaggagattcaagtttacattgactactttgacattactttggttccagcaaccattttcttcttcaatgcccatcacatgaagatggattcagggacacctgaccacacaaaatggataggttcttttagcagcaaacaagactttatcgatgtagttgaggcaatattcagaggtgcgatgaaaggcaaactgatagtgtcttgcccccttcctcctgagaggataccaagattccagcttcttttcaaggatgtctgagaaaactgcagctcatcacgtgcacacaatcagctacctagcccaaggtaagtagaaaagctgaagcttctataagagaagcaccacagaggggacaatgcagggcgtgtcg

SEQ ID NO: 51404 - protein, 95 aa, Zea mays
  misc_feature: Ceres CLONE 1465970-F
MVALVDMDSEEIQVYIDYFDITLVPATIFFFNAHHMKMDSGTPDHTKWIGSFSSKQDFIDVVEAIFRGAMKGKLIVSCPLPPERIPRFQLLFKDV

SEQ ID NO: 51405 - DNA, 800 bp, Zea mays
  misc_feature: Ceres CLONE 1465972-F
  misc_feature: Encodes the peptide sequence at SEQ ID NO. 51406
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ggggcggtggcgtgttcgttttttttcgcggggnnnnngaaaannnncaaactggagctccccgcggtggcggccgctctagaactagtggatcccccgggctgcaggaattcgcacgagaccattacctagaacatcctaatcgaaaaatttcgatattcccagccccattccccgtcgcccggtcggaagcacccccagctaccagggatggctggcggggacgaggagaacgccacggagctaaagatcggcgaacagttcctaaaggccaagtgcctgatgaactgcgagggggcgatcatcctggagcgcaagtacgagcagatccagcaccacccctcgtccgagtcggacccgtcatcgcacgtgtcgcacgtgttcgagaagtcactgcacgtacgtgaagcgcttcagttgttaggggaaccccgacgacgggcaccaggtcctctagacgcccacctggtgttggtgctctccgagttcgaggttctgcacggctaggaacctctgccccgacaccagggcggaggccaccgcggctcgaccgctccctcaagtcaggcggctgggttcgtcctgtgaccccgggggacgagaaacaccgacaagatgctcaaacgaccttctcccctcatctagaattacgaagtagtgtcgggagcccctctcttccgctgtatcttccccttccccgaggagtacgcgagtcctccctgatcaggcacggggaaattcaccatcaaggactatcgcaccggggtgaaaattccaccttggggtcgtgccccacctag

SEQ ID NO: 51406 - protein, 98 aa, Zea mays
  misc_feature: Ceres CLONE 1465972-F
MAGGDEENATELKIGEQFLKAKCLMNCEGAIILERKYEQIQHHPSSESDPSSHVSHVFEKSLHVREALQLLGEPRRRAPGPLDAHLVLVLSEFEVLHG

SEQ ID NO: 51407 - DNA, 718 bp, Zea mays
  misc_feature: Ceres CLONE 1465973-F
  misc_feature: Encodes the peptide sequence at SEQ ID NO. 51408
  misc_feature (538)..(538): n is a, c, t, g, unknown, or other
aagctggagctccccgcggtggcggccgctctagaactagtggatcccccgggctgcaggaattcgcacgagaccattacctagaacatcctaatcgaaaaatcacaagctgtcacaaactcagcacacaatcatactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtaccgcgggaggaaggtgggggccaggacggaggtgcgggacctgtaaggcgacggcaacgcgcaggagctcggccgcccctccgtggccgagtacaaccggcagctccgagaaggtggcggcggcggcggcaggctcgagttcggcagggtggtggcggcgcagccgcaaggggtggcggggctcaagaactacctccccgtcntggccgtgaaaaagggcggcgcggggaacggcggcaagcgcgtgttcaacgccgtcgtcgtcttcaacccctggctcgactcgcgcaccctggtccagttcgcgcccgggggccccaagtaagccccggcgcctcccgccgggggtaacgcctagtggaagaatccctgggccggcccct

SEQ ID NO: 51408 - protein, 57 aa, Zea mays
  misc_feature: Ceres CLONE 1465973-F
MARALGACVLLAVLLGALAPAAAARAHDDQGSGAGIRQPSGEYRGRKVGARTEVRDL

SEQ ID NO: 51409 - DNA, 663 bp, Zea mays
  misc_feature: Ceres CLONE 1465974-F
  misc_feature: Encodes the peptide sequence at SEQ ID NO. 51410
aagctggagctccccgcggtggcggccgctctagaactagtggatcccccgggctgcaggaattcgcacgagaccattacctagaacatcctaatcgaaaaagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcacatctgtcagctatggaaacgttggccatgcttctcaagtatgaaataattccgttgtcacctcatgctacataaagcagattggtggtatgagttaaatcctgtgaaacttagcattctgtaaccgtgaatgtcgaggttaatgaagtcccttgggtgcggcctcaatcaagttctcctcaaggattgtatctgatgc

SEQ ID NO: 51410 - protein, 112 aa, Zea mays
  misc_feature: Ceres CLONE 1465974-F
  misc_feature (11)..(109): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGFEKQILRSGTGPKPIKGQKVTVHCTGYGKDRDLSKKFWSTKDPGQQPFSFSIGQGSVIKGWDEGVMTMQVGEVARIQCTPDYAYGAGGFPAWGIQPNSVLVFEIEVLSAQ

SEQ ID NO: 51411 - DNA, 732 bp, Zea mays
  misc_feature: Ceres CLONE 1465978-F
  misc_feature: Encodes the peptide sequence at SEQ ID NO. 51412
  misc_feature (352)..(352): n is a, c, t, g, unknown, or other
  misc_feature (358)..(358): n is a, c, t, g, unknown, or other
ggagctccccgcggtggcggccgctctagaactagtggatcccccgggctgcaggaattcgcacgagaccattacctagaacatcctaatcgaaaaacagatcggaggagagagcactgactcgtctcccttctcgtctccagcgacggcgaaggcgaagcggaggagcgggagcagaaacagaagaggcagccatggccgtgatggagaagctcaagatcttcgttgtgaaggagcctgttgtcgcagcttcctgtctcatcgccggattcggtctctttcttccagcagttgtccggccaatcctggattcatgggagaccgcagaaaaagttcctcccacacctctaantgatgntggtgcgggtgtcaccggcaagaaaaagtagtgaacttgcatttgtttctcatggccatgctgtccaaaattttcttccccatgtttttctgggcgtcagattggaaggctctccaaagtccgggcccccaagggaaggttggttgatttttaacagatccaaagggtttttgtctcaacccaattggaaaaatgggggtttaaaattgtccttttatccaaaaaaaaaggggtttttttcccgaaacaataccggagggggggcttttttaaaattttccccctaaaaaagggtggaaaaaaaaaaaaaaaaaaaatttttttttccccccccccccggggggggggccggcccactttccccccttatgggg

SEQ ID NO: 51412 - protein, 64 aa, Zea mays
  misc_feature: Ceres CLONE 1465978-F
  misc_feature (53)..(53): Xaa is any aa, unknown, or other
  misc_feature (55)..(55): Xaa is any aa, unknown, or other
MAVMEKLKIFVVKEPVVAASCLIAGFGLFLPAVVRPILDSWETAEKVPPTPLXDXGAGVTGKKK

SEQ ID NO: 51413 - DNA, 674 bp, Zea mays
  misc_feature: Ceres CLONE 1465982-F
  misc_feature: Encodes the peptide sequence at SEQ ID NO. 51414
ctccaccgcggtggcggccgctctagaactagtggatcccccgggctgcaggaattcgcacgagaccattacctagaacatcctaatcgaaaaaaaccgccgcttctgttctgatctgctccccgaaactactaaaacaaatcgaagtggggaacaaacaagagagaagggagatggcggaggcggttgcgtacgaggagcaacggcggaggcagatagaaatgaacaagcggaagctggaggagctgcagctccaccacctctccgccgccgtcagagaggccgccgccgctgccaaaccctcgtcggccaagaagcggaaggcgccggtgccgcgggacgtcgccacggagccgccaaggcggtccggccgactcgccaacctccctgagaagccaatgtaccgcgaggtcagggtgaacttgccatttccggaaggcagcaagtcgaatgcgcgagtgccgctggacgctgccaactctgtggtggcggagccgctacggtggtccgaccgactcgccaacctccccagaaagccacgtaccacgaggattttcgacgagagaggagctacgccatctctaaaggccaagagctggtgcaagaagctgggctccagcttccccatctcacccaggccatgacactgtcccatgtcttcggaagcctttggg

SEQ ID NO: 51414 - protein, 156 aa, Zea mays
  misc_feature: Ceres CLONE 1465982-F
MAEAVAYEEQRRRQIEMNKRKLEELQLHHLSAAVREAAAAAKPSSAKKRKAPVPRDVATEPPRRSGRLANLPEKPMYREVRVNLPFPEGSKSNARVPLDAANSVVAEPLRWSDRLANLPRKPRTTRIFDERGATPSLKAKSWCKKLGSSFPISPRP

SEQ ID NO: 51415 - DNA, 745 bp, Zea mays
  misc_feature: Ceres CLONE 1465984-F
  misc_feature: Translation starting site: 179
aaactggagctccccgcggtggcggccgctctagaactagtggatcccccgggctgcaggaattcgcacgagaccattacctagaacatcctaatcgaaaaagagaaattgtacacatattccctgcctctcgctagcgccttccctccgcaaacggaaggctctcgtgaccaccgggatgtccgccatggagaccgacatcaacgcgccgccgccgcccgccccagctggcgagggatcctctgcggccggtccgtcctcctcccgcaagcccaacaagcgcttcgagatcaagaagtggaacgccgtcgcgctctgggcatgggatatcgtcgtcgacaactgcgctatctgccgcaccacatcatggatctatgcatcgagtgccaggcgaaacaagccagcgcgaccagcgaggagtgcactgttgcttgggggagtctgaatcatgcttttcaccttcactgcatcaacaagggggctaaagactcctccagtgggccccattaataacagggggggggaattccagaaaaatggcccccaattcccggggcacccccagtggaagttggggccttactcccaggaacgcccccccccccaggggttttttttttgcccaaaaacccccacttttaaccgctttgggcccgcgggggtcccccgggcatttttccctgaaaaccccccccccggaaaattttttttttttctccttaaaaaaaaaaagccccctttttta

SEQ ID NO: 51416 - DNA, 756 bp, Zea mays
  misc_feature: Ceres CLONE 1465985-F
  misc_feature: Encodes the peptide sequence at SEQ ID NO. 51417
aagctggagctccccgcggtggcggccgctctagaactagtggatcccccgggctgcaggaattcgcacgagaccattacctagaacatcctaatcgaaaaattcattcacacaccacacctcccgaactacaagtttcgcttctcgtcgcgacgactgggcgagaccgccgccgccgcctgagttctgtagaaatggctgatggtgaggacatccagcctcttgtctgcgacaatggcactggaatggtcaaggctggttttgctggcgacgatgcaccaagggctgttttccctagtattgttggccgtcctcgccacactggtgttatggtaggggatggacagaaggatgcgtatgttgggcgacgagcacagtcccagagaagtattctcacgctcaagtatccgatcgagcatggtattgtgagcaactgggatgacttgaagaaaatctggattccccttttctaaaacaagttctggttgccccaaaagaccccctgggttggcccatgagagcccctttaaccccagggcccacgggggaaaaagaccccaaatttgtttccaaaattttaaagttcccggccagaaccttggaaattctaaggggggttttcctcttttggccgggggagtaccccgggggtttggtcccccccctgggggggggggggaaaccaacgtggccccctttttaaagagaaaagccccccccccgggactttttttttggagaatttttggggggggg

SEQ ID NO: 51417 - protein, 92 aa, Zea mays
  misc_feature: Ceres CLONE 1465985-F
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMVGDGQKDAYVGRRAQSQRSILTLKYPIEHGIVSNWDDLKKIWIPLF

SEQ ID NO: 51418 - DNA, 712 bp, Zea mays
  misc_feature: Ceres CLONE 1465991-F
  misc_feature: Encodes the peptide sequence at SEQ ID NO. 51419
  misc_feature (593)..(593): n is a, c, t, g, unknown, or other
  misc_feature (667)..(667): n is a, c, t, g, unknown, or other
aaactggagctccccgcggtggcggccgctctagaactagtggatcccccgggctgcaggaattcgcacgagaccattacctagaacatcctaatcgaaaaagatctagtaacgctgacattgtggtcccagagtggtgccttggcatacctgaccagctagcaaataggcccagccaactccgatcgcaccagcaccactgcaccagccgcccgcaacccgcaaagctgcttcccggactagctagggtttcgtgtacgccgcttgatctagtcctctctcccggcacgcgagggcgcagcgttgatggcggcggcaccggcggacgctaaggcggaggccgccaagatggacctcctcgaggacgatgacgagttcgaagagttcgagatcgaccaagaatgggatgaccaggaagaaggcaacgaagccgtccagcagtgggaggatgattgggatgacgatgacgtgaacgatgatttctcgctgcagcttaaggaagagctggacggaagcaacggccagaagagctgaaggattatttctccactttatataaatgatttttatatggcagctacttttggaaccgntgatgtgctttggatgtgaaagtttttggacctcagtcggcaaattgacagcactggacctggtaagtggtccntaggaaatggccctagcccaaaacccttgaatccgccacaatgcc

SEQ ID NO: 51419 - protein, 75 aa, Zea mays
  misc_feature: Ceres CLONE 1465991-F
  misc_feature (8)..(70): Pfam Name: DSS1_SEM1 Pfam Description: DSS1/SEM1 family
MAAAPADAKAEAAKMDLLEDDDEFEEFEIDQEWDDQEEGNEAVQQWEDDWDDDDVNDDFSLQLKEELDGSNGQKS

SEQ ID NO: 51420 - DNA, 728 bp, Zea mays
  misc_feature: Ceres CLONE 1466158-F
  misc_feature: Translation starting site: 191
aagctggagctccccgcggtggcggccgctctagaactagtggatcccccgggctgcaggaattcgtctcacccctaatcgaaaagagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagggccgtaccagggaaagccggatgccactttctccttcacggacaacgatttccttggaatcgccaccggcaagacgaattcgcagattgcattcatccgaggggcgattaaaatcaaggggagcatcagtgcggcgcagaagtttacccctgacatcttccccaagcctgccaagctgtagaaggttagattgtattacttggtcgaggtgaataataatgtttgcaagcttcaattactatgtacgagatacaatgagtgaaacatgaaaagcacgttctcggtgggaattcggatatggttgaacttccacttaaaaaaaaaaaaaaaacgagacgctcgaggtacccaattcgccctatagtgagtcgtattacgcgcgctcactggccgtcgttttacaacgtcgtg

SEQ ID NO: 51421 - DNA, 769 bp, Zea mays
  misc_feature: Ceres CLONE 1466166-F
  misc_feature: Encodes the peptide sequence at SEQ ID NO. 51422
  misc_feature (360)..(360): n is a, c, t, g, unknown, or other
  misc_feature (379)..(379): n is a, c, t, g, unknown, or other
  misc_feature (380)..(380): n is a, c, t, g, unknown, or other
  misc_feature (390)..(390): n is a, c, t, g, unknown, or other
aagctggagctccccgcggtggcggccgctctagaactagtggatcccccgggctgcaggaattcgtctcacccctaatcgaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagccctttcttccaggcctcgtggactacatcatctctggcccttgtntggccatggtctgggaggnncagagcgtcntcacactggccgcaagatcatggcgcaccaaccccctggcttcaaacccggaaccaccgtggggactttgcttggcaattggcggaagggctttctggaaaggaccctttgaagggctaaaaagaattgcccttggtttcccaaaggcccggtttttgaaaaaacccccccccccgggtttcaaaaaaaaacgggggattttccccccccctgtggacacaaaaaaacgccccccctttgttgttaaaagtttttaaaaaaaaatatattgtttttgggaaccttttttgggagcaaatttttttttttttaaaaaaaaaaaaaaaagggggggggagccccccccccaaagggggaaaattccccccccccccggctc

SEQ ID NO: 51422 - protein, 165 aa, Zea mays
  misc_feature: Ceres CLONE 1466166-F
  misc_feature (2)..(130): Pfam Name: NDK Pfam Description: Nucleoside diphosphate kinase
  misc_feature: SWISSPROT Homolog: EC 2.7.4.6 Nucleoside-diphosphate kinase
  misc_feature (71)..(71): Xaa is any aa, unknown, or other
  misc_feature (77)..(77): Xaa is any aa, unknown, or other
  misc_feature (81)..(81): Xaa is any aa, unknown, or other
MESTFIMIKPDGVQRGLIGEIISRFEKKGFYLKALKLVNVERSFAEKHYADLASKPFLPGLVDYIISGPCXAMVWEXQSVXTLAARSWRTNPLASNPEPPWGLCLAIGGRAFWKGPFEGLKRIALGFPKARFLKKPPPPGFKKKRGIFPPPVDTKKRPPFVVKSF

SEQ ID NO: 51423 - DNA, 717 bp, Zea mays
  misc_feature: Ceres CLONE 1466169-F
  misc_feature: Encodes the peptide sequence at SEQ ID NO. 51424
aaagctggagctccccgcggtggcggccgctctagaactagtggatcccccgggctgcaggaattcgcacgagaccattacctagaacatcctaatcgaaaattgagggacaacagaggacaacactagacagtactgtcccaacccttgacccagaaccaaacaacttaatttgagggatcgtcccatcccgtcctgtcattgcaaccaaacgcaccatagttcgcagtgatgcttgcgccagggctggatgtggatgttagatcagtactacaatgataggcagtagagtcattaggtagcattacgtgtgattgtgggactaatcactgtctgggctggtgtgtatactttatcacgcactgtccatcagccaaaaaaaaaagttcagttgtgcgatggaacattatcatgacattgcatgccaatagccagtgctcaacgcaacgcagccactggactctgaaacgccgtcgtgcctctgtcgtcgacgcagggcccgcggaccgccgtgcggcggaggcgaccggaccggacggcgcggcctgccacgacgagccgcagccgctgccgctgcgcctgcgcacgctgcggtcgctgacgatgcggacggcgagcacgggcgacctccggagcgccatggcggaggacatgcccatggtgtcgtacaaggcggagggccccggcgggcgcaagacggacgggttctgaaaaatt

SEQ ID NO: 51424 - protein, 99 aa, Zea mays
  misc_feature: Ceres CLONE 1466169-F
MTLHANSQCSTQRSHWTLKRRRASVVDAGPADRRAAEATGPDGAACHDEPQPLPLRLRTLRSLTMRTASTGDLRSAMAEDMPMVSYKAEGPGGRKTDGF

SEQ ID NO: 51425 - DNA, 723 bp, Zea mays
  misc_feature: Ceres CLONE 1466174-F
  misc_feature: Translation starting site: 436
  misc_feature (539)..(539): n is a, c, t, g, unknown, or other
caaagctggagctccccgcggtggcggccgctctagaactagtggatcccccgggctgcaggaattcgcacgagaccattacctagaacatcctaatcgaaaaataaaaaggcgctcgagatccagatctgggccgatgcgaccgccctcgctgctctccctcaccctcgacgccgcgctcctccgcatcgccaatatcgccgacctctcccacctcccagaccacctcctcatcgacctcttccgtagaaccctcagtgctggtaagctgacagagaaagttctcaagttgtttctagcaaccggctgtgaggatatcatattggctgttcggttgctcaacattaagcagccactcgtaccagtccttcccacaaggtgctctgagagattctagatctgctgccgcccacatcgttttgattacctgagaagatgcctttggaaatttcagatagtgaggttgacatagtgattgcggcactccagcccaaccctgacactttctttgaggcatggcgaccatttttctcccgttnccacatcattgtcgtcaaagatccagacatggcagaggatcttcaaatccctgcaggttttgatctcaaggtttacaccaagtcagatattatggggtggctgggggcctcctcaccataaacttatctggccccccatgcggtactttgggtatcttgcccaccgcagaagtatgggatttcg

SEQ ID NO: 51426 - DNA, 836 bp, Zea mays
  misc_feature: Ceres CLONE 1466184-F
  misc_feature: Encodes the peptide sequence at SEQ ID NO. 51427
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (477)..(477): n is a, c, t, g, unknown, or other
  misc_feature (767)..(767): n is a, c, t, g, unknown, or other
gaaaagggccaccaaaaaacccgacccccaaccccnnnnntaaccccccccaaactggaactccccgcggtggcggccgctctttactagtggatcccccgggctgcaggtattcgcacgagaccattacctagaacatcctaatcgaaaaaatgccggcgccacagcgatcggcaggcgaggcagtggtgcgtgcagcgctgcgagcgtaagcaacaggaggaggacgccgccgccgacgacgacaacagcggccggtgccagaagagatgccagcaccacagcgatcggcaggcgaggcagtggtgcgtgcaacgctgcgagcgtaagcaacaggaggacgccgccgccgacgacgacgagaacagcgaccggtgccagaaaacatgccccccgcacagcgactggatgaaaagggtgcggtgcattgcaaggagggtgaaaaaagaggagggtatgctaacatttgtatgtacnaaaaacttattccagctccgggtgaccacgtgccacaaaaaagtgcctagcaatcatcccctttttattaccaacaaggcgggagacaaagggcagtgggtcaaattgcctgtccaccggtcgggggctagggaaaaccaataggattgggcgccccccttttggagcgcggtttttatccattccaaccaagggaccatggtccgcggcatcccacaacctataaacgcaatacctgtattttgtgccccggttactcttgacccccccacttcgtatcctcccgcccnggttttcgactcgcaatccatacgctgggggcctttctttccttccatgcctttatcccttttagttga

SEQ ID NO: 51427 - protein, 70 aa, Zea mays
  misc_feature: Ceres CLONE 1466184-F
MKRVRCIARRVKKEEGMLTFVCTKNLFQLRVTTCHKKVPSNHPLFITNKAGDKGQWVKLPVHRSGARENQ

SEQ ID NO: 51428 - DNA, 795 bp, Zea mays
  misc_feature: Ceres CLONE 1466186-F
  misc_feature: Encodes the peptide sequence at SEQ ID NO. 51429
  misc_feature (402)..(402): n is a, c, t, g, unknown, or other
  misc_feature (403)..(403): n is a, c, t, g, unknown, or other
  misc_feature (644)..(644): n is a, c, t, g, unknown, or other
  misc_feature (676)..(676): n is a, c, t, g, unknown, or other
  misc_feature (677)..(677): n is a, c, t, g, unknown, or other
  misc_feature (680)..(680): n is a, c, t, g, unknown, or other
  misc_feature (681)..(681): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (694)..(694): n is a, c, t, g, unknown, or other
  misc_feature (730)..(730): n is a, c, t, g, unknown, or other
aagagctggagctccccgcggtggcggccgctctagaactagtggatcccccgggctgcaggaattcgcacgagaccattacctagaacatcctaatcgaaaaaccacgtcaccgaaactgtagacgaggaggacaagggtcaagggaaagaaagccaaccgccccaatctcgcgtcccgccggcggccaccaccaccaccgccatgatcagcatcctcgcgcaggagcgcctcctcgggttcgccctgggctccgtctctatgggaggtttcgtcctccaccagcgccgcgccatctaccgctcaatcgttgaagctgatgggtcgtcctacttctaccaccctggtgaaattgctgggcgtaaaagttcaactggagcggggtcatgtatggaacaaggnngtggcccccaccccctgagaaacttggttggggaccctcacccctcggggatgggggatccaacgccccttggcgaacattgtaaatcgaaaaaggcccgggcggaggaaaaattcgtttttgaaaccccctgaggggcccagctttccccggattccccgattgagcatgggctgtttttataaaacaaaaaaagggccctctggggccggcaatttttttccccagctcggaccggaancctcaccgggaggcttccgccctctaccaggnnganngnnnnctctcganccaaaggtggctctataccatacagggaagatgcgncggatccgcctaccaccaaagatctggtggtatatttactgtgttccccgcccacgtctttctcg

SEQ ID NO: 51429 - protein, 110 aa, Zea mays
  misc_feature: Ceres CLONE 1466186-F
  misc_feature (67)..(67): Xaa is any aa, unknown, or other
MISILAQERLLGFALGSVSMGGFVLHQRRAIYRSIVEADGSSYFYHPGEIAGRKSSTGAGSCMEQGXGPHPLRNLVGDPHPSGMGDPTPLGEHCKSKKARAEEKFVFETP

SEQ ID NO: 51430 - DNA, 779 bp, Zea mays
  misc_feature: Ceres CLONE 1466188-F
  misc_feature: Encodes the peptide sequence at SEQ ID NO. 51431
  misc_feature (357)..(357): n is a, c, t, g, unknown, or other
  misc_feature (498)..(498): n is a, c, t, g, unknown, or other
  misc_feature (589)..(589): n is a, c, t, g, unknown, or other
  misc_feature (595)..(595): n is a, c, t, g, unknown, or other
aagctggagctccccgcggtggcggccgctctagaactagtggatcccccgggctgcaggaattcgtctcacccctaatcgaaaagaatgaatcttgctgtaccgctctgtgctgcgagactggaagagactccacggagacaccacatggccgccgccggcgacggcggtgagtcccactaccgggaggcgctccgcgaggccttcggtgactcgtcgagcagcgattccgacacacccgtcggtgtcagccccggagcaggccgcgggcactggaggtgggaggcggtggctggggtcagggggctgtggctctgcgccgccttcctctccgccgacgagcaggcgcgcctcctncacgccatccagcgagaaggatggtttattaatgcagacaaccaagcgatgagattcggcgacctcccttcgtgggcagtcgaactttctgcacttatccgcgaagctatctgcgtcggcgacaccagtgtcggtcttggntgcgaggggacgaacgaggacgaagatgcgtggcctctgccatcagacttgttgtggcgggagccattttttgatcagatgatcccgaacngatccngaccagggcatctgggctcacgtcgatctgatgccctttgatgaaggaatccggatcctccccctcaagtcagcctgggggatgcctttcgtcaaacaaaaccgcctctgactccccaaccaagggggcattgcccttgatccccgggagaggcccccttttgttaaacccgggccccttgggc

SEQ ID NO: 51431 - protein, 162 aa, Zea mays
  misc_feature: Ceres CLONE 1466188-F
  misc_feature (148)..(148): Xaa is any aa, unknown, or other
  misc_feature (150)..(150): Xaa is any aa, unknown, or other
MAAAGDGGESHYREALREAFGDSSSSDSDTPVGVSPGAGRGHWRWEAVAGVRGLWLCAAFLSADEQARLLHAIQREGWFINADNQAMRFGDLPSWAVELSALIREAICVGDTSVGLGCEGTNEDEDAWPLPSDLLWREPFFDQMIPNXSXPGHLGSRRSDAL

SEQ ID NO: 51432 - DNA, 700 bp, Zea mays
  misc_feature: Ceres CLONE 1466189-F
  misc_feature: Encodes the peptide sequence at SEQ ID NO. 51433
  misc_feature (262)..(262): n is a, c, t, g, unknown, or other
  misc_feature (265)..(265): n is a, c, t, g, unknown, or other
  misc_feature (268)..(268): n is a, c, t, g, unknown, or other
aagctggagctccccgcggtggcggccgctctagaactagtggatcccccgggctgcaggaattcgcacgagaccattacctagaacatcctaatcgaaaaaaaacccaagcctgaggtggagaccgcacgggtcaccagtcaccacatccctccctccctgccatttgtttggttgttcctctcgcagtctcgctcgccaccaggcagcaggcatcccaatctcgcgagagccagtagcggcggcggcggcggcggcttcntcnccncctcctccatgacgtccgccgccgcctccaccagggaggagaacaagaagacatttgctcctccgaaggaggaacatgtccaggctacacattcgatgccgtctcacaagattgaaattatcaagtcacttgatgattgtgctaaacccaccaccatgacacttctcaagccagacaagaagtgttggcagccacaggatttcctccctgacccatcatctgaaggatttcatgatgaagatgaggagctaaaagaacgtgccaagaagatccctgatgattattttgtttgtttggttgaagacatgattactgaggaagctctaccaacatacaagactatgattaacatcctcgacggcgtaagagatgagacaggagccaccaccactgcttgtgctgttaggacgacgacatctactgctgaggaca

SEQ ID NO: 51433 - protein, 141 aa, Zea mays
  misc_feature: Ceres CLONE 1466189-F
  misc_feature: SWISSPROT Homolog: EC 1.14.19.2 Acyl-[acyl-carrier-protein] desaturase
MTSAAASTREENKKTFAPPKEEHVQATHSMPSHKIEIIKSLDDCAKPTTMTLLKPDKKCWQPQDFLPDPSSEGFHDEDEELKERAKKIPDDYFVCLVEDMITEEALPTYKTMINILDGVRDETGATTTACAVRTTTSTAED

SEQ ID NO: 51434 - DNA, 777 bp, Zea mays
  misc_feature: Ceres CLONE 1466199-F
  misc_feature: Encodes the peptide sequence at SEQ ID NO. 51435
aagctggagctccccgcggtggcggccgctctatactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccacgcgacctcttttttttcctaagaacgtacattgtcatttttggaagcttctgaaagcatggcgtgcgcgtgaactatgaatgtatgagtcactccgaagctaaactgtttgagtactatgctaagctgaggagctgcattcacatcatggtgtgaagcgcgaggaaaggttctttatcgggacagccccctttgacccgacgaatcagggcccccccaagccggggaacacctgggtttggctttggaaagaaaacaccccccgggtttgcccaaaggctatcccgaccgggagaaaacaggttctttttaatcccaggggtacccccccccaaaaaatggggggcccctttgaaaaggcgcgaaaaaagcctctcaaaaaaaaaaaaaaaaaaagagcggggggaacccaatccccccaaagggggagttaaaccgcgccccccgggcggtttttataaag

SEQ ID NO: 51435 - protein, 72 aa, Zea mays
  misc_feature: Ceres CLONE 1466199-F
SWSSPRWRPLYTSGSPGLQEFVSPLIENKWERQRFGLQGGFVTNPLAEPNISSAGKTMVTHEGRKKDKTLQK

SEQ ID NO: 51436 - DNA, 896 bp, Zea mays
  misc_feature: Ceres CLONE 1466209-F
  misc_feature: Encodes the peptide sequence at SEQ ID NO. 51437
  misc_feature (39)..(39): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (450)..(450): n is a, c, t, g, unknown, or other
  misc_feature (468)..(468): n is a, c, t, g, unknown, or other
  misc_feature (490)..(490): n is a, c, t, g, unknown, or other
aaagcccccgacccagcaaacccaaacaccccccccccncccacnncnnncctcatactgggactcaccgcggtggcggccgctctattctagtggatcccccgggctgcaggaattcgcacgagaccattacctagaacatcctaatcgaaaagccatcttgtgcatttgtgctaacacccattgccccaggccctccggcgccgcccacctccaccgcctggaatccaggacatccggcgccgcccacctccgtcccctgtctgctgcctcgactcaactgttttgctgcgatgggtttattcaggggcagttttactcccttcgcgcgaatggtatgtggtgtgcgtatagttccgaattccaccgtcagtaatgtctaaacctttcccacaacatatgttttttcgggaacattggttgtggggaattgttaaacctatcctaaanaaaaaaaaaccaattaantggcgcgaaccacgtttgtganacttttgtggtaattggtgcagagatacttgggcgaagatggaagccattttttacaacttttacaaccccgcctatctgtggagatttttggacaaaaacccccccccaccgccccctgaggggaaaacggggtaaagtgtgtggcaagacttatcccctttattccgttatataaacccttacgtgtcttcttacgttggtaccccaaggcactattttaaaagacgcccgctatttatttgtcctcggtagagccattttcacccccccccatgataaactctctgtcctttctatatgcttataataaaaacacaaatcacaccagtgggattttttatgtttgggaatccgccctctctgtggggggtggcgccatgcaatacacccactgttctcttatg

SEQ ID NO: 51437 - protein, 29 aa, Zea mays
  misc_feature: Ceres CLONE 1466209-F
MGLFRGSFTPFARMVCGVRIVPNSTVSNV

SEQ ID NO: 51438 - DNA, 767 bp, Zea mays
  misc_feature: Ceres CLONE 1466211-F
  misc_feature: Encodes the peptide sequence at SEQ ID NO. 51439
  misc_feature (668)..(668): n is a, c, t, g, unknown, or other
aaagctggagctccccgcggtggcggccgctctataactagtggatcccccgggctgcaggaattcgtctcacccctaatcgaaaaacttccgtcattcgcctccactcccccctcgcatgtgctgcccacgtaagtccgttgcgggaatgaccactcgcttcatgaagaaccgtatgaagtgcggcctcgtgtccgccgggcacagacgtttctcatggctttagatgcacccggttaggtcccggcaacgccggtggcatgctccatcaccgtatcctcttcaacaagtaccatccgggctacttcctctatgctgatatggttcacttccttaagttccacaacttgttctacttgtccgcggtaaatatcaagcgccactggttcatggtgcccacccaccatgtcgcttaggccgtctcttacaatgccccgcatatccacctctcgacgttctgctacttcaatgtgctcggcaatgcggagctgccgatctagcccattgtcttcaaggacaagctcatctcccatgtcactccataagaatatcaacgcagcttagctgcgctcgtcgtgcgtcttccacctatgtttcgcatccttgtatcactgcctgtgttttgagatctgatatcatgaactgatcttcgctgttccctgtctctngcaatattgtgcttaaaagaatctcgtcagatttaaatatatcgtggtctcctagccttagtttgcgcagagactgtatcgcgggtatttatgaagaca

SEQ ID NO: 51439 - protein, 51 aa, Zea mays
  misc_feature: Ceres CLONE 1466211-F
MLHHRILFNKYHPGYFLYADMVHFLKFHNLFYLSAVNIKRHWFMVPTHHVA

SEQ ID NO: 51440 - DNA, 714 bp, Zea mays
  misc_feature: Ceres CLONE 1466212-F
  misc_feature: Encodes the peptide sequence at SEQ ID NO. 51441
aaagctggagctccccgcggtggcggccgctctagaactagtggatcccccgggctgcaggaattcgcacgagaccattacctagaacatcctaatcgaaaaagatcccaaggaaggtcgaacatgtggtgcgccgcggccgcgccaactctccgctcgccggtcacggtattttctgtggcggagacaggcggcgccaccgttgacgctagaaaatggggaattgatttgatatagcacacgaggaactaaatactctccctactctcttcggcgttcttcggttgttgctctgtatccttacctaccttcgtggcaacctgcgctcgcgccatcagcgcgtcgatccatcaactccatggcgtgcagcttcccgccttcctccgccacgaggctccatgccttggacgccgcggcggcgggggtgaagaacggcagggtccccctcaaggcctccgtcgcccccgcgcagagggcactcggttgctgcagggcgaccgcgcggcaggaaggcgctacacaggaacccagtgttgcagcttcttcggcccgtgcacagctggacctcctggagcaactgacgtccgccacacctgatgacactgcggctggcctggagaacggcatgcctccaccagcagaaccgcgtcggcgtgctaccatccgcgagcagctgtcagcgctagccaacggtaaggtcgacgagttcaccct

SEQ ID NO: 51441 - protein, 118 aa, Zea mays
  misc_feature: Ceres CLONE 1466212-F
MACSFPPSSATRLHALDAAAAGVKNGRVPLKASVAPAQRALGCCRATARQEGATQEPSVAASSARAQLDLLEQLTSATPDDTAAGLENGMPPPAEPRRRATIREQLSALANGKVDEFT

SEQ ID NO: 51442 - DNA, 763 bp, Zea mays
  misc_feature: Ceres CLONE 1466215-F
  misc_feature: Encodes the peptide sequence at SEQ ID NO. 51443
  misc_feature (395)..(395): n is a, c, t, g, unknown, or other
  misc_feature (400)..(400): n is a, c, t, g, unknown, or other
caagtgtggagctccccgcggtggcggccgctctagaactagtggatcccccgggctgcaggaattcgcacgagaccattacctagaacatcctaatcgaaaatccgcagtgcaaagcgtcaacgcaaacagaccaagatccagaagcaagaaagtgtttatagcctagccggtgcgcgcgcgagagggatagccgattatcatcaagctctgagctagcagagaagatgagcgcatcgtcgtccatgaccaagaaggcgtcgtcgttcgtggtggcggcgagcatgagcgcggtggaggcgctcaaggaccaggcggggctgtgccggtgggactacgcgctccgctccctctacaaccgtgtggtcgccgccaataagggcggggggggcccnccccntcccattatccccccccctctgttccaaaccgcgggtggcagtgtgcgctcccgcggccggcgcggagggcctccaggccccaagctatccggaggaggaaataatgcacaagggcgtacctttctcttctggctggggccctaaacttattgttacggggcaatcttcttattgtttcccccccttaaacccccctgcgcccgattccccccgcgcccggggcgatagacccgccccggacgttttctgcggcatgttcccaggctgtgtaccggtccttccgggacggtcaagcgacccccccgcatccccttataacggattggctgtgaataaaaacacgggtaacgaccctccttttt

SEQ ID NO: 51443 - protein, 105 aa, Zea mays
  misc_feature: Ceres CLONE 1466215-F
  misc_feature (58)..(58): Xaa is any aa, unknown, or other
MSASSSMTKKASSFVVAASMSAVEALKDQAGLCRWDYALRSLYNRVVAANKGGGGPPXPIIPPPLFQTAGGSVRSRGRRGGPPGPKLSGGGNNAQGRTFLFWLGP

SEQ ID NO: 51444 - DNA, 773 bp, Zea mays
  misc_feature: Ceres CLONE 1466217-F
  misc_feature: Encodes the peptide sequence at SEQ ID NO. 51445
aaagctggagctccccgcggtggcggccgctctagaactagtggatcccccgggctgcaggaattcgtctcacccctaatcgaaaaatcattaccgcgccagcccggatgcctcgggaacagaaggagacgcccaaaattccagcggcgacgtcgtgaccacacctaatgtccttcgccctgcggaatgcggacccctgttcctacggcccgtcccctaccgcgctcttgatggatcgggcgccgagcacatcgctcccgccgctcgtggcctctggattactgggatcaccaattcgatcgcctcctgctgactgcctgccccctatgaagaccatcggccatatcttccacccaaggatgcatgcgccatgtcgcttcctctccgcattcattgcttctacgtgctacggaaacatctgccgctcgtacggatcctcggcgccatcggtggacttccacgcttgcctgtacgtggaccattcgcataagcctgctctgacctcatgatccctcctgcgtgcctgatcatgtatgttctcatcgctcgtagatcctgacacgcccatggtggctctatcgccatacatgatagtcgtctccaacctaccatatgatgtgtccgacccgacagatctctgcctttgctcatgcgacgttcgtcgcgtcatgcatgtacaactttttggtgaggatgctgacagtgatgtccatgttaaattctcgggccgacattcgggagaacactgtaaagttcttcatgcgaacggagtt

SEQ ID NO: 51445 - protein, 113 aa, Zea mays
  misc_feature: Ceres CLONE 1466217-F
MSFALRNADPCSYGPSPTALLMDRAPSTSLPPLVASGLLGSPIRSPPADCLPPMKTIGHIFHPRMHAPCRFLSAFIASTCYGNICRSYGSSAPSVDFHACLYVDHSHKPALTS

SEQ ID NO: 51446 - DNA, 761 bp, Zea mays
  misc_feature: Ceres CLONE 1466218-F
  misc_feature: Translation starting site: 207
aaagctggagctccccgcggtggcggccgctctagaactagtggatcccccgggctgcaggaattcgtctcacccctaatcgaaaaacacacaacaccagtcaccagctcatcacatccatctcattctactactgcctcagagaccaagctgctgcaaccggagaaggagatctattctacaaagtgaagtacttagcttgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgcgccgccgccgaggaggaggcagacaagaagcgcgccgccgccgaggaggaggcagacaagcagcgcgacgcggagacagcacccccggcggccaagtgagtagctagatctgagcaccgaaacgttcagagggaaccgaacgtgtgtctctcgtacgtacgttacgtgtacgtacgtagcatatctatctcttctgtgcgcatatgctgccggtggtgctcacgcgcgccagctacttgtcaccaactcttgcagggcgcccgtggtcggatggccaccggtgaggtcgtaccggaagagctgcttccagcaggcaaagcagcaggccgtcagcagcagcagcagcaaggcggccgacaaagaggatgctgcggcgccggcgccgagctgcacggcgtccgcagccgcctc

SEQ ID NO: 51447 - DNA, 720 bp, Zea mays
  misc_feature: Ceres CLONE 1466220-F
  misc_feature: Encodes the peptide sequence at SEQ ID NO. 51448
  misc_feature (434)..(434): n is a, c, t, g, unknown, or other
  misc_feature (476)..(476): n is a, c, t, g, unknown, or other
agagctggagctccccgcggtggcggccgctctagaactagtggatcccccgggctgcaggaattcgcacgagaccattacctagaacatcctaatcgaaaaatcgtttatccacggaacttccggtgccggcggcgaccacttgtggcgatccatccctcaccatgtcgtcggagaaggaggcggcgctcgccgccgtgctcgatgacagcccaaccatatttgacaagatcatcaaaaaggaaataccttctactgtggtttatgaggacgagaaggtactggctttcagggacataaaccctcaagctccaacacacattctcatcatccccaaagtcaaggatggactaactggcctggcaaaggctgaagagaggcacatagaaatacttggctatctcctctatgttgccaacgctgttgcgaagcangaaggacttgaagatggctatcgcgtcgtcatcaatgacggncccagtggatgttcatctgtttaccacatccacgttcatctcctcggaagcaggcaaatgaactggcccccagctaaaaatatctgtgattgatcagggctaatgccaaggactgctactccattctctctagataatccctgaaatttccataaaagctagggccattgccctaacttgggcttattttgggaaatcccggaacatggttcttgttttttaattggcaacaaaaatttgaccg

SEQ ID NO: 51448 - protein, 134 aa, Zea mays
  misc_feature: Ceres CLONE 1466220-F
  misc_feature (25)..(124): Pfam Name: HIT Pfam Description: HIT domain
  misc_feature: SWISSPROT Homolog: EC 3.6.1.29 Bis(5'-adenosyl)-triphosphatase
  misc_feature (90)..(90): Xaa is any aa, unknown, or other
MSSEKEAALAAVLDDSPTIFDKIIKKEIPSTVVYEDEKVLAFRDINPQAPTHILIIPKVKDGLTGLAKAEERHIEILGYLLYVANAVAKXEGLEDGYRVVINDGPSGCSSVYHIHVHLLGSRQMNWPPAKNICD

SEQ ID NO: 51449 - DNA, 742 bp, Zea mays
  misc_feature: Ceres CLONE 1466221-F
  misc_feature: Encodes the peptide sequence at SEQ ID NO. 51450
aaagctggagctccccgcggtggcggccgctctagaactagtggatcccccgggctgcaggaattcgcacgagaccattacctagaacatcctaatcgaaaaccccacctcgctcgcgcaagtcgtcgcacccttccccaggccccagccccagctagccatggcgaccgcgccgcggaggctgctccccgcgctcctcaaggccctagctccagccggcgcgcgcggcctctccaccgagaaggctgtcggcgccgccgccgtcgctgtcgtgggcagccacaccgctaagtggatgcaggacacgagcaagaagtcaccgatggaactgatcaacaaggtacctccgatcaaggttgatggccgcatcgccgtttgtgaaggggctgctgaaggtgttgggcttgcccacccatcgagtatatctgccttgatctggaggcaccccacgtgtgcaaatactgtggcctccggtatgttcaatttcaccatcactaaataggggagatactggcgtttacggctgcaaaagtttgaacctgagaactttatgcatgcccccttgttcccttaagttctgggacgggacttccacctatggttgggcggcaaaacattaacttttgaggaccacccccttttgggaaaaaatttttaaaaaccgggggaaactgtggaaaaaaaaaaaaaaaaaaagttttttctcccccccccccccggggggggggcccgggcccccatg

SEQ ID NO: 51450 - protein, 113 aa, Zea mays
  misc_feature: Ceres CLONE 1466221-F
MATAPRRLLPALLKALAPAGARGLSTEKAVGAAAVAVVGSHTAKWMQDTSKKSPMELINKVPPIKVDGRIAVCEGAAEGVGLAHPSSISALIWRHPTCANTVASGMFNFTITK

SEQ ID NO: 51451 - DNA, 777 bp, Zea mays
  misc_feature: Ceres CLONE 1466222-F
  misc_feature (777)..(777): n is a, c, t, g, unknown, or other
aaagctggagctccccgcggtggcggccgctctataactagtggatcccccgggctgcaggaattcgtctcacccctaatcgaaaaattttactagatctttctacaaactcatacctggtgtcagggttacctaccgtgacattgaagctatcaatcctgcatactacaagaatttgcaatggatgctcgagaatgacataagtgatgttttggatctcaccttcaccacggatgcggacgaatagaaacgtgatattgtactagaaggccgacgtcactgattgtgagttgattcccggagggcataacatcaggcttactgaggagaataaacatcaatatgtggatcgggtagcagagcatcgactgacgactgcactcatgcctctcattgatgccttcctggaagcgcctaacgaactcattccgcgggagctgatatctatcttcatccacgaagagcttgaacttccgattagcggtcttccacatattgacttgaacgatttgaaaccaaatgctcaatatcctggctacaggatagccgctccagtcatccagtgtttctgggaaatcgttcacgggtgcagcaaggaagacaaagcccggttcctccagctcgtcactggtacttcataggtaccgctggaagttttagtgcacatcaatggatcgctgtgccacgaaggtctcagatacataacggctagcggagcacgaagcatctgcccttcgctcatacttgcttttaccaactagaccttgctgactagcn

SEQ ID NO: 51452 - DNA, 737 bp, Zea mays
  misc_feature: Ceres CLONE 1466224-F
  misc_feature: Encodes the peptide sequence at SEQ ID NO. 51453
  misc_feature (400)..(400): n is a, c, t, g, unknown, or other
  misc_feature (414)..(414): n is a, c, t, g, unknown, or other
  misc_feature (437)..(437): n is a, c, t, g, unknown, or other
  misc_feature (466)..(466): n is a, c, t, g, unknown, or other
  misc_feature (508)..(508): n is a, c, t, g, unknown, or other
aaagctggagctccccgcggtggcggccgctctagaactagtggatcccccgggctgcaggaattcgcacgagaccattacctagaacatcctaatcgaaaaatccgccacagccgaactggcccgatgtcgctggttgcctacgatgcctcctccgatgaggaagacgccggcgagcctgccgccgccgcggcgccacaccctgcccccatcggtccgcagccaaggcctccgtctcctacggcagtgagccctgctcctcggcctacgcctacgcttacgccgccgccgccagcagccagccagagtgtagcaccaattagttcgagtgatgtctctctgcccacatcatcattagatctcccagatgttgcagatctctttgctccccctgcagacnatgcatcaaggaangagggaatcaaatggggtctgcntcttcatgactcgcggcataaatttccanggatgccattcacaattcaaaggcataagaagtgctgcaggnaaccgcccaaattccccccagccttcttggaaagagccatgttgttacccgaaaccttgaccaaactttttggggcttacccaaaaaagaaccttttaccctttttgggacctgacccttgtttgggacccctaaatggaaaaccctttttcctggggcacagggttggcccccttgtccccggggttttttgctcccccaaaaccccccaaagagttttcctggggga

SEQ ID NO: 51453 - protein, 203 aa, Zea mays
  misc_feature: Ceres CLONE 1466224-F
  misc_feature (92)..(92): Xaa is any aa, unknown, or other
  misc_feature (96)..(96): Xaa is any aa, unknown, or other
  misc_feature (104)..(104): Xaa is any aa, unknown, or other
  misc_feature (114)..(114): Xaa is any aa, unknown, or other
  misc_feature (128)..(128): Xaa is any aa, unknown, or other
MSLVAYDASSDEEDAGEPAAAAAPHPAPIGPQPRPPSPTAVSPAPRPTPTLTPPPPAASQSVAPISSSDVSLPTSSLDLPDVADLFAPPADXASRXEGIKWGLXLHDSRHKFPXMPFTIQRHKKCCRXPPKFPPAFLERAMLLPETLTKLFGAYPKKNLLPFLGPDPCLGPLNGKPFFLGHRVGPLVPGVFCSPKTPQRVFLG

SEQ ID NO: 51454 - DNA, 806 bp, Zea mays
  misc_feature: Ceres CLONE 1466225-F
  misc_feature: Encodes the peptide sequence at SEQ ID NO. 51455
  misc_feature (486)..(486): n is a, c, t, g, unknown, or other
  misc_feature (626)..(626): n is a, c, t, g, unknown, or other
aagctggagctccccgcggtggcggccgctctatactagtggatcccccgggctgcaggaattcgtctcacccctaatcgaaaaaacagtccgtatattccgctcataattcctcaccggcctgcctcagagagagaaaaagcggagattagcggcggcgatggcactcccggcgtcgagctccggcctcttccgcttcgtctccccgcgcagccgcccccagtccaccgacatcgtggctgccgcctcctggggagtcttcgccggcaccgccggcctctacctcgtccagccatttgactggattaagaaaactttcttcgagaaaccccaaccagaggcataaaaggcttgcaagtctgcaactttggtacttcacttttatccgggatggttcctgactgaagagaccccccactactccacaaataataccgagacccccctcgggtttcccttggttgggtttttatatttcagatgganggcaattccccaccaggggagaccagggaaccggagaaccggcttgggttccacctggggcctaaataaataccccctggggtatcccaacctgcctggttttaaaaaccgtggggaaaataatttcttggctggatttnaaaaaaaaaaaatttaaaaaaaaaaaaaaaaaaacggaggcgccccggggggcccccacttcccccctaataggggagtccatattacccccccccccctgggcccggtttttttaaccccgctgtggtggagaaaacccgggggttccccctatttttccctttggggaaatccccccg

SEQ ID NO: 51455 - protein, 61 aa, Zea mays; identical to SEQ ID NO: 45456
  misc_feature: Ceres CLONE 1466225-F

SEQ ID NO: 51456 - DNA, 772 bp, Zea mays
  misc_feature: Ceres CLONE 1466226-F
  misc_feature: Encodes the peptide sequence at SEQ ID NO. 51457
  misc_feature (277)..(277): n is a, c, t, g, unknown, or other
aaagctggagctccccgcggtggcggccgctctagaactagtggatcccccgggctgcaggaattcgcacgagaccattacctagaacatcctaatcgaaaagccgacaaggatggcgtcgtggtcgtcgccctcatccgccgccgccgcctcgggcgcccgattcggccccttcccgagccgagcgcagcggctcgtgccgtatccgtcgctcgcccgcggaaaccccgcctcgacgctcgtcctcaggccccacccggacgggcgtgggcatggnctcctcgcgcacacggcttcttcttctcgcggtgccgcgccgtcccccgccaaggtcaagggcttcaaattcgccaacccggtaggcccactcatcgggaaagacccccagggaaattttccaaaaaccccccccagggctcctgtccccaatggttggtggcaacctctgaaatttaggggcccctgtttttaactccccagggacggggaggggggcccctttggaaaaaatggtccctaaaaaaaaggggttttttttcccccggggaaaaggggttttttgggggacccccccacggggaaaaaaacgcggcggggggccggccctctttggggggccccccccggaggaaaatggttgatattaacagggccctctccctctggaggggggggggggaagaggcccccctcaccacttttgtggggggaaaatttttctcttttcgcccccaaagaggggagaagggcccccctaaagggccgctatata

SEQ ID NO: 51457 - protein, 119 aa, Zea mays
  misc_feature: Ceres CLONE 1466226-F
MASWSSPSSAAAASGARFGPFPSRAQRLVPYPSLARGNPASTLVLRPHPDGRGHGLLAHTASSSRGAAPSPAKVKGFKFANPVGPLIGKDPQGNFPKTPPRAPVPNGWWQPLKFRGPCF

SEQ ID NO: 51458 - DNA, 700 bp, Zea mays
  misc_feature: Ceres CLONE 1466227-F
  misc_feature: Encodes the peptide sequence at SEQ ID NO. 51459
aaagctggagctccccgcggtggcggccgctctagaactagtggatcccccgggctgcaggaattcgcacgagaccattacctagaacatcctaatcgaaaattactcttccccaccaacactccgatggatgttttcaccaagcaactcctccccatgcctcaccagcgggaccccaactacccttcctcttccacctcttcctcctcgtcgtcgtcctcctccacgcccccatctcgccctcaccaccgtgcgcaaccccaaccccaaccccacaacctcccccagtcccccagacccgtcccgcgcaccatcgacaccaccccgttccccaccaccttcgtccaggccgacaccacctcgttcaaacaggtcgtccagatgctcaccggcgccgagcagccggccaacaacgacgcgacgacggcgggcgcagccgctgccgctgccgccaacggcggcggcgccggggcccaggcgggcagcggcggaccgtgctgccggcccaagaagccgtcgttcaagctgtacgagcggcggagcagcctgaagaacctgaagatgatcgcgccgctggcgatgggctcgccgccgtcgccgtcgccgtcgccgcggagggcggcgccggagatcctgtcgccgagcgtgctggacttcccgtccctcacgctcagcccggtgacgccgctcgccggcgacg

SEQ ID NO: 51459 - protein, 191 aa, Zea mays
  misc_feature: Ceres CLONE 1466227-F
  misc_feature (66)..(96): Pfam Name: VQ Pfam Description: VQ motif
MDVFTKQLLPMPHQRDPNYPSSSTSSSSSSSSSTPPSRPHHRAQPQPQPHNLPQSPRPVPRTIDTTPFPTTFVQADTTSFKQVVQMLTGAEQPANNDATTAGAAAAAAANGGGAGAQAGSGGPCCRPKKPSFKLYERRSSLKNLKMIAPLAMGSPPSPSPSPRRAAPEILSPSVLDFPSLTLSPVTPLAGD

SEQ ID NO: 51460 - DNA, 714 bp, Zea mays
  misc_feature: Ceres CLONE 1466229-F
  misc_feature: Translation starting site: 208
aagctggagctccccgcggtggcggccgctctagaactagtggatcccccgggctgcaggaattcgcacgagaccattacctagaacatcctaatcgaaaagacgcgtctcttccacagccgcaacctctatccctcgtctggtatcgtctcccacacccctctgccccaactcagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcacaagctgcaccgccagtggaccttctggtacgacatccagtccaagcccaaacccggcgctgcgtggggcacctccctcaaaaaggcgtacaccttcgacaccgtcgaggagttttggggcttgtatgatcatgttttccgtccaaggcagtgcctgggactgctgattttcacctattcaaggctggagtagagcaaaaatggggagacccaaaatgttgcaatggtggcaaagggactgccccatgcaacgaaaggccaccttttgaaaccttggggctggaaactttaagggccctgttgggggaacattttgatgaaacaaaataacattggggaaatgtttgcaggggcctcccaaaagaaaaaaactttcattgggaaacggagattgccccaaagaaac

SEQ ID NO: 51461 - DNA, 779 bp, Zea mays
  misc_feature: Ceres CLONE 1466244-F
  misc_feature: Encodes the peptide sequence at SEQ ID NO. 51462
  misc_feature (369)..(369): n is a, c, t, g, unknown, or other
  misc_feature (423)..(423): n is a, c, t, g, unknown, or other
  misc_feature (424)..(424): n is a, c, t, g, unknown, or other
  misc_feature (426)..(426): n is a, c, t, g, unknown, or other
  misc_feature (427)..(427): n is a, c, t, g, unknown, or other
  misc_feature (432)..(432): n is a, c, t, g, unknown, or other
  misc_feature (433)..(433): n is a, c, t, g, unknown, or other
  misc_feature (438)..(438): n is a, c, t, g, unknown, or other
  misc_feature (642)..(642): n is a, c, t, g, unknown, or other
atagctggagctccccgcggtggcggccgctctatactagtggatcccccgggctgcaggaattcgtctcacccctaatcgaaaaactctttccccttcccttcccttcccactcccaggctcccactctcaccccttccgcctacccacgcaaacggcacacgaactaacagccacctctcacgtcccccaccctctggttcatgtcctgctgctccccatgtcgcctccactcgagctcgactacataggcctctcgccgccggcggcagccgccgccgctgaaaacgacgaactgaagggtactgagctccgcctcgggctgccagggtccgggtcgccggaccgccgtgtcgtggctgctattgngaccaccctggacctgctcccggccaagggcgccaagttctccccccccaccanncnnccccnnaatcncctgttgccgctgccggaaagggaaagaaggtggcagaagaggagtacgacgagaagaaggtggcagcgaccccgcacccggccgcccagtagggcgaatgtggaagtggatccttggggttttggcgcctcaaacataaaaaaggggaaggcttgggggttttgcgctgccagcgggttcattctgccgttcttgggaactgnggccactaagggtttcgcaaattgttttggtgaattgttccccctttgtttgggcgcgccttggggggcaaagttctctggaaatatgggaaaaccttgcggggcccttttgaggttattggacctttcgcgggtta

SEQ ID NO: 51462 - protein, 186 aa, Zea mays
  misc_feature: Ceres CLONE 1466244-F
  misc_feature (50)..(50): Xaa is any aa, unknown, or other
  misc_feature (68)..(68): Xaa is any aa, unknown, or other
  misc_feature (69)..(69): Xaa is any aa, unknown, or other
  misc_feature (71)..(71): Xaa is any aa, unknown, or other
  misc_feature (73)..(73): Xaa is any aa, unknown, or other
  misc_feature (141)..(141): Xaa is any aa, unknown, or other
MSPPLELDYIGLSPPAAAAAAENDELKGTELRLGLPGSGSPDRRVVAAIXTTLDLLPAKGAKFSPPTXXPXNXLLPLPERERRWQKRSTTRRRWQRPRTRPPSRANVEVDPWGFGASNIKKGKAWGFCAASGFILPFLGTXATKGFANCFGELFPLCLGAPWGAKFSGNMGKPCGALLRLLDLSRV

SEQ ID NO: 51463 - DNA, 753 bp, Zea mays
  misc_feature: Ceres CLONE 1466249-F
  misc_feature: Encodes the peptide sequence at SEQ ID NO. 51464
aaagctggagctccccgcggtggcggccgctctagaactagtggatcccccgggctgcaggaattcgtctcacccctaatcgaaaacttttgagcttctaccggctccaattccacccctcgccgccatctccgtctctctctctcccgcaaccaagcagttcaactcacacccgaagcggcgccgctagggtttgctccgacagccgcgaaacctagtccttactgcgccctcccacagaggccgtcattcactaatctacctgctacgcttcgcttcccgctccgattgggagctagggtttagcttatctccgagctcagcttcgggtcgcggcacgcggcatggcggggtacggggaagagaaccagaacgccatgaacgggtacgaggaggaagaggaggaagaagaagttgaagaagtcgaggaggtgtacgaagaggaggaggagggggacggggagggggaaggagacgagggggcagccgccgaggcagcagcgatggcggccgagacgagaagtgtcgatggaggccggggcctagcggaggccgttgggaaatgtgatgccggaggcgaagatgagagggatgcaaattctagcggcggtgacgcttcggggaaagttttcgtagggggtgtagcctgggagaccactgaaggtagccagcaattccttttgaatctaaccaatgatctattttgggttatatcacgtgaagtgttggagcaaaacaccatatattctggga

SEQ ID NO: 51464 - protein, 136 aa, Zea mays
  misc_feature: Ceres CLONE 1466249-F
MAGYGEENQNAMNGYEEEEEEEEVEEVEEVYEEEEEGDGEGEGDEGAAAEAAAMAAETRSVDGGRGLAEAVGKCDAGGEDERDANSSGGDASGKVFVGGVAWETTEGSQQFLLNLTNDLFWVISREVLEQNTIYSG

SEQ ID NO: 51465 - DNA, 790 bp, Zea mays
  misc_feature: Ceres CLONE 1466250-F
  misc_feature: Encodes the peptide sequence at SEQ ID NO. 51466
aaagctggagctccccgcggtggcggccgctctagaactagtggatcccccgggctgcaggaattcgtctcacccctaatcgaaaaaaaaatagataaaaccctttacctcctccccgctcagagaccatcgcggagagaaaccccaaacccccaaatcttgtcgactccaacgatgccgccgccgccgacgagcgccccgcattctctcgctgctgacgatttccacacctcggacacggctgccgccgcggccggggctgtggtgccatgcgcggcgtcccagccggggaccaacggcggcaagaagcctgcgttcgcgttcgggcgggtgtggtcggaggcggacgaagttcgcatcctcgagggcctcgcggcgtacgccgcggcccacggcgcagaaccgcgccggtcccagctccacgccgcgctcggcggctgcggcctggacaagtccgagttcaccgtcacggagatctacgagaaggtgcggcgctccggaccaagtacgcgaaccggcgctccgccggggggcgtgcccggtgcctgcaactgcacggtggggcttgttaacggccattaagccccccaagtacgaacctgtcaaaggccgattttggggccacttggcgcctcaaaaaagatagggggcagcccccgcccccaaacgccaggggtaatgggaaatgggaaatgcccatggccaagggggggctccggggccaccggggcccccaaaagggtttctaagaaacttccgggggcttttacccccacctcttgtctctgga

SEQ ID NO: 51466 - protein, 135 aa, Zea mays
  misc_feature: Ceres CLONE 1466250-F
MPPPPTSAPHSLAADDFHTSDTAAAAAGAVVPCAASQPGTNGGKKPAFAFGRVWSEADEVRILEGLAAYAAAHGAEPRRSQLHAALGGCGLDKSEFTVTEIYEKVRRSGPSTRTGAPPGGVPGACNCTVGLVNGH

SEQ ID NO: 51467 - DNA, 741 bp, Zea mays
  misc_feature: Ceres CLONE 1466255-F
  misc_feature: Encodes the peptide sequence at SEQ ID NO. 51468
  misc_feature (664)..(664): n is a, c, t, g, unknown, or other
  misc_feature (685)..(685): n is a, c, t, g, unknown, or other
aaagctggagctccccgcggtggcggccgctctagaactagtggatcccccgggctgcaggaattcgtctcacccctaatcgaaaaactcgcacgccgccttcaattcatccccctgtgcagcaggcccagccggacgctctctcctgatcttcctccgccgtctcctcctgtcacccgcttgctttgaatccccttcttctgctccgccatcgcgacgcgccgacatgactgggtcttctaagaagcatgacctcaaatctaagcaaaaattggaaaagaagattagtttttacacaaaagtaaaagatgcagttacttccttaaatgctaagaagactgtcagtaagaaaaataaacagagtcggcgccagaagaaacttaaagcatacgatctgtcggcactttctgagttcctcccagaaccagctgcaccagagcagaagactgaagcaaagctgaactgcaagtcaagacagacattagtgttgcaggagtctgctcatcttaaggctgtactggacaacccgcagttccagcttgacccatttgctgcgatccatcagcacctgctggcaacgcagccgcctgcagctgcaaagaaggacgacacagcggggaatcaggggaaggttttcaaggacaagaaaagcaggaggaagaanggcacatcgtcaatctctcangcaatggatatctgaatgtgttccttcagtactagtaacttggtccgatgtcgacc

SEQ ID NO: 51468 - protein, 157 aa, Zea mays
  misc_feature: Ceres CLONE 1466255-F
  misc_feature (146)..(146): Xaa is any aa, unknown, or other
  misc_feature (153)..(153): Xaa is any aa, unknown, or other
MTGSSKKHDLKSKQKLEKKISFYTKVKDAVTSLNAKKTVSKKNKQSRRQKKLKAYDLSALSEFLPEPAAPEQKTEAKLNCKSRQTLVLQESAHLKAVLDNPQFQLDPFAAIHQHLLATQPPAAAKKDDTAGNQGKVFKDKKSRRKXGTSSISXAMDI

SEQ ID NO: 51469 - DNA, 744 bp, Zea mays
  misc_feature: Ceres CLONE 1466258-F
  misc_feature (422)..(422): n is a, c, t, g, unknown, or other
aaagctggagctccccgcggtggcggccgctctagaactagtggatcccccgggctgcaggaattcgtctcacccctaatcgaaaacatttccctggaacatccagtctccaagactcgaacaaaacggggcagagtcaccctgctgaagaattggatctttcctgagtactattttgctaacatgacgagttaattatcgcagaggaggtacggctgccgcgctatgatgctggaaacggtggctgcggtaccggggatggtgggcggcatgctgcttcacctgcgctcgctccgccgcttcgagcacagcggcggctggatccgggcgctgctggaggaggcggagaatgaacgcatgcacctcatgaccttcatggaggtggccaagcccaagtggtacgagcgcgcgcccccccctcnccgtgcagggcgtcttcttcaacgcctacttcctcggctacctcatctcccccaagttcgcgcaccgtgtcgttgggtacctcgaggaggaggccatccactcatataccgaatacctcaaggacctcgaggccggcaagatcgagaacatccccgcgccggccattgccatcgactactggcagctcccagctgatgcgacgctcaaggatgtggttgtcgtggtgcgctccaatgaggcgcaccaccgcgacgtcaatcactttgcgtcggacatacatttccagggtatgcagctcaaggagacacctgcgccgattga

SEQ ID NO: 51470 - DNA, 755 bp, Zea mays
  misc_feature: Ceres CLONE 1466262-F
  misc_feature: Encodes the peptide sequence at SEQ ID NO. 51471
  misc_feature (621)..(621): n is a, c, t, g, unknown, or other
  misc_feature (650)..(650): n is a, c, t, g, unknown, or other
  misc_feature (697)..(697): n is a, c, t, g, unknown, or other
  misc_feature (718)..(718): n is a, c, t, g, unknown, or other
  misc_feature (719)..(719): n is a, c, t, g, unknown, or other
atagctggagctccccgcggtggcggccgctctagaactagtggatcccccgggctgcaggaattcgtctcacccctaatcgaaaacactctacccgcacagcgcccctcgcccccacaccccaacccaaccatccgctccttgtcgccttccgacgctgagtttgctggtgtcgatttgcgccggcggatgctcgatctggtagctgcatgtgccgacctactcgtcgaatccgttatctaacgtaatggatgggcaaggcacaaagcacaggattttgatggtgtccgactttttctttccaaactttggtggggtggaaagccatatctactacctgtcacaatgtctacttaagcttggccataaggttgttgtcatgacacatgcatatggaaacagatctggagtacgatatgtcacaaatggtttaaaggtctattatgtaccatggaggccattcctgatgcagaatacacttcctacactatccttgacgtttccaattgtaaggacaattattattcgagagaagatttctgtcgtgcatggacatcaagctttttcaacactgtgtcatgaagcattaatgcatgctaggacaatgggatattgatcaangcatatgtgtctcacatacaagcaaagangacactgtctttgaggctgggatatcttcagaggaagttttcatggntccctatgcaagtgacactgnncatgttacctccctctcccagcgccttaactgtgat

SEQ ID NO: 51471 - protein, 122 aa, Zea mays; identical to SEQ ID NO: 47963
  misc_feature: Ceres CLONE 1466262-F
  misc_feature (47)..(122): Pfam Name: PIGA Pfam Description: PIGA (GPI anchor biosynthesis)
  misc_feature: SWISSPROT Homolog: EC 2.4.1.198 Phosphatidylinositol N-acetylglucosaminyltransferase

SEQ ID NO: 51472 - DNA, 754 bp, Zea mays
  misc_feature: Ceres CLONE 1466263-F
  misc_feature: Encodes the peptide sequence at SEQ ID NO. 51473
aaagctggagctccccgcggtggcggccgctctagaactagtggatcccccgggctgcaggaattcgtctcacccctaatcgaaaattttcgagatgaacgaacagtccagaacccactgctcgaaaccgcagccactggccagtcgatgcccatgactgcggtgcccaggaccggccccggttgcctggggtcgccgccggctcaggctctgtcgagctcactagccggggttcaaggcgccccgaagcgactgggcgtatcgaagccgtcgtggatcgttcgcactgagtcaaacgtgaggagggagagagcaaaacgacctgatcctccttgcaccatctgcaaaggcacagggagaatagactgccgcaactgctttggtcgaggaagaacaaaccatgccgatgtgaccatgcttccgaacggcgaatggccacaatggtgtcgaatttgtggtggtagtggactggattactgcctccggtgccatggaactgaggaatcgcctgggggctgggggtccagtttccagccgttctcgagatcgaatctgcatgccatgacgtcccaggggcccggcgtccaaacgagtcttggcgaacgtcttccagtggctgtcgcccaggtcccgtcacgcctgccccgccgtgtgcctcaagtggtccgagctgctctcttcggcccgtctcgagttccccgccaacttcgacgacggcaacgccgactcctccccatggttccctggcctccgc

SEQ ID NO: 51473 - protein, 200 aa, Zea mays
  misc_feature: Ceres CLONE 1466263-F
MTAVPRTGPGCLGSPPAQALSSSLAGVQGAPKRLGVSKPSWIVRTESNVRRERAKRPDPPCTICKGTGRIDCRNCFGRGRTNHADVTMLPNGEWPQWCRICGGSGLDYCLRCHGTEESPGGWGSSFQPFSRSNLHAMTSQGPGVQTSLGERLPVAVAQVPSRLPRRVPQVVRAALFGPSRVPRQLRRRQRRLLPMVPWPP

SEQ ID NO: 51474 - DNA, 725 bp, Zea mays
  misc_feature: Ceres CLONE 1466267-F
  misc_feature: Encodes the peptide sequence at SEQ ID NO. 51475
agctccccgcggtggcggccgctctagaactagtggatcccccgggctgcaggaattcgtctcacccctaatcgaaaaaagctcttgaaaactgctcgtcccctccacttcaaaatctactactcaaggatggaaagctgtcatctctgtacacaacccaaggtgtggcggttgctgagctacagttctgccatcctgaggtggtcccaacgtcaaagaacttctggaagccactatgtgcatctctgcagaatctgctgaggtgcagcgtcgacatccgaatcaacctatctcctatctccggcaacggggcgggatccaaggactcgtccgtcagccttgtcatggagtcaagagaagaagaccgcgaggcacaggacccagccacctcaaactgcagaaccgtggtgtcatccgggagagactgcccttccccacccttggggcaggccaaggagagatcgtcccacatcctggggtgcctccatggcggcgcgggtggcgacgccgtggacaccgagccgaggatcctgagctaccagaagatctccgttgtccctgcagcatccaccccaggaaacactcccctgaaagccgctgccgccgctgccggagacgagtcaaaggttgatgatggcggggttcgtcctggctgctgctcgcacattttaccctgtggtgcttgcgctccccgtcagaagccccggacgcgggagaaacgccgg

SEQ ID NO: 51475 - protein, 127 aa, Zea mays; identical to SEQ ID NO: 50240
  misc_feature: Ceres CLONE 1466267-F

SEQ ID NO: 51476 - DNA, 744 bp, Zea mays
  misc_feature: Ceres CLONE 1466268-F
  misc_feature: Encodes the peptide sequence at SEQ ID NO. 51477
  misc_feature (374)..(374): n is a, c, t, g, unknown, or other
  misc_feature (380)..(380): n is a, c, t, g, unknown, or other
aagctggagctccccgcggtggcggccgctctagaactagtggatcccccgggctgcaggaattcgtctcacccctaatcgaaaactaattctctcaactcaaaaccctaacatccgtccccactccccaatcaacctgccgccgcccgccagcaccaaacttccatccgccccgagctctgcctccgccgccgccgcgccatgaggcctctcgacgagaaggagacgactcaggtattcgagaagctgttcaagttcacggggcccaacctgaagcacctcctggagcgccccgcagtggagggccccgacgcggagcccggccgctactgcctccggcttcaccgcaatcgcgtctactacgcctccgaggngctcgngcgccgcgccaccgccgtgtcccgaccgcgcctcgcccccctccggacgcccatcggcaagttcacccaccacggcgcgttccaccttacggtccacgcgctcgacctcctcgctgcacacgcgcgccgccgcgtctggctcaaacccgacaccgagcgttcctttctctttggcaattccgtgcccaagtcttctctcgctcgcatcaccgagaacaccaaggcccgggacggggtggtcgtcatgtccatggctgaccgccctctcgggttccgcattgcgccaggtcggcccaggattgcaggaagccaacaccaaacgcgtcgtcgtgcttgcaccatcggaccccgggagtacctccct

SEQ ID NO: 51477 - protein, 181 aa, Zea mays
  misc_feature: Ceres CLONE 1466268-F
  misc_feature (58)..(58): Xaa is any aa, unknown, or other
  misc_feature (60)..(60): Xaa is any aa, unknown, or other
MRPLDEKETTQVFEKLFKFTGPNLKHLLERPAVEGPDAEPGRYCLRLHRNRVYYASEXLXRRATAVSRPRLAPLRTPIGKFTHHGAFHLTVHALDLLAAHARRRVWLKPDTERSFLFGNSVPKSSLARITENTKARDGVVVMSMADRPLGFRIAPGRPRIAGSQHQTRRRACTIGPREYLP

SEQ ID NO: 51478 - DNA, 757 bp, Zea mays
  misc_feature: Ceres CLONE 1466270-F
  misc_feature: Encodes the peptide sequence at SEQ ID NO. 51479
  misc_feature (426)..(426): n is a, c, t, g, unknown, or other
  misc_feature (502)..(502): n is a, c, t, g, unknown, or other
tggagctccccgcggtggcggccgctctagaactagtggatcccccgggctgcaggaattcgtctcacccctaatcgaaaagaaatccccgcgacctcccctccccgtctcccctctccgctcccaaattcgtcgaacgccaccccacccgcccactgcaatggcgagcttcaatcccgccggcgccagcgccgccaaccataatcccaacaaatccttcgaggtgactccggcgcctggggactcggtgtccagcctcagcttcagccccaaggcgaaccacctcgttgccacctcatgggacaaccaggttcggtgctgggaggtcatggctggtggggcctgccaagcgaaggcctccatttcgcacgatcaaccggtgctgtgctcggcttggaaggatgaccgccccgactgttttctcangaagctgtgataagcaggttaaaatgtggccccctgctcctcaggtgccagcccaagggttttctcagggcatganggcaccttattaaagacccccttttgggggccccagaagaaatctccttggcagtgggaagctgggacaaaaactttgagggactggggacttttgggaacccccacccggggggtggttcagcaacttcccggagccgggccatgggccatacccttttgtttacccccccccgggggggggggcccgcgcataacccaacctaaaattcttttcaactcgggaaaaaaccacggcttgaatttcaaagaaaat

SEQ ID NO: 51479 - protein, 91 aa, Zea mays
  misc_feature: Ceres CLONE 1466270-F
  misc_feature (17)..(55): Pfam Name: WD40 Pfam Description: WD domain, G-beta repeat
  misc_feature (89)..(89): Xaa is any aa, unknown, or other
MASFNPAGASAANHNPNKSFEVTPAPGDSVSSLSFSPKANHLVATSWDNQVRCWEVMAGGACQAKASISHDQPVLCSAWKDDRPDCFLXKL

SEQ ID NO: 51480 - DNA, 751 bp, Zea mays
  misc_feature: Ceres CLONE 1466273-F
  misc_feature: Encodes the peptide sequence at SEQ ID NO. 51481
  misc_feature (610)..(610): n is a, c, t, g, unknown, or other
atagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcaccccccaccctaaactgtttgcagaactatgcctaagctgaggagctgcacttcacatccttgttgtgggaccgccaaggaagccttctttatcggaacagccccctttgtccccaaaccaatcagggccccccccaacccggggaaaaacccggggcttggctttggcaaaaaaaaccacccctgtggttttccaaaancaattccgaaccggaaaaaaaagtcccttttaaacccaaggtgtcccccccccacaaaaattgggggcgcccttgaaaaaggccggaaaaagcccctctaaaaaaaaaaaaaaaaaaaagagcgcctgggacccccattcc

SEQ ID NO: 51481 - protein, 73 aa, Zea mays; identical to SEQ ID NO: 46194
  misc_feature: Ceres CLONE 1466273-F

SEQ ID NO: 51482 - DNA, 826 bp, Zea mays
  misc_feature: Ceres CLONE 1466275-F
  misc_feature: Encodes the peptide sequence at SEQ ID NO. 51483
  misc_feature (373)..(373): n is a, c, t, g, unknown, or other
aaagctggagctccccgcggtggcggccgctctagaactagtggatcccccgggctgcaggaattcgtctcacccctaatcgaaaaagcaagctcgacggaactgactagaactagtacgtagatccaacactcgggacgaaattaaaagagacgacgcacatcaaccagcaggcatcgcgcggtcaccaccatggcggcgcaggagggcggcatgaggctggtgtcgcacccgatcgcggcgcacgacgggcggctgccgcggcagtacacggcggaagggcagggcgcccaagaggacatgtcgcccgcgctggagtggtacggcgtgcccaagggcgcgcgttccctggcgctgctggttgcagaaatcnaaccccgaccccagggtggctggaacccactgggtgggggcccaacaccccgcccgccaacagggggcctccccaaggggttctccgggcccccggggcccggggggggggggggggccccacacaaatcggggggccttgaggaggggggcaacaaatgggaaaaaccccggttgggggggggcccgggcccccctccccggggcccgtgttctttttaaattctctcccccccaaaaaaaggggcgccccccaccacggggggccggggataactcctgggggggctcccgcgccccctggtaaaaaaaacaaatataccccgtgtttcggggggttcccccacaaaaaaaaaacccccccaaaaaaatttttgggggggcggtttttttggggggggccccccccttttttttttccaagggggcccccccaaaaaaaaaaaacgagggc

SEQ ID NO: 51483 - protein, 133 aa, Zea mays
  misc_feature: Ceres CLONE 1466275-F
  misc_feature (61)..(61): Xaa is any aa, unknown, or other
MAAQEGGMRLVSHPIAAHDGRLPRQYTAEGQGAQEDMSPALEWYGVPKGARSLALLVAEIXPRPQGGWNPLGGGPTPRPPTGGLPKGFSGPPGPGGGGGAPHKSGGLEEGGNKWEKPRLGGGPGPPPRGPCSF

SEQ ID NO: 51484 - DNA, 750 bp, Zea mays
  misc_feature: Ceres CLONE 1466276-F
  misc_feature: Encodes the peptide sequence at SEQ ID NO. 51485
  misc_feature (433)..(433): n is a, c, t, g, unknown, or other
aagctggagctccccgcggtggcggccgctctagaactagtggatcccccgggctgcaggaattcgtctcacccctaatcgaaaacagccatccgccgcggctcgtctccgtctcccggctcctcggcgtctagctcgtcaacgcgcgcgtccgccgtcggctcctccgaccggcgtcccaccacaggggaatacagatcgacgatccgctgggcttgcaaacatgtatatccgagtgaagcgcaacaagagtacctacttcattcaatgtgaaccaacagagacagctttgagcatcaaacagaagttgcactcgctgatagatcaacctcctagtagtcagcagttggtcttgtggcctagcagtgatgtgctttgagactcaaagactttggcagatcaaaaggtggatcacgattcctttgttgcattngcactaagaaaagatgacggtgagtttgaaggagttttcatcgctagggccggaggatttcatgcatcctcctggataaaaataagccaatcattttacaaagggacccctgcccgttccttggaatggacccccccccttagcggggttcttcaaaaaccgggaagggccttggcttgccctttggaggaaaaaaaaaatctttttggggaacccccaacaccccgttggagaaaattaaacttttttttgccccccccccgagggcccggtttttttgaaaaaaaaaaaaaaaacacaccccccccgcccccccc

SEQ ID NO: 51485 - protein, 51 aa, Zea mays
  misc_feature: Ceres CLONE 1466276-F
MYIRVKRNKSTYFIQCEPTETALSIKQKLHSLIDQPPSSQQLVLWPSSDVL

SEQ ID NO: 51486 - DNA, 781 bp, Zea mays
  misc_feature: Ceres CLONE 1466277-F
  misc_feature: Encodes the peptide sequence at SEQ ID NO. 51487
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
atagctggagctccccgcggtggcggccgctctatgaactagtggatcccccgggctgcaggaattcgtctcacccctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatcgggctgggcgtgccgnnnccgcgtgtggcgggcggcgccaacgcgcccatgtcagcggccgacctcctcccgccgggccacccggacccgtccgtcctggagcgccccccccccctgctggcgtcccgcggcgttttctcccaatccaccgagtccacccccaccacgcggcgggcggttattccgcctcacccggtggggcccacccctgggccgggggcccccctgggggggccctaagccgaattttgggtgaaaaacccacaaaacccttggggggggcgtggcccccctctaaaaaggccgtgtttaaccccgggggcccaaaccgttccgcgccccaaccgcggggccccccctcccctcttagggaggagacaaagccccaccggttttctcccccccgggggggggttacaaacccttttggggccccccccccaaaataagcccccccgggggttttcggccccc

SEQ ID NO: 51487 - protein, 125 aa, Zea mays
  misc_feature: Ceres CLONE 1466277-F
  misc_feature (52)..(52): Xaa is any aa, unknown, or other
MPPPSANGATAAAAAARDDMSPAEARLAMMELANMVSVPMALAAVIGLGVPXPRVAGGANAPMSAADLLPPGHPDPSVLERPPPLLASRGVFSQSTESTPTTRRAVIPPHPVGPTPGPGAPLGGP

SEQ ID NO: 51488 - DNA, 748 bp, Zea mays
  misc_feature: Ceres CLONE 1466278-F
  misc_feature: Encodes the peptide sequence at SEQ ID NO. 51489
aaagctggagctccccgcggtggcggccgctctataactagtggatcccccgggctgcaggaattcgtctcacccctaatcgaaaaaagactgcttaaacatgattgctcggcttccaccagtggcttcttatgtttaccggagaattttcaagggtgggaaatcaatagaaactgacaattctctggattatgcggcaaatttctcacacatgcttggttttgatgaccctaaaatgctggagctgatgcggctctatgtaacaattcacactgatcatgaaggcgggaatgtcagtgctcatactggtcatctggttggaagtgctctgtcagatccttatctttctttcgcagcggctcttaatggggtagctggggccactacatggcctttgcaaatcaggaagtgctcccaccccatcaaatctgtaattcaggaaaactggagggatgttaccacggaacacctcaagaatatttcttgaaaaaactaaagaaggaaaaaggttgtcccgtgaatttggcagggattctcggcaaaaaaaacccccggatttcttgccaaagggaatttgccccgaaacatttgccccaaaaacccctttttccaaggggggcccaagtttatataaaaccccccccccaatcccctcgtgaactgaaaaggtcaaaaaccccggggcccaatgtttattccccccagggggttttttcgaaacccctttgggtatttttataccccgttt

SEQ ID NO: 51489 - protein, 128 aa, Zea mays
  misc_feature: Ceres CLONE 1466278-F
  misc_feature: SWISSPROT Homolog: EC 2.3.3.1 Citrate (Si)-synthase
MIARLPPVASYVYRRIFKGGKSIETDNSLDYAANFSHMLGFDDPKMLELMRLYVTIHTDHEGGNVSAHTGHLVGSALSDPYLSFAAALNGVAGATTWPLQIRKCSHPIKSVIQENWRDVTTEHLKNIS

SEQ ID NO: 51490 - DNA, 651 bp, Zea mays
  misc_feature: Ceres CLONE 1466281-F
  misc_feature: Encodes the peptide sequence at SEQ ID NO. 51491
atagctggagctccccgcggtggcggccgctctagaactagtggatcccccgggctgcaggaattcgtctcacccctaatcgaaaatctgaaattccccccaaatatcccagccactgccgtcgtgcagtcaaagtgtcaaaccatgccggcagtagcgttcgcgtcggctcctgccatattcgcctccgcctccgcgcgtccctggcgcagcgcggctccgggcatcctttcctccgactccggggcgggccccgcgcggcgcgcgtggcgccgtccagtgtgaggtcgcctcctcctcggcaccgtccgcggctggacccaggcccgcccgtgggcccaaagaacgtggtcattcccgccaaggggcgggggggcccacctcttccccaacaatccttaattggaataggaaaaacctggcccgatttttatgggggcctggcccatcttgttttggagacacaaaggggggcttttaaattatagaggaaacaacccccccgtatccccggttgacccttaaaaatttttttatccccttttgttcccaggggccccctctccccccggggggccccccctaagaggggccgggggtagtccgcgccccaaaaaaaaaaaaaaaggagtgggggtgcccccccgacat

SEQ ID NO: 51491 - protein, 46 aa, Zea mays
  misc_feature: Ceres CLONE 1466281-F
MPAVAFASAPAIFASASARPWRSAAPGILSSDSGAGPARRAWRRPV

SEQ ID NO: 51492 - DNA, 757 bp, Zea mays
  misc_feature: Ceres CLONE 1466282-F
  misc_feature: Encodes the peptide sequence at SEQ ID NO. 51493
  misc_feature (399)..(399): n is a, c, t, g, unknown, or other
  misc_feature (486)..(486): n is a, c, t, g, unknown, or other
aaagctggagctccccgcggtggcggccgctctagaactagtggatcccccgggctgcaggaattcgtctcacccctaatcgaaaaactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggccgcactccccgccgacgccttcgccaccgcgctggtcatcttcctcggcgactacaacgaccgcggcccgcacacccgcagggtcctcgacttcctcctcgcgctcccgacgcgctaccccgcgcagcngcacgtcttcctctgcggcaaccacgacctcgccttcgcggcgttcgtcggggcgctgccgccgccgcccgacggctccccgttctncgccacctgggacgagtacatccacaacgaggagcacgaggggtggttccgcggcccggattcaagggcatgcccgttcaggggaggcggtggggcggggtcatcaaggagaggtggacccccaagaagggcctcccgtacaagggttcattctcgacgcgcagcccaccttgaatcctatggcgcgccccatgtttcctctgatctgcaaaggctgggccaaaagaaccacaaaggtttctgcatgatttgggtttggaaccataagaag

SEQ ID NO: 51493 - protein, 195 aa, Zea mays
  misc_feature: Ceres CLONE 1466282-F
  misc_feature: SWISSPROT Homolog: EC 3.1.3.16 Phosphoprotein phosphatase
  misc_feature (76)..(76): Xaa is any aa, unknown, or other
  misc_feature (105)..(105): Xaa is any aa, unknown, or other
MSAPSAPPRTVICVGDVHGYITKLESLWSNLQAALPADAFATALVIFLGDYNDRGPHTRRVLDFLLALPTRYPAQXHVFLCGNHDLAFAAFVGALPPPPDGSPFXATWDEYIHNEEHEGWFRGPDSRACPFRGGGGAGSSRRGGPPRRASRTRVHSRRAAHLESYGAPHVSSDLQRLGQKNHKGFCMIWVWNHKK

SEQ ID NO: 51494 - DNA, 748 bp, Zea mays
  misc_feature: Ceres CLONE 1466284-F
  misc_feature (349)..(349): n is a, c, t, g, unknown, or other
ctggagctccccgcggtggcggccgctctagaactagtggatcccccgggctgcaggaattcgtctcacccctaatcgaaaacttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattttctattccgtattgaaggcgtcgatggccttgtccgcccntatcagcaccctcctcgccgtcgccatctgtcaacttattgctccagtttatacgaccattgccagacccgtgggaaggacattcatattgtcaatcttgatccagctgctgaccactcaactatcctggagattggatatcaaaaacttgatcccttgataattttatggagaaaattggttggggcccaaatggcgtccccccttccgcttggacccctttaaaaaccttggtaatattgtttttaaaaacccctaaaaccccccgaagaattttttcttggtttattccccccgcaaattaaacctccccaagtttcccctttcgggaaatttttgcgccccctaaaaaaaaaaaatttcacagtgggcggttttccctcttttaataaagagtgt

SEQ ID NO: 51495 - DNA, 768 bp, Zea mays
  misc_feature: Ceres CLONE 1466285-F
  misc_feature: Encodes the peptide sequence at SEQ ID NO. 51496
  misc_feature (408)..(408): n is a, c, t, g, unknown, or other
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgaatnactcccaaacccccccccccccactactaatgctaagctgaggagctgcattcacatcatgtggtggaacccgagggaggtttctttatcgaacagcctcacttgtcaccaacccaatcaggcaccccccccaacccgtggactaccctggggtttgctctttggcatgaaaacgaccgcctgtgttttgccaaagctcatatcggaacttagagaaacacagtacctttataatcaccattggatccccccctcctaccgaaacctttggatgcctccttgtaacttagggccggaaaaaagcgccttctaaaaaaaaaaaaaaaaaaaccgacacctccagggtcccccatttccccc

SEQ ID NO: 51496 - protein, 72 aa, Zea mays; identical to SEQ ID NO: 46180
  misc_feature: Ceres CLONE 1466285-F

SEQ ID NO: 51497 - DNA, 804 bp, Zea mays
  misc_feature: Ceres CLONE 1466287-F
  misc_feature: Translation starting site: 184
  misc_feature: SWISSPROT Homolog: EC 2.4.1.121 Indole-3-acetate beta-glucosyltransferase
  misc_feature (379)..(379): n is a, c, t, g, unknown, or other
  misc_feature (398)..(398): n is a, c, t, g, unknown, or other
  misc_feature (684)..(684): n is a, c, t, g, unknown, or other
  misc_feature (715)..(715): n is a, c, t, g, unknown, or other
gagctggagctccccgcggtggcggccgctctagaactagtggatcccccgggctgcaggaattcgcacgagaccattacctagaacatcctaatcgaaaaaacattgcaacctgcaactgcaacattgctctttggaattccacctaacatccattgttgcaagaaggatcaaggaacaaccatggcgccgcatgtcctcgacgtgcccttccccggtcagggacacatgaaccccatggtacagttcgccaagaggctggcatccaagggcgtggccaccacgctcgtcaccacccgcttcatccagaggactgccgacgtggacgcgcacccagcgagggtcgaggccatctccgacgggcacgatgagggagggntcgggtggggcgaggacgntcacaataatataacccaactgcgtggccggctgtgtatgagccacaggacccacttcctcaaggcacgcgcgcccccctgccgacgccctacccgtacgtccgagaaaaatgcggtacaagaactgcggggccatcccatgcccccgctaaaaggggcttgcgccacccgcccccttctccacccaattcttggcaccgagcgcccccaaagaacctcgcactttcacacaatccaagaaatcgccttcccctcccggagcccgcccaaggcacggaaaacagantttcttccctgggtcgcggcccccaacccancaatcaattcaacggggccgatcacaaaaagtaattacgcacctagcaccccccccctccctggctgcacccaaagactgagctccgag

SEQ ID NO: 51498 - DNA, 730 bp, Zea mays
  misc_feature: Ceres CLONE 1466297-F
  misc_feature: Encodes the peptide sequence at SEQ ID NO. 51499
aagctggagctccccgcggtggcggccgctctagaactagtggatcccccgggctgcaggaattcgcacgagaccattacctagaacatcctaatcgaaaaagtcacacctcgaaagcaacagcaagtcagcaacctacctagctagagctatcactatcagtatcaggtacctagagctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcagcaggcgggagaggacgtgaagcggccggacacgctgcacgaggggacggtgctgatcccggggatggggcgctacgagatcggcagccactacatcccggacatcggcgggctggaccacagcatccccgccgccacccacggccagttcctccccggcgccgacgacacctgggcccaaccccggcttcgaggtccccaaccccttcatgcccggcgcggccactccctgaacacgtaccgcgcgctgccgaaggtggctctcggtcgatctgatcgtcgagcgccgccgcccgccctgaacgaataatactactagctactctcggtctgctacgtatagctagcttagcttagctagccgtgcttgcctgctgcatgtacgcatgtcttcgtgtggcccgtcccacgtacgtct

SEQ ID NO: 51499 - protein, 136 aa, Zea mays
  misc_feature: Ceres CLONE 1466297-F
MARWSSSALVAVLVVLAAAVACSAARPVPAQQQQQAGEDVKRPDTLHEGTVLIPGMGRYEIGSHYIPDIGGLDHSIPAATHGQFLPGADDTWAQPRLRGPQPLHARRGHSLNTYRALPKVALGRSDRRAPPPALNE

SEQ ID NO: 51500 - DNA, 761 bp, Zea mays
  misc_feature: Ceres CLONE 1466303-F
  misc_feature: Encodes the peptide sequence at SEQ ID NO. 51501
atagctggagctccccgcggtggcggccgctctagaactagtggatcccccgggctgcaggaattcgcacgagaccattacctagaacatcctaatcgaaaagtaaagtgaaacggagacgaaacccgctcgcgttttcttctttcagaaaacgaaatccactcaggagcgaggaaagagggacagaggagggatagatccccgggctccacgcctccacaaccatccgtcccgatcccgaccagctttgagatcgcgatggcggacggccgctgctgcaccttcctggagatcctcttcgccatcatcctcccgcccctcggcgtcttcctccgattcggctgctgcagaatagagttctgcatctgcctgctgctcacaatccttggctacgtccccggaatcatctacgccatctatgtccttgttgctctcgactctgaccagcacgagagggaatactacacccttgcttagagcatctggttgtgccaggcgggcctgcacagttgagtcgaaatcagtattttttttctcatgtggattgtctgacatggcataagcggcaatgggtaaccaagtgttgtggtctatatctctgttacccaacttgtgagctccctttattgtgctccagttattccatctgaaattgggatactacaagagaaataaatgcgcatgtatccctgagaggcaaaaaaaaaaaaaaaacttatcgataccgtcgacctccaagggggggcccggttacccaatcc

SEQ ID NO: 51501 - protein, 72 aa, Zea mays
  misc_feature: Ceres CLONE 1466303-F
  misc_feature (7)..(58): Pfam Name: UPF0057 Pfam Description: Uncharacterized protein family UPF0057
MADGRCCTFLEILFAIILPPLGVFLRFGCCRIEFCICLLLTILGYVPGIIYAIYVLVALDSDQHEREYYTLA

SEQ ID NO: 51502 - DNA, 764 bp, Zea mays
  misc_feature: Ceres CLONE 1466307-F
  misc_feature: Encodes the peptide sequence at SEQ ID NO. 51503
  misc_feature (383)..(383): n is a, c, t, g, unknown, or other
tggagctccccgcggtggcggccgctctagaactagtggatcccccgggctgcaggaattcgcacgagaccattacctagaacatcctaatcgaaaacttccttcccttccggccgcctcttgtcctcctcacctcccaaattgaaatcctcctccctccccgcctagggttccgcttcctcccccgtccgagcaccactcaagcggcggcagcagcggtggcagcctggaagcagtcccatctcgtcgccctagacttccctgccgccgcacgtctcagtttcttgttcgcccgctctcctgccggtccgcccatcgcctgaggttcttacggagccacggagttggcaactgcaaggagtgatattgtggtacaacactanttctaattgaagtaataaggcgggtggtaaactttcccctaccattgcttccatggcaactaacgagaacctcccgccaaatgtcatcaagcaattggctaaagaactgaagaaccttgatgagtcacctccagaagggattaatgtgattgtcaatgatgatgacttcactactatttttgctgacattgaaagccctgctggaactccatatgagaacggagtattcaggatgaggctattattgtcacgcgatatccctcaatctcccccaaaagggttcttcttgactaaaattttccatcctaacataactactaggggggagatatgtgtaaacacactgaaaaaggattgggaaccctggccttggaataagaa

SEQ ID NO: 51503 - protein, 109 aa, Zea mays
  misc_feature: Ceres CLONE 1466307-F
  misc_feature (14)..(108): Pfam Name: UQ_con Pfam Description: Ubiquitin-conjugating enzyme
  misc_feature: SWISSPROT Homolog: EC 6.3.2.19 Ubiquitin--protein ligase
MATNENLPPNVIKQLAKELKNLDESPPEGINVIVNDDDFTTIFADIESPAGTPYENGVFRMRLLLSRDIPQSPPKGFFLTKIFHPNITTRGEICVNTLKKDWEPWPWNK

SEQ ID NO: 51504 - DNA, 780 bp, Zea mays
  misc_feature: Ceres CLONE 1466312-F
  misc_feature: Encodes the peptide sequence at SEQ ID NO. 51505
  misc_feature (239)..(239): n is a, c, t, g, unknown, or other
  misc_feature (298)..(298): n is a, c, t, g, unknown, or other
  misc_feature (389)..(389): n is a, c, t, g, unknown, or other
  misc_feature (406)..(406): n is a, c, t, g, unknown, or other
  misc_feature (407)..(407): n is a, c, t, g, unknown, or other
gctcttgaactagtggatcccccgggctgcaggaattcgcacgagaccattaagtacaacatcctaatcgaaaagtattcaaacacgcccgctagcatgatagcccatttcttaggtttcagcgcctcactgggacgaaactcacaggctccctctcctcccccagtccgcggcgctcgctccgttcacctcgaccgcggcgatcttcgaggcgacgagacgatgctgcggctctcccncttcctcccctccgcctgcaagaggggttttgatctaaaagaatctctttggagcagcncattgacaatcccacacgctgtttccactgcagctacaaatctttgtttaaacttggtctggcaaaaagtttggaagttatattttttctnacgtgtgtgtcagaaanntaaaatacatgccgatactgccagcttttccccaaacaacaaatccgagaagaatctgccagtggagccaaaaactggatcaagtaaatgtgtgacccgtacttatcccagcaggttgttgcacatcgtaaggatttgacttataccaaaagaaaacaccctcctattgcctctggccaccctacttgatagtcgtgaaaaccctgtataaagtcctctgggccctgcttcattcctggaggaaatttttccaatgactccctccctgtaaatctaatcatacgaagggacccgatgataaaaatccgccggacgatccactcccctttgggcagtagaccatgggatcaccttggataaattcaaccagctc

SEQ ID NO: 51505 - protein, 107 aa, Zea mays
  misc_feature: Ceres CLONE 1466312-F
  misc_feature (6)..(6): Xaa is any aa, unknown, or other
  misc_feature (26)..(26): Xaa is any aa, unknown, or other
  misc_feature (56)..(56): Xaa is any aa, unknown, or other
  misc_feature (62)..(62): Xaa is any aa, unknown, or other
MLRLSXFLPSACKRGFDLKESLWSSXLTIPHAVSTAATNLCLNLVWQKVWKLYFFXRVCQKXKIHADTASFSPNNKSEKNLPVEPKTGSSKCVTRTYPSRLLHIVRI

SEQ ID NO: 51506 - DNA, 717 bp, Zea mays
  misc_feature: Ceres CLONE 1466320-F
  misc_feature: Encodes the peptide sequence at SEQ ID NO. 51507
  misc_feature (43)..(43): n is a, c, t, g, unknown, or other
  misc_feature (332)..(332): n is a, c, t, g, unknown, or other
  misc_feature (334)..(334): n is a, c, t, g, unknown, or other
  misc_feature (717)..(717): n is a, c, t, g, unknown, or other
ggatcccccgggctgcaggaattcgcacgagaccattacctanaacatcctaatcgaaaaacaggcggcactcaccactagagttggtgccgcgactgcgaatccggcgcaatggccgcggcggcgatgggcctcgtgcgtgagctcctgcagccacagggaaccacgagcacccgccggctctgcagcacaggtgtgggcgtgggcgtggcggcgggcttcctcagcgccgggaccgtcgcgtcggcatccagcgcatgcccggcttacccgtggtcacaggacggggcgcggggcgggcacaaggtgttcatgcagcatgactgtgaggnangccactcgggcctgccgtacgctggcctagttgatgaacccttcccccccggaggcgaggtggaagccaaggcggccgagatcgtggttgtccatgaccacaaggaggaggcagcgctgacgacggcgacgacgctccacggtggcgcctgcccgccggacctctccgccgtcaccaaaatgctggaatggctgcgccgcggcaacctgtacagcgcggacgagatcaagacgacgatggcgctggcttcccctgtctggctgcagtttcttcaggccgtactttaggattcctccagccaccctgaaatgccagtccagatttctccacttaaaacatcccaagtcccagcctctagtgaccgtgaattattcctgcttgcn

SEQ ID NO: 51507 - protein, 169 aa, Zea mays
  misc_feature: Ceres CLONE 1466320-F
  misc_feature (74)..(74): Xaa is any aa, unknown, or other
  misc_feature (75)..(75): Xaa is any aa, unknown, or other
MAAAAMGLVRELLQPQGTTSTRRLCSTGVGVGVAAGFLSAGTVASASSACPAYPWSQDGARGGHKVFMQHDCEXXHSGLPYAGLVDEPFPPGGEVEAKAAEIVVVHDHKEEAALTTATTLHGGACPPDLSAVTKMLEWLRRGNLYSADEIKTTMALASPVWLQFLQAVL

SEQ ID NO: 51508 - DNA, 722 bp, Zea mays
  misc_feature: Ceres CLONE 1466321-F
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (554)..(554): n is a, c, t, g, unknown, or other
  misc_feature (556)..(556): n is a, c, t, g, unknown, or other
  misc_feature (557)..(557): n is a, c, t, g, unknown, or other
aagctggagctccccgcggtggcggccgctctagaactagtggatcccccgggctgcaggaattcgcacgagaccattacctagaacatcctaatcgaaaacccaattcccctcccgtcccgtcccgtcccctcccctcccctccgctcccgtcgtctaccctcactcgaaaccccgattcgaaaccggctgagttcaatttggggatttcggcacctcgttccccgaaattttctggatctgagtctgtcggccgttctcgatttgcgtctggagtgagcctgcgagttttcaggctcgatttggtcggggcctcggggggtcccgggtctcgatttcggggatggactcgtctccggtgtctattggtgctacagctgcagccgctcgtgaggttatccccttcactggcctcggcccggagggggaggcgcttcttaaaacatttacccacccccccccccgggnnnngtgggaaacgcccggccggaaaaaaaaaccgggcattggggcccggggggaatcttttggggttcaggcttaataaaaaaaangnngggaaaaagggtggcccttccccgggaaaccccaccccccccgggggggcggtgtcccccccgggcccaaatttctcgggggggggggggcggtccccccccccccgccaaaaaggggggggggggtcccccccccccggagggggggggggggggtgtccccct

SEQ ID NO: 51509 - DNA, 708 bp, Zea mays
  misc_feature: Ceres CLONE 1466329-F
  misc_feature: Encodes the peptide sequence at SEQ ID NO. 51510
aagctggagctccccgcggtggcggccgctctagaactagtggatcccccgggctgcaggaattcgcacgagaccattacctagaacatcctaatcgaaaaagaaacccaccaccgcaagtccgcaacacctgcgctccggcctgctctctctttcaaacagcttcgtgtgtcgttgcgccgcgcatagttccagcgccagctcggcactgaagaatctggtgaccggcctggatcgagatccaagctcgagcaggaacggagagcgcgcggatatatatagctaggatgatgatgatgatggacaggcaactcgtcaggcaatgcgacatggaggtcatgaggatatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtg

SEQ ID NO: 51510 - protein, 98 aa, Zea mays
  misc_feature: Ceres CLONE 1466329-F
  misc_feature: SWISSPROT Homolog: EC 3.2.1.23 Beta-galactosidase
MMMMMDRQLVRQCDMEVMRISIPSTSRGGPVPNSPYSESYYARSLAVVLQRRDWENPGVTQLNRLAAHPPFASWRNSEEARTDRPSQQLRSLNGEWKL

SEQ ID NO: 51511 - DNA, 829 bp, Zea mays
  misc_feature: Ceres CLONE 1466333-F
  misc_feature: Encodes the peptide sequence at SEQ ID NO. 51512
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (30)..(30): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (468)..(468): n is a, c, t, g, unknown, or other
  misc_feature (469)..(469): n is a, c, t, g, unknown, or other
acccgctaaaaaaaaacnncccccccccnncccaccacaaccacatactggaactccccgcggtggcggccgctctagaactagtggatcccccgggctgcaggaattcgcacgagaccattacctaaaacatcctaatcgaaaaaccacgcccagtcgcccacgcagccggcccaagcccaaaaacctttctccatcctctactctcatccccacgatggccgccgccgccaccacgccgcactccctcctcctccagcgcgccgcgatcccggccgcgccgtcgagggcgtccgccgccgcctctcccgtccgcctcccggtccgcgccgccaggatctcgtgcgcggcggtggcagcgccgtccccggccgcagccgccgcggcggacgaggtggagcgcggcgtctacaactttttaannnnncgcgcgacactccctctctccgtggtcaaacaacccccctnnctgacgggtgggagttatttcggctcccccaccaccatcatgtacatgaaccaccgcgcgaacgacctcgacgccgccatcaaaaaggccgagtccgaactgcgcgcgctcctcgcgggggcccgacacccaacccgggctcatcctacaaggcggcaccaaccacttactttaccgccgttctcgcttcattcttggaggggggtccaccgacacgtggcgagattctcctgttccggatcgctgcaccctataagggcctttaacggaggcccaaaaattttatccggtgtctttagattccaggattccggctaaaagaacggtaaagtaaatatgacacattcacgcgggagcgag

SEQ ID NO: 51512 - protein, 189 aa, Zea mays
  misc_feature: Ceres CLONE 1466333-F
  misc_feature: SWISSPROT Homolog: EC 2.6.1.52 Phosphoserine transaminase
  misc_feature (69)..(69): Xaa is any aa, unknown, or other
  misc_feature (70)..(70): Xaa is any aa, unknown, or other
  misc_feature (84)..(84): Xaa is any aa, unknown, or other
MAAAATTPHSLLLQRAAIPAAPSRASAAASPVRLPVRAARISCAAVAAPSPAAAAAADEVERGVYNFLXXRATLPLSVVKQPPXLTGGSYFGSPTTIMYMNHRANDLDAAIKKAESELRALLAGARHPTRAHPTRRHQPLTLPPFSLHSWRGVHRHVARFSCSGSLHPIRAFNGGPKILSGVFRFQDSG

SEQ ID NO: 51513 - DNA, 723 bp, Zea mays
  misc_feature: Ceres CLONE 1466334-F
  misc_feature: Encodes the peptide sequence at SEQ ID NO. 51514
aagctggagctccccgcggtggcggccgctctagaactagtggatcccccgggctgcaggaattcgcacgagaccattacctagaacatcctaatcgaaaaattttcacatcgccaacaaaaccgaaacatcaaagaggtgacagcgtcctctggcagtccccccaatggagagcaccttcctcatgatcaagggagagggagtccataggcgcctcattggttatatcctcagccgctgtgagaagaatggcttctatctctcggccttgaatcttgtgaacgcggagaggtcctttgctaagaagcactatcccgatctcgcctccaattccttcttccatggctgcgagaactaatcttctctagacttgcggaggccatgctctgtgagttcaggatcgtctcacaactgttcgcaagatcatagttcgagcaaccccatgcgtctgaacccgggaccttcatggcaactttgtagtaaactttcgataaatttctttcggaaagaaccccttgaaggtcttaccaggaaatttccctgagcttccccaagggccctgttaattggcaaacccccttcccccgcggattaagaaaaaaaaaatgggaaaattcattttgccctttaagccccagaaaattttttccctttgggttaagaggttttttcaaaaaaaaaatatttttcccggaactttttgggggaaaaattttttttttc

SEQ ID NO: 51514 - protein, 63 aa, Zea mays
  misc_feature: Ceres CLONE 1466334-F
  misc_feature (2)..(63): Pfam Name: NDK Pfam Description: Nucleoside diphosphate kinase
  misc_feature: SWISSPROT Homolog: EC 2.7.4.6 Nucleoside-diphosphate kinase
MESTFLMIKGEGVHRRLIGYILSRCEKNGFYLSALNLVNAERSFAKKHYPDLASNSFFHGCEN

SEQ ID NO: 51515 - DNA, 744 bp, Zea mays
  misc_feature: Ceres CLONE 1466343-F
  misc_feature: Encodes the peptide sequence at SEQ ID NO. 51516
  misc_feature (744)..(744): n is a, c, t, g, unknown, or other
ttcctggagctcaccgcggtggcggccgctctagaactagtggatcccccgggctgcaggaattcgcacgagaccattacctagaacatcctaatcgaaaaattccactgtttctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaactagggagtcctcgcccttcgagctcccccttggaaagtacggcctcgacggagagaaggcgtgtgcccagctcctgagcgggggggaggcagtggctctccacaggtgacccattcccccccccccacactataagccacctcttgcagcgtgtgttgtaaatggggccttggaactggattcttctgaagctacctcccctggacgaactctaattgtcccatacatcacaagatcgtcaagcctatctcatgggaccgaacctgcaccaaaggcctccgctggtccttcatgggcgcgaaaaaggggccacacctgactatacccccccgtgggggggggggaccccaaaacctcctacatcccttgcaaaaccggagggcaccctttttatgtttcctcggaacagggggcacggttgaaaggtcccccacgctccctctcggcn

SEQ ID NO: 51516 - protein, 67 aa, Zea mays
  misc_feature: Ceres CLONE 1466343-F
MRVAPRVLFLVRDAAGYGAALADALRPPPGLTRESSPFELPLGKYGLDGEKACAQLLSGGEAVALHR

SEQ ID NO: 51517 - DNA, 728 bp, Zea mays
  misc_feature: Ceres CLONE 1466353-F
  misc_feature: Encodes the peptide sequence at SEQ ID NO. 51518
  misc_feature (517)..(517): n is a, c, t, g, unknown, or other
  misc_feature (562)..(562): n is a, c, t, g, unknown, or other
  misc_feature (564)..(564): n is a, c, t, g, unknown, or other
  misc_feature (608)..(608): n is a, c, t, g, unknown, or other
aaagctggagctccccgcggtggcggccgctctagaactagtggatcccccgggctgcaggaattcgcacgagaccattacctagaacatcctaatcgaaaatctttctctctcacgctaaatggatgggcacgctacgccgcattcctcccccgcagccgcttcttcgcccacacgctcgcgcgctcggaatactccgaggagggtgctcgaggagggcgacgatccggccacttcctgctcgcctcgccgccggtcccgcgccccggagccctagagctctccccgcggcgggaccgccagagtcctcgggcgcgtggagaaaatggaggcggcgctggaggcggcgcgcgccaaggacaccaaggagcgtctggccggggtcgagcggctgcacgaggtgcttgacgtcgcgacgcgtcgcgggctgacggcggccgaggtcaccgcgctggtggacccctgcatggatctgacgcgggatgccaacttccgcatcgcccagggcggcctccangcgctctccgtcgccgctgtcgtcgccggcgacactttcagatcnanctcaactccctcgtcttcgccgctgtcaaccccttcgggaaagnaaggaagcccgtccgaaaggcccggggccagttccttattaggttatgggaggagatgcacagcccctgggaatccaattttcgggaagctttgcccccccaaatcggcctttgaaaagc

SEQ ID NO: 51518 - protein, 134 aa, Zea mays
  misc_feature: Ceres CLONE 1466353-F
  misc_feature (64)..(64): Xaa is any aa, unknown, or other
  misc_feature (80)..(80): Xaa is any aa, unknown, or other
  misc_feature (95)..(95): Xaa is any aa, unknown, or other
MEAALEAARAKDTKERLAGVERLHEVLDVATRRGLTAAEVTALVDPCMDLTRDANFRIAQGGLXALSVAAVVAGDTFRSXSTPSSSPLSTPSGKXGSPSERPGASSLLGYGRRCTAPGNPIFGKLCPPKSAFEK

SEQ ID NO: 51519 - DNA, 704 bp, Zea mays
  misc_feature: Ceres CLONE 1466357-F
  misc_feature: Encodes the peptide sequence at SEQ ID NO. 51520
  misc_feature (374)..(374): n is a, c, t, g, unknown, or other
tggagctccccgcggtggcggccgctctattcctagtggatcccccgggctgcaggaattcgcacgagaccattacctagaacatcctaatcgaaaagaatcattccttctcgccgataagcagcagctcatcacctgaaggagagcagcccggaggagggggagcaagcagcagccgtccgtggaagaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctggcagcagtagctgagaccataaagaactttgcggtcatctaccttggngacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaagagttcatcgacatttgtggagaccgtataccaggggcgcccgggaaaggccgtgggtctgggtgattggctccaaaaggactactcccaccaagtacccgttacctagaaagccgggcattccccttaatgcaatcctattgggggatttttttacccggaacagtttagcccccacagggg

SEQ ID NO: 51520 - protein, 131 aa, Zea mays
  misc_feature: Ceres CLONE 1466357-F
  misc_feature (4)..(129): Pfam Name: DIM1 Pfam Description: Mitosis protein DIM1
MSYLLPHLHSGWAVDQAILAEEERLVIIRFGHDWDETCMQMDEVLAAVAETIKNFAVIYLGDITEVPDFNTMYELYDPSTVMFFFRNKHIMIDLGTGNNNKINWALKDKQEFIDICGDRIPGAPGKGRGSG

SEQ ID NO: 51521 - DNA, 1045 bp, Zea mays
  misc_feature: Ceres CLONE 1466362-F
  misc_feature: Encodes the peptide sequence at SEQ ID NO. 51522
  misc_feature (19)..(19): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (29)..(29): n is a, c, t, g, unknown, or other
  misc_feature (465)..(465): n is a, c, t, g, unknown, or other
  misc_feature (466)..(466): n is a, c, t, g, unknown, or other
  misc_feature (478)..(478): n is a, c, t, g, unknown, or other
  misc_feature (484)..(484): n is a, c, t, g, unknown, or other
  misc_feature (607)..(607): n is a, c, t, g, unknown, or other
  misc_feature (1045)..(1045): n is a, c, t, g, unknown, or other
gatttgtgtaaaaaaaacnccnnnccccnacaccaccccaataatggaactccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggctttcacccccaggcgcagcagcagcacaagcagggcgccatgatgacggcgctcaaagccgccaacggccgcgacctttcggccgggtcgaatgctgagggttgtccggggtttgattttaacccaccaccgtagatctggacttatgggggggttatagaatgcnncccccccccccnaaaaanaaaagagatagaaggcagggaaaacccatacgcactttgttcgtctccccgcgacatacagaggagtcctatcacactccccgtgcggcaccgagggaagtctaaattaaaatttaggtcacntgttgtcccccctgaaccgtgttctctggcatgcgcttttcgtcgcttccaattaacactcctcttcgtggtggattcccgcactctcagacatgggtgtacacaactaccaccatagaccatacagcttatgggtggtattcgaggagagacgccgtgagctactctacagctgtatagtcgctaatcatgccctaccgtccttcttttcttctccttgctctcattggagccttcttttgatatagaaaaatagactcctcttttatatctgaacgtttaggcgcggcggctacccaccttattaaataactaatggcgctgccgagcggcgaattagtagagactctcaatagattaagcaggtatgaatcgtcatttcagcatatctgccacgtaaacaactcctcggctggtcgcctctgtactgcctatggn

SEQ ID NO: 51522 - protein, 67 aa, Zea mays
  misc_feature: Ceres CLONE 1466362-F
MADHHRGATGGGGGYGDLQRGGGFHPQAQQQHKQGAMMTALKAANGRDLSAGSNAEGCPGFDFNPPP

SEQ ID NO: 51523 - DNA, 783 bp, Zea mays
  misc_feature: Ceres CLONE 1466369-F
  misc_feature: Encodes the peptide sequence at SEQ ID NO. 51524
  misc_feature (364)..(364): n is a, c, t, g, unknown, or other
  misc_feature (394)..(394): n is a, c, t, g, unknown, or other
aagctggagctccccgcggtggcggccgctctataactagtggatcccccgggctgcaggaattcgcacgagaccattacctagaacatcctaatcgaaaaaggagagcactggcttgtatccctctggcctctctcgtctccagcgacggcagcgggcgagggttacgcgaaggcgaagcggagtagtggaagcagaggcggcagccatggcggtgatggagaagctcaagatctttgtcgttaaggagcccgtagtcgcggcctcctgcctcatcgctggattcggtctctttcttccagcagttgtccggccaatcctggattcatggcagaccgcggaacaagttcctccacctcttctnaatgatgtggttgcaggtgtcaccggcaanaaaaagtagtaaacttgcattggtttctcatgccaatattgccccacattttcttccccgttgttttttctggggaaccagattggaagggtttttcccaagagtggcctggaactctaaatggtaacccccggaaataaccttggtccccggattcattaacctgcaaggggggcaattatgaaaaattttttcccctccctcacaaggttttattgaatggccaaaaaaaaaagaaaaaaaaggttttttccaaccccccccccccccgggggggggggcgcgggacacacatttcccccccttagaggagggctgtatattcccgccggctcttgggggggggttgttttaaaacagcgggggggggggggaaaaaccctcggggg

SEQ ID NO: 51524 - protein, 64 aa, Zea mays
  misc_feature: Ceres CLONE 1466369-F
  misc_feature (62)..(62): Xaa is any aa, unknown, or other
MAVMEKLKIFVVKEPVVAASCLIAGFGLFLPAVVRPILDSWQTAEQVPPPLLNDVVAGVTGXKK

SEQ ID NO: 51525 - DNA, 862 bp, Zea mays
  misc_feature: Ceres CLONE 1466380-F
  misc_feature: Encodes the peptide sequence at SEQ ID NO. 51526
  misc_feature (421)..(421): n is a, c, t, g, unknown, or other
  misc_feature (862)..(862): n is a, c, t, g, unknown, or other
ccccgcggtggcggccgctctagaactagtggatcccccgggctgcaggaattcgcacgagaccattacctagaacatcctaatcgaaaagatacacacagtcacagcagctgagcagccccgctctccagtctccacacctcctgcggccggcccgacggccccccgacaccgaacatgaagagggagagacgtcacggcatgagcgcacggctaccgaccatgctgctggcaatgcttctgctgctggcgaccgagctcgcctccttcggctgctgcggccacgggattcccagaaccgacgtggcggcgtggaagcataaacgggtggccatgccggcggctgcgtcggcggtggttgtgtgtgaaaacaacaacaggaggggccgcggcgttatttgtttatgggccctttccccanacccgggaacaaaccccaaacagggcccccgggaaatccaaaaaagcttggggcccccaaggggccctcacccccgtcgccaaattatagaaaaccgttggccttggaacaccaagaaaaaacaaaaacgcgggcccgcggaaggggtctctcccccccggggaaatcctttcggggtatttttttttttacccccccccccagagaggcaacacacagggcccccccggcatcttttagggagccccccgttcattttttaataattatttatgccttctcacatgggcgtcctattaagggccagtttttgagggcgggtgtgtctcttcctccccactctcccaatacaaggagccacacacctctcggggtcgtggcgtgaagctaacatattttcttctctcagaaaataaaataaaattttcttccctcctcgtn

SEQ ID NO: 51526 - protein, 168 aa, Zea mays
  misc_feature: Ceres CLONE 1466380-F
  misc_feature (82)..(82): Xaa is any aa, unknown, or other
MKRERRHGMSARLPTMLLAMLLLLATELASFGCCGHGIPRTDVAAWKHKRVAMPAAASAVVVCENNNRRGRGVICLWALSPXPGTNPKQGPREIQKSLGPPRGPHPRRQIIENRWPWNTKKKQKRGPAEGVSPPRGNPFGVFFFLPPPPERQHTGPPRHLLGSPPFIF

SEQ ID NO: 51527 - DNA, 723 bp, Zea mays
  misc_feature: Ceres CLONE 1466381-F
  misc_feature: Encodes the peptide sequence at SEQ ID NO. 51528
aaagctggagctccccgcggtggcggccgctctagaactagtggatcccccgggctgcaggaattcgcacgagaccattacctagaacatcctaatcgaaaagaagcccccactacggtccgaccgatgtctcgctgacgtcacctcgtgttcaccagttaccaccggagtccggagtgaagcgcaggtcgggttcgcttttttcctcggcttcttctctctcgtccatcaacccagggggaaggagcgggagggagcgagccatggtagtcagcacgttcaatggacccgggattgggatcgggttcggtgtcggctgcgggttcggcgtcgggtgggggttcggaggaatgcctcttaacatgttcggcttgggtatcggtgggggttgtggatttggtcttggactaggatggggctttggaaatgcttttggttgtcagtatcgatcttcaagagttcagttccaaggcattgaatttcagaagaaggcggaaggagatgatgcaccaaaagttgtttcaccggagcttgctcaaaagtctcgtccttatggctagtatgcctgctaccataaaaattcagagactgttttgtgtgatgaatcacagtttaattacatacctacgtgttccttgttagtaatgttatgctacacttattttcgtttctgttgtaaccaggatgaagttaatcgatgggattttcaattaggaagaaatg

SEQ ID NO: 51528 - protein, 98 aa, Zea mays
  misc_feature: Ceres CLONE 1466381-F
MVVSTFNGPGIGIGFGVGCGFGVGWGFGGMPLNMFGLGIGGGCGFGLGLGWGFGNAFGCQYRSSRVQFQGIEFQKKAEGDDAPKVVSPELAQKSRPYG

SEQ ID NO: 51529 - DNA, 788 bp, Zea mays
  misc_feature: Ceres CLONE 1466382-F
  misc_feature (368)..(368): n is a, c, t, g, unknown, or other
  misc_feature (413)..(413): n is a, c, t, g, unknown, or other
  misc_feature (674)..(674): n is a, c, t, g, unknown, or other
ctggagctccccgcggtggcggccgctctagaactagtggatcccccgggctgcaggaattcgcacgagaccattacctagaacatcctaatcgaaaaaaacaaagagcgagcataaaccccgctatacccgcttccttctctccaatctccggtgctcgcatcccgctccgcctccatgcgccgcggcagttccacgacgccagtcctctcacctctgtcctgacccaacacccgggcggctggaacccgcaggtgcgcttagtgccgctcgaagaggctcgccgtttgctggattcgttctgtcctttgccggccggcattgtgccctccgcggcggcaacaggggcgtgcgcggtgctgctgtangggagggtgacgggcatctccctgggtcggcgcgggccgggccgntggcgtgcgaggaagacgggatcacaaagcacggggctcccccagtctagccaggtgggtttgaatggcttcccacgctccagctgttggttcccttgcccttaacagctttggcctttttcctcccccagggcaattgactgagagattctccccgggacctctccgggttgggccaaggggactcccaccgggtaaggggcacctaaaaggcctggaaaacaacgggggggcgtggggaaaccaaaaaggggggggaanaccccctttttcccacaaggagggcgcgggggggcgtctttctataaaaaaattggagggggggggtgtgctttttttaaaggggggttcccccccaaaatatccctttcccta

SEQ ID NO: 51530 - DNA, 810 bp, Zea mays
  misc_feature: Ceres CLONE 1466387-F
  misc_feature: Encodes the peptide sequence at SEQ ID NO. 51531
  misc_feature (376)..(376): n is a, c, t, g, unknown, or other
aagctggagctccccgcggtggcggccgctctagaactagtggatcccccgggctgcaggaattcgcacgagaccattacctagaacatcctaatcgaaaaaccaaagcctccgcccccttccctgacaccctcgccgccgcgcacgcacgcacgaaccagcgaagagatgggcgtctacaccttcgtgtgccgcagcgccggcggcggcgagtggaccgccaagcagcactccggcgagatggaggcctccgccgccaccccctacgagctgcagcgccgcctcgtcgccgccgcctccgcggccgactccgcgtccggcgtccagtcgtccttctccatggtcacccccagctccgccgtcttccaggtgaacntcggtggtggcgcgatgatggttagtggcggctgcaccctcggtgcggccgccgccgagtcgggtggcgctgcggccgaacctccccaggaggagaagaaggaagaggagaaggaagagagcgacgacgacatgggattctccctgttcgactagagttaagctgccttgtgcatggttgccggttcgggcgtgtcccgccaaaccgtgaagagctcaggcgggcctttttggttccagtccccccatgtggaaagcctttgaaaccctggtcctggaaatgaaaaaaatttccccccccaaaaaaaaaaaaaaaaaaaagccttatccaatacccgtcgaaccctcgagggggggggccccgtgtaccccaaatttccccccttattagggaggccctcattataccccccgcctccacttggcgccgtcgtt

SEQ ID NO: 51531 - protein, 120 aa, Zea mays
  misc_feature: Ceres CLONE 1466387-F
  misc_feature (26)..(119): Pfam Name: Ribosomal_60s Pfam Description: 60s Acidic ribosomal protein
  misc_feature (70)..(70): Xaa is any aa, unknown, or other
MGVYTFVCRSAGGGEWTAKQHSGEMEASAATPYELQRRLVAAASAADSASGVQSSFSMVTPSSAVFQVNXGGGAMMVSGGCTLGAAAAESGGAAAEPPQEEKKEEEKEESDDDMGFSLFD

SEQ ID NO: 51532 - DNA, 715 bp, Zea mays
  misc_feature: Ceres CLONE 1466389-F
  misc_feature: Encodes the peptide sequence at SEQ ID NO. 51533
aaagctggagctccccgcggtggcggccgctctagaactagtggatcccccgggctgcaggaattcgcaagagaccattacctagaacatcctaatcgaaaaataccaccgcagcccaggctctcagccttatccccttcgtacaacactgtcaccaggaattcccttgcctttgctcgttctcatggccgagcacaagtcttcctcaagcgtcgcctgctgtaccagtgtcgagctccccacgcccaccgctactcctagcccctctcctccctggatttcgcccagtctccatctctctttctagccatggacggcgatctctcctgcctacagcaggtcagcgccccatctcctcaacatctcggctccctgtcccatctctctcacgagccactcttctcgttctccatggcgtcgacatggggctcgcccctgcaacctcgcctcgctgggtttcctcagggcgccgggatgctgcttcctatacatcgtgcgactccctggtgcttgctctcgccctagtccatggagcagtagcagccacgacactccttcgtgtcgcgccctcgacgtgttcgatgaaatactgcagcgagctccaactcgatctgcacagcccctgcgcgacgtcacaaactccgctcgttgtcgatgtcgtgcttcgggcatcgcgtgttcgacgaaaatcccaagtccatggacagcacatgca

SEQ ID NO: 51533 - protein, 97 aa, Zea mays
  misc_feature: Ceres CLONE 1466389-F
MGLAPATSPRWVSSGRRDAASYTSCDSLVLALALVHGAVAATTLLRVAPSTCSMKYCSELQLDLHSPCATSQTPLVVDVVLRASRVRRKSQVHGQHM

SEQ ID NO: 51534 - DNA, 730 bp, Zea mays
  misc_feature: Ceres CLONE 1466390-F
  misc_feature (730)..(730): n is a, c, t, g, unknown, or other
ctggagctccccgcggtggcggccgctctagaactagtggatcccccgggctgcaggaattcgcacgagaccattacctagaacatcctaatcgaaaaataaaccttcgccaagattctctctctatacctcttcctttctctctccgtcggcgatgcaaaggctttccatagacgcatcagcttcgaagctccagagctacgatatcaatgactccaatcggaaagaatcactctcctctcctcctccttcttcgtcatcgtccgctccagattacgacgatcacgacctcaaggacgttaagctcagacggctatcgtcgctgcaatcgcctcatcagaaacgcgagaacctcgtccacttcatccccgtcctcactctaatctgcttcgtcatcctctacctctcttctcacgctccgtcgcaatcagatttggctcagtttaacggattcatgcgttcatcaaagcgtctagaatccgacgaagatggcgaaatctctgggctgatgatcggtaccgacgcttcggctatccggagtagcataaggaagttgagagagacggaatcgcttccccgccgccgaacctctcaccggaaaacagctgacttctagctttttttcactcacatcgtcttcttgtgggtttgttcattgaaactcaaaaatcgcgatttctcgttctgttataactaatggatattttaaaaaaaaaaaaaaaaagcttan

SEQ ID NO: 51535 - DNA, 747 bp, Zea mays
  misc_feature: Ceres CLONE 1466396-F
  misc_feature: Translation starting site: 312
  misc_feature: SWISSPROT Homolog: EC 2.7.4.9 dTMP kinase
  misc_feature (706)..(706): n is a, c, t, g, unknown, or other
tacccgcggtggcggccgctctagaactagtggatcccccgggctgcaggaattcgcacgagaccattacctagaacatcctaatcgaaaaacgcgcttctactgacccgactctctgaaaactaggaaccccactccccctcccgaaactaccgccgccgccgctgccgccgcgatccaggtctcccgcggtcccgccccgcctgagctctcgacctcttcactcctcgccgccgctgctcgccctcccgcgtatcctcgtctcagctctcaggttttcagcctgatcaaaccggtgtaaccagccgtgcatgactgcattggttcggctcgccggaagagcagcttcgcggagcagggtcggcatagcggcggcggcggcaccctctcctgtcggcttgtccgtgcagcgccggagggcgttccagggcgtgagaatggagacggggggcagcaagggcggccgtggcgctctggtggtcctggaaggcctggaccggagcgggaaaacttcgcagtgtgcccggctgctgtccttcctcaaggcaaaggctacaatgccgaaggatggaggttccccgatagggccaccagtgtggggcagatgatatctgcctatctcgctaacgattcgcagcttgatgacaggacgattcatctgctcttcagcgccaaccgctggggagaaagagctttgatggagagncagctacttagtggaactactctcattgtagaccgttactc

SEQ ID NO: 51536 - DNA, 739 bp, Zea mays
  misc_feature: Ceres CLONE 1466398-F
  misc_feature (326)..(326): n is a, c, t, g, unknown, or other
tggagctccccgcggtggcggccgctctataactagtggatcccccgggctgcaggaattcgcacgagaccattacctagaacatcctaatcgaaaaacctccatccagctcgagccagcccgtcgcctgcgcgcatctctctacacttctactgcttcatactctcgtagagagatcccgcgcggcccaataaaaacccgactcgctagctacactacacactcgcagatggccggcctcaggatgaagttcgtcgccgtcgccgccatggccgccgcgctcgtggcgtccgccgcagccgccgaagccccccgcccgggccccngcttcgaacgcgcgggccgccgtgcccctctgcgggggctccctcgccggccgccgctttcggtacctcttctggtaaaacccccctggacggggggtttctgcttgatttgggaatcccccgggcccaatggaaccctggttccggccccggtcttggtaaaatttttcccgggggcttgttcttttatattggcccccggggcaaaaaaagggtgccccctgggggaaccggcccccacccctccttttgtgggggggaaaaagggccccgccccctttttggttttcaaggggagtgttttttttttcaaaaaaaaaaaaaaaaaatttttttcccccccccccccctgggggggcggccccccccaccccccctcaagagggagagaataacccccccccccccccccc

SEQ ID NO: 51537 - DNA, 725 bp, Zea mays
  misc_feature: Ceres CLONE 1466400-F
  misc_feature: Translation starting site: 168
  misc_feature: SWISSPROT Homolog: EC 3.1.4.17 3',5'-cyclic-nucleotide phosphodiesterase
ctggagctccccgcggtggcggccgctctagaactagtggatcccccgggctgcaggaattcgcacgagaccattacctagaacatcctaatcgaaaaacttcagttgcgggtgcggccaccttctcccctttcctcagaccccaggccccagcccggcaagcagacatgggcaaccgtgcgtcgcgccaccaccgccaagccgccgagcagcaaccggcgacgccgaccctgccgaagccccagccccagatccagccgccgcctccgcctccgccgacgcagacgcagcagtaccagcaggcgccgccgcagtcgcagcagaagccgaagccggcggcggacttgggggcggtggggcgcgtgctggggcggcccatggaggacgtgcgcgcgaactaactttcccccgccagctcgggcggggccagtcgggggcccctactcgtcacgccttcgaaaccggcaacgcttcgctgaaagtcatcgcccccggaacctcgccaccgcaccaatttaagaactgcccccgaagggcaaaattgcccccctccggggccccgaaaattttaaaactcgggaaaaaaaaaagaaagccccccccccaccttttaggaccctcggggggggggaacttttcccgccttataacaggggcccttaccgagggggccccccccctctttccccgaaaaaaatcccccttcaaaaaggtcaccccggggg

SEQ ID NO: 51538 - DNA, 762 bp, Zea mays
  misc_feature: Ceres CLONE 1466403-F
  misc_feature: Encodes the peptide sequence at SEQ ID NO. 51539
ggagctccccgcggtggcggccgctctagaactagtggatcccccgggctgcaggaattcgcacgagaccattacctagaacatcctaatcgaaaaagcattcaaactagggtttactcctgccgctccgagaaagcaaacaagcgtcagctccgccggctgcctccgcgctttctccccgccgccgccgccgccgctccttccctacgccaggcacgccaagatgaagctcgtcaggttccttatgaagctgaacaatgagacggtcaccatcgagctcaagaacggcacggttgtacatggcaccatcaccggtgttgacataagcatgaacactcatctgaagacagtgaagcttacactgaaagggaagaaccctgtaacacttgacccactcagcgtgcgaggaaacacatccgctactacatccttcctgacagcttaaacctggaaaccttgctgggtagagaaacccctagggtgaagcttagaagccactaccggaagcccttggggcgtggtcccgcccaaggtctggactggttcgaaccgggggcccccttaactttttcgtccccgggtggcgggcccctccctggaaaaaaattttcccaaaagggaaaaccctttccccgccccttgggaaaaaatgtccccccttccctttccaggggggaaaatttcccggggggtattttggggggaaaaaaaaaaaaaaaatttttcccccccccccccgggggggggcgcgcacatcctcca

SEQ ID NO: 51539 - protein, 73 aa, Zea mays
  misc_feature: Ceres CLONE 1466403-F
  misc_feature (5)..(70): Pfam Name: LSM Pfam Description: LSM domain
MKLVRFLMKLNNETVTIELKNGTVVHGTITGVDISMNTHLKTVKLTLKGKNPVTLDPLSVRGNTSATTSFLTA

SEQ ID NO: 51540 - DNA, 581 bp, Zea mays
  misc_feature: Ceres CLONE 1466407-F
  misc_feature: Pfam Name: Synaptobrevin Pfam Description: Synaptobrevin
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
ctccccgcggtggcggccgctctagaactagtggatcccccgggctgcaggaattcgcacgagaccattacctagagcatcctaatcgaaaacagacgccttgacaaaatttcaggatcctgcggaagctgacaaattaatgaaaattcagaagggacttggatgaaacaaaaattatcctacataaaactatttgagagtgtccttgcccagaggagagagatttgaataacttgggtttgaaaaaaactcctgaatctgagtgcctgcttccccaaaaggttcaacagagccgggcaaagaaaaaaaaaacccatggcgtgccccaaaacgggaaaaattttgggcccctcccaccccgggggtgggcgaaaaaaaaaaaaaaagggggcaaaaaaagcgggggcaaatttttttttttttcgcggggagaattaaaacccccccccagaaaaccgggaaacaccttgttttttaaggcccccccccctccttaaaaaaaggggggggggnnnnnnnnggggggggtgggtgtttttttctccccccacccccccccccccaaaaaaaaaattttgttt

SEQ ID NO: 51541 - DNA, 756 bp, Zea mays
  misc_feature: Ceres CLONE 1466408-F
  misc_feature: Encodes the peptide sequence at SEQ ID NO. 51542
ggagctccccgcggtggcggccgctctagaactagtggatcccccgggctgcaggaattcgcacgagaccattacctagaacatcctaatcgaaaaaagaaaaaaattctcgtgttcttcgaccggtggtggtggtgcgaacgcaaggcgaccaaggggaggcgagatgaggggggcgaagcggccgctcagcgtggtgacgtcgtgggtgcggcggcagccgcccaaggtgaaggctttcttggccgttgtcaccggcatggccgcgctcgtcgtcatccgcttcatcgtccacgaccatgacaacctcttcgtcgctgccgaggctgcgcacgcgctcggcataggcgtcctcatctacaagctcacaaaggagaagacatgtgccgggttcgtttccgcctgctttctttgcacccgttcccgatctgtcgagatcgcccgtgccggcgcagatagggtctaggatttttatagggatttggcccgccatttcacgtttcagacgacgattttactcctgtgaacatctaggactgggaaaggttagaatatttattggggctatttggatctataaatacacttatggttttgcccatttttaaaaatgtttgttgggcctccaatggttaccatggcttggtttgggtcttggacgggattccgggtaaggattcctcggggaacttttggaaaaaaaaaaaaaagacttttctttcccgccaccttagggggggcccggacccattttcc

SEQ ID NO: 51542 - protein, 99 aa, Zea mays
  misc_feature: Ceres CLONE 1466408-F
MRGAKRPLSVVTSWVRRQPPKVKAFLAVVTGMAALVVIRFIVHDHDNLFVAAEAAHALGIGVLIYKLTKEKTCAGFVSACFLCTRSRSVEIARAGADRV

SEQ ID NO: 51543 - DNA, 722 bp, Zea mays
  misc_feature: Ceres CLONE 1466409-F
  misc_feature: Encodes the peptide sequence at SEQ ID NO. 51544
  misc_feature (722)..(722): n is a, c, t, g, unknown, or other
ctggagctccccgcggtggcggccgctctagaactagtggatcccccgggctgcaggaattcgcacgagaccattacctagaacatcctaatcgaaaagcaaaacgacacggacgtatttccgcttccacctgcgccgagatctcggaagaggattcagaagaagcaggcttccgctgctgcttcccccactcgaatccaagcaaccacgcccccacgcccagtccaaccccaacccgcgaagctggcgcgcgaggcggccgacgcgagcgcccgcaagcgcaaggcgggggacggcggcgaggtccccgacgccaccgcctcggcagaggtggccgcagcgccgacccccggagaggacgcggccatgggcgacgttccacaggcgccgcacgctgcgggaggtggagaagagtgggcggggccggaccctaaccctagcccgagcctcggcggctgctcggaccccgtgtcggtggagctctccatgggcggggactactaccgcgcctgctgcggcgagcccgatcccgacatccccgaggggcccaagctgccgtgcgttggggacaaggtgagagagggagggagagcgagccctctgtctcccaccatcctcacatgtccgcgatcgggtattgggtagcccgccgtatggtgggatgggtctccatcacgctttagtgttttacaggcctgcacctgatctagtggaaatatgcn

SEQ ID NO: 51544 - protein, 92 aa, Zea mays
  misc_feature: Ceres CLONE 1466409-F
MGDVPQAPHAAGGGEEWAGPDPNPSPSLGGCSDPVSVELSMGGDYYRACCGEPDPDIPEGPKLPCVGDKVREGGRASPLSPTILTCPRSGIG

SEQ ID NO: 51545 - DNA, 823 bp, Zea mays
  misc_feature: Ceres CLONE 1466410-F
  misc_feature: Encodes the peptide sequence at SEQ ID NO. 51546
  misc_feature (381)..(381): n is a, c, t, g, unknown, or other
  misc_feature (419)..(419): n is a, c, t, g, unknown, or other
  misc_feature (430)..(430): n is a, c, t, g, unknown, or other
aagctggagctccccgcggtggcggccgctctatactagtggatcccccgggctgcaggaattcgcacgagaccattacctagaacatcctaatcgaaaagtttcttcggaggctttatttatcgtttatccacggaacttccggtgccggcggcgaccacttgtggcgatccatccctcaccatgtcctcagacaaggaggcggcgctcgccgccgtgctcgatgacagcccaaccatatttgacaagatcatcaaaaaggaaataccttctactgtggtttatgaggacaagaaggtactggctttcagggacataaaccctcaagctccaacacaaattctcatcattccccaaagtcaagggatggaattaaatggnccagaaaaaggttgaaaaaaaggcatatataaaaccanccggtgtgccnatttatatttttttaaaggtttttgccaacccacggaacgaattttaaaaagggcctttccggtcctcctttaatggacggcccccaggggggagtccaacttgtgatgacccccatcccttttttttctcctttttagagagatggacaaaaaatattggccccccccagcgaaaaaaaaatttttgggattttttttctgcgtaaagacccaaggcacgtctcaccaccattgcccaaagaaaataccctgggggttctccccaaaaaaagaaatgtgcggccgcgccacaaacatattgggcctttttttaccgggacacccccccagaaaaaacgtcgtctcgccctctctcttgtgtgtacccacaaacattttcttgtgttgttgtt

SEQ ID NO: 51546 - protein, 70 aa, Zea mays
  misc_feature: Ceres CLONE 1466410-F
MSSDKEAALAAVLDDSPTIFDKIIKKEIPSTVVYEDKKVLAFRDINPQAPTQILIIPQSQGMELNGPEKG

SEQ ID NO: 51547 - DNA, 763 bp, Zea mays
  misc_feature: Ceres CLONE 1466414-F
  misc_feature: Encodes the peptide sequence at SEQ ID NO. 51548
ctccccgcggtggcggccgctctataactagtggatcccccgggctgcaggaattcgcacgagaccattacctagaacatcctaatcgaaaagggcaaaaaccctaatcgcatctgcttccagagccccccgccgccgctgcgccctcctctcggtcctgccgtccgtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggttacattggcgagttcgagtacgtggatgaccacagagctgggaagatcgtggtggagctgaatggaagactgaataaatgtggtgttattagcccacgttttgatgtaggtgttaaggagatcgagggatggacggcgaggcttcttccatctcgccagtttggctacatcgtcctaacaacttctgctggaattatggaccatgaggaggcccgccgtaagaatgttggtggcaaggttctaggtttcttttattgaaaatgtgtttttttgagccacagatgcgtccaagaactcgtctgatgttttgaggtttgtaagactgggtgtccgagcctttgtgggttgttaaacagcgatgtgtcatgtatttcaaaatttgggattttatgagatgtacctgcaagaagcctgtctgttccattttaggaaatggtttttat

SEQ ID NO: 51548 - protein, 130 aa, Zea mays
  misc_feature: Ceres CLONE 1466414-F
  misc_feature (5)..(130): Pfam Name: Ribosomal_S8 Pfam Description: Ribosomal protein S8
MVRVSVLNDALKSMYNAEKIGKRQVMIRPSSKVIIKFLTVMQRHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 51549 - DNA, 773 bp, Zea mays
  misc_feature: Ceres CLONE 1466416-F
  misc_feature: Translation starting site: 238
  misc_feature (38)..(38): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
catatatcttccccctatctagcctatatgcgcaacanaaaataccccccaacaaaagctggcgctccccgcggtggcggccgctctatactagtggatcccccgggctgcaggaattcgcacgagaccattacctagaacatcctaatcgaaaagcgccgccacttcccctccgagcctcagttcgcatccacgcgcgccgccgccgcctcgcagctcgacgctcaccgcgcagccatggcggaacagactgagaaggctttcctcaagcagccaaaggttttcctcagctcaaagaaatccggcaaaggtaagaagcctggcaagggcggcaaccgattctggaagagcattggccttggcttcaagactcccagggaagcaattgaagggacctacattgacaagaaatgcccattcactggaannnnnnctatcagaggcagaattattgctgggacatgccaccccgctaaaatgaacagaactatcattgttcgcaggaattacctccactttgtaaagaaataccagaggtatgagaagagggcactccaacattcctgctcacatctccccatgcttccgtgtgaaggaaggggaccatgtcattattgggcaaatgccagccccctgtcaaaaaccgtgaaggtccaatggccgtaaaactcattctcacttggatcccccacctggctggaaaaaaaggccttccacccacccctgaagttttatacactatggttccattaaaaattcctaacgaattgtct

SEQ ID NO: 51550 - DNA, 763 bp, Zea mays
  misc_feature: Ceres CLONE 1466419-F
  misc_feature: Encodes the peptide sequence at SEQ ID NO. 51551
  misc_feature (602)..(602): n is a, c, t, g, unknown, or other
  misc_feature (690)..(690): n is a, c, t, g, unknown, or other
  misc_feature (753)..(753): n is a, c, t, g, unknown, or other
tggagctccccgcggtggcggccgctctagaactagtggatcccccgggctgcaggaattcgcacgagaccattacctagaacatcctaatcgaaaaatggggttggcctagttatgcccgttgagcactagcagcctccttgaaacctccagatctgtgcctccaaggcccccgttcctcggcaacaagggtcctatctgtggtgtgccagacttcaagatgaggggaaagaagagtgatgagctcgaacctgtcgatgctggcgatgaagatgatgatggtggtgacgatggggacgaggatggtgactttggggaggagggtgaagaggacgtctcagaaggggagggatatgacaacccaaagggcaatgagaccaagaagcaaagaggtgatcctgaggaaaatgcccaccaagatgaggaagaaccagaagatcaggagggtggcggcgacgacgatgatgacgacgatgacgatgatgagaacggggatgacgaggacgacgacaatggggatgacgatgaggagggtgtagatgaagaagacgatgaccaggacgaagatgaggaggaagatgatgatgaagactcgctccagnccccaaagaagaggaagaagtgaagatcttctgccgctttagttaccgtgcgctgagttctgcctggcttttcgtcatatcctcgcantttcactttcccatagagagttaagaaggatccacacgttcagcagcacgtgtgggcttgtangagctttata

SEQ ID NO: 51551 - protein, 134 aa, Zea mays
  misc_feature: Ceres CLONE 1466419-F
  misc_feature (128)..(128): Xaa is any aa, unknown, or other
MRGKKSDELEPVDAGDEDDDGGDDGDEDGDFGEEGEEDVSEGEGYDNPKGNETKKQRGDPEENAHQDEEEPEDQEGGGDDDDDDDDDDENGDDEDDDNGDDDEEGVDEEDDDQDEDEEEDDDEDSLQXPKKRKK

SEQ ID NO: 51552 - DNA, 737 bp, Zea mays
  misc_feature: Ceres CLONE 1466428-F
  misc_feature: Encodes the peptide sequence at SEQ ID NO. 51553
cgcggtggcggccgctctagaactagtggatcccccgggctgcaggaattcgcacgagaccattacctagaacatcctaatcgaaaacacttgtcgctcgcccgcccgcgtcgtcgtctccgccggccggccggccggcctcccaaaccctagcgaggcgagcgagagagaaactagacgccatgttcgggtacaggaaggcggacccggacctcgaggccggcgggtcctcgctgctgtacccggggatgacggagagccccgaactgcggtgggcgttcgtccgcaagatctacgtcatcctcacggtccagctcgccatgacggcagccgtctcggccttcgtcgtcaaggtgcccgccgtctccaacttcttcgtctcctccaacgccgggacccccccctacatcttcctcatcgtcctgcccttcatcgtgctgtgccctctgcactactaccaccagaagcatccgatcaatctgctgctgctcggcctcttcaccgtcgccatcagcttcgccgtcggcatgacatgcgctttcactagcggaaaaatcattttgaaggctgccattcttacagcggtggtggtgaacagcttaactgcttacactttctgggctgcgaaaaggggccatgacttcaacttcccccggccccttcctaattgctgctaacatggtgcccatggtggtttcacctaatccaaatcttttttccccctggggcagaatccg

SEQ ID NO: 51553 - protein, 164 aa, Zea mays
  misc_feature: Ceres CLONE 1466428-F
MFGYRKADPDLEAGGSSLLYPGMTESPELRWAFVRKIYVILTVQLAMTAAVSAFVVKVPAVSNFFVSSNAGTPPYIFLIVLPFIVLCPLHYYHQKHPINLLLLGLFTVAISFAVGMTCAFTSGKIILKAAILTAVVVNSLTAYTFWAAKRGHDFNFPRPLPNCC

SEQ ID NO: 51554 - DNA, 689 bp, Zea mays
  misc_feature: Ceres CLONE 1466429-F
  misc_feature (689)..(689): n is a, c, t, g, unknown, or other
aagctggagctccccgcggtggcggccgctctagatactagtggatcccccgggctgcaggaattcgcacgagaccattacctagaacatcctaaccgaaaaacttgcaccctaccccaaccccatccatcgtaacccgccgccgccgcgatagatgccaatcctgccgccgcatccaaccccgcccgacgtggacgccagagaggtgcacgactgccgcaactcgtggcactcagtgtggtggtcgtccaagctcgtcctctagctcagcctcaacgccttcagcttcctcgtgccgtcgccgctcgcctagatctacgatgcaatggtgagtggctctgtgaggaggcacacaagctcacattgacggcagcaagaacggtgtcgcctccttggtggcagccatcgcgtccacgaccaccacggatgctggcgtcgcctgcttcgacctgatgcctctcgtcgtcctctcccctggctgtattttgccccgtccccggtatatccgcccccccccgagcaggccgagcttcttagcactgtcgtccgaggccattaccaccccacccagggtgggctgaacaatttccatggccagcatggccttcgggagccagccaaggaaactccaccagggcatccctgattaaaaaaatgcttttggcccgcaaagggaaaaatttgcttgn

SEQ ID NO: 51555 - DNA, 737 bp, Zea mays
  misc_feature: Ceres CLONE 1466430-F
  misc_feature (368)..(368): n is a, c, t, g, unknown, or other
  misc_feature (374)..(374): n is a, c, t, g, unknown, or other
ggagctccccgcggtggcggccgctctagaactagtggatcccccgggctgcaggaattcgcacgagaccattacctagaacatcctaatcgaaaaaatctttgaagattgttttctagcctatggctgctcttatccccattctccgacctttcttcactgaaacccaagcaccaatctccgctcgaacctccgatcatccacgcactctctcacgtcgcgacgccctctctctctcctccgcctctctcctcctcttcactctctctccaaccgatcccgcttttgccttcggaatctcaggacccaaggagtggttgaaagatcagaagaagaagtcgtccaggttcttgttagctcccattgangcgacncgcgaaagcctccgctctgtttacctttctcccccccaccacacacactgattatacggacaaagatttggagagccttcagaacctgttaaggtcttctgcaagagattgtgttcctaaagagagaagctctcttgtcgattttcagtctaaaaccggagtggaggtttgcacattcaagcttgttctgaagaatgctgcttcattactagatgataaggaccctgtcatacttgaagcagagaatatactacatgatcttggtaggtcctttggttctctcatcgttctgacaatgggaatgatatgaaccttccttctgataaaaaaaagatgcagatgcagttatggaggcaatctctt

SEQ ID NO: 51556 - DNA, 803 bp, Zea mays
  misc_feature: Ceres CLONE 1466431-F
  misc_feature: Encodes the peptide sequence at SEQ ID NO. 51557
  misc_feature (803)..(803): n is a, c, t, g, unknown, or other
tggagctccccgcggtggcggccgctctataactagtggatcccccgggctgcaggaattcgcacgagaccattacctagaacatcctaatcgaaaaaccatcacaaggagaaacaaattcttctattttagctctagctcgctcgccatcccctgcccggctgctgcccccaacggaacgacggccagaggaagctaccagagtcgatcgatcgatcgagatcgagagagagagagagagagcatggctggcaggagtttcctgattcggtcccccaaggaggaggagtccaacgccgccgtcagagaagctgtactgctgggagcaaagaacgccgcaatagctggtactgtggttgcagttcccacgctggttggctgccgtgtccttctttgggcaaaggcgaatcccaaccacactgcacaagcactcattatatctgcagcctgtattgctgccttcttcatcactgctgacaaaacctttctacggaacgccggacaaacaccatccgggaagcttgacaagtccacttgatgccaaaatggtacttgaggctgaaaaaggttccctggttgcccccgccggttgaaaagggggctctttggccccataggaggggggccccttttcccttccgtggaaagaaaaatttttgggggggttgggccttaacaaacacaaagaggggggcgggaaagccttgtcccaacgagggggccccccatatgggttccccattctcccccaaattttaaaccaaaaaaaagaggcgggtcctatattgttcactaaaaaaaan

SEQ ID NO: 51557 - protein, 97 aa, Zea mays
  misc_feature: Ceres CLONE 1466431-F
  misc_feature (11)..(89): Pfam Name: ENOD93 Pfam Description: Early nodulin 93 ENOD93 protein
MAGRSFLIRSPKEEESNAAVREAVLLGAKNAAIAGTVVAVPTLVGCRVLLWAKANPNHTAQALIISAACIAAFFITADKTFLRNAGQTPSGKLDKST

SEQ ID NO: 51558 - DNA, 742 bp, Zea mays
  misc_feature: Ceres CLONE 1466432-F
  misc_feature: Encodes the peptide sequence at SEQ ID NO. 51559
tggagctccccgcggtggcggccgctctagaactagtggatcccccgggctgcaggaattcgcacgagaccattacctagaacatcctaatcgaaaaaaaattcgcagcgtgtctcttcctccatcgcagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtacaccttgaggccgctacccggggaggagagcgagagatgtataaacaggtgggagcggggggaggggctgggctggaccggaagcggatcaacgactctctggataagcatctcgaggagggcggccgcgtccccgtccacatcgaggcccccccccggccggcgggcgcgacccaccactgcctcgtcgtgccaccctccgtgtcccccacccccagggccctctgcccccaaggggagtcggattccgaacacgaaacctccggaggttacccgtttttaaggaaaaaaccccccttgggattcctgggattcccccctaaagagggaaggagttccttttgggaaccccccagatattttaatggaaagaccacttctaacttttggggtcccgacgaccgaagtccctgaaagggagatgccccccccccccctgttagaggggcgccttccccgcgcgggagtgggcacgga

SEQ ID NO: 51559 - protein, 125 aa, Zea mays
  misc_feature: Ceres CLONE 1466432-F
MYKQVGAGGGAGLDRKRINDSLDKHLEEGGRVPVHIEAPPRPAGATHHCLVVPPSVSPTPRALCPQGESDSEHETSGGYPFLRKKPPLGFLGFPPKEGRSSFWEPPRYFNGKTTSNFWGPDDRSP

SEQ ID NO: 51560 - DNA, 762 bp, Zea mays
  misc_feature: Ceres CLONE 1466435-F
  misc_feature: Translation starting site: 253
  misc_feature: Pfam Name: SOH1 Pfam Description: SOH1
ggagctccccgcggtggcggccgctctataactagtggatcccccgggctgcaggaattcgcacgagaccattacctagaacatcctaatcgaaaacctaatcgaaaatttccaagatccggtcattctctctcggggtcggctaccgccgccgccgtacgccaggtgccgactgccgagaccttctccgatctgtttgccggcgaagagcgcccgccaaatctgcccctggtttcaaccgattgaaccccgatgtccgacgtcgagaaccctggcgtgggtgggaagccgccgccgtacaaggaccctgacaatgggagtcagcgattcctactcgagttggagttcgtgcagtgcctcgccaaccctacctacatccactgtactatctagcgcagaatagatatccccaggatgaggcatttatcgggtacctcaagtatctaaaatactggcagcgaccagagtatatcaaatacataatgtatccacactgccttttctttcttgagcttctccaaaatgccaatttcccgaatgcaatggcacatccaacaacaaggagcttgctcataggcagcaatatttcttctggaaaaactacaggaataacagactgaagcacatcataccgcgccctcctcctgaaactgcaccttcacaggcacctgctacattgcccctacaagcgtccgtgcgacacctgtagctccacctgttcctgcccaacatcgtctatgcccctgtgggagcaagtggtgg

SEQ ID NO: 51561 - DNA, 796 bp, Zea mays
  misc_feature: Ceres CLONE 1466436-F
  misc_feature: Encodes the peptide sequence at SEQ ID NO. 51562
  misc_feature (746)..(746): n is a, c, t, g, unknown, or other
tttttctcttgcagtcgctggtgtttgtttggatcttatctgtttcctccgagccatcagccccgcgggggggcggccgctctttaactaatggatcccccgggctgcaggaattcgcacgagaccattacctagaacatcctaatcgaaaaagtcctctgcctcctcgtcggaaagccctaatcccactcaatcctctcgctgccgatccgacctcaattccgaatccctcccccatctcccggcgtccccaacgccctccgccatgccggacgtgcagccgctcgtcagcgacttcgtcctcaagcttaagcgccggaaggtggaggggtcgcacgcggtggcccggcagacggcggaactgctacggtcggttgtgtcgcagcatcggatgggtagcagcgccaaccagggagcttttttttcccatgctgtacgcgctgtgggggagcagctcatctcccccaatcccattgagcttgctgttggaaacattgtgagacgtgttttacatataataaaggaggaggatatatcttccacagcagttggaatttgaaggtcttttctgttactgatgacagtgatgaagaatatgacagtgaacatgatgattgccctgcattatctgctgctgttcttgttgcacatggaaaaaatgcccttcacgcaccttctatggaaaatctgttagaagacattacctgtgaggtcctggaattttcgggactgtctccacaaacccnagaaacaaaaaggaaaaaatataacttacttggagaaaaaaaccccaccg

SEQ ID NO: 51562 - protein, 97 aa, Zea mays
  misc_feature: Ceres CLONE 1466436-F
MPDVQPLVSDFVLKLKRRKVEGSHAVARQTAELLRSVVSQHRMGSSANQGAFFSHAVRAVGEQLISPNPIELAVGNIVRRVLHIIKEEDISSTAVGI

SEQ ID NO: 51563 - DNA, 740 bp, Zea mays
  misc_feature: Ceres CLONE 1466439-F
  misc_feature: SWISSPROT Homolog: EC 3.1.4.4 Phospholipase D
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
ggagctccccgcggtggcggccgctctagaactagtggatcccccgggctgcaggaattcgcacgagaccattacctagaacatcctaatcgaaaattttttctcttcagcaaagatggaaaaagctcggggctagcgacctccatgcccctctcaagttatctttctgacgttgtcactccccccttcccctgtgatgttcccggatgacagacacacgtggaatgttcatttcttcacatccatcgatggtggtgctagcttttggcttctccgacactcttgaggaagctgcaagagctccgactagtgactggaatggataaaatcagtcgactgcgtatccatgatgcatacgtaaaggccctactgaggggaaaccattccgtataccttgagcatcaggtagttgcttccaaaacttaaaggctgaaacccaaacgggtcaagcccggaaaaaatcggcctctttccttggtcccaagggaccccccccttaaaatatggcgaaaaaagaggccgggacaactttttttttcttttatgtggggcccaatcgccctgggggggtccccaaaaaactcccctgggggattttttttcttggcaaaaagaaaaaagaagaaatttttttttttctctccaaaacttttaaaaatttgggtgggaagaaactcccgggatttcttctttttttttgtnnnnnccccttttggagaaagggtgttttttataaacca

SEQ ID NO: 51564 - DNA, 767 bp, Zea mays
  misc_feature: Ceres CLONE 1466440-F
  misc_feature (470)..(470): n is a, c, t, g, unknown, or other
taagatttggagctcctcctaggtggcggccgctctagaactagtggatcccccgggctgcaggaattcgcacgagaccattacctagaacatcctaatcgaaaaatcccacttccgcccaaatccaccacctccataccacgcgtgtccccaattccatctagtaggctggcccatggcagtagtctcggatgagatgaggcaaatataagttccggtagtcgcgggggcaagcccaagggggccaagggtgtgtctctggctaccaaggcagggctgcatttccccgaggggggcatcgggcggtacgtctacgccggcaagtaccccgagcgcttccgcaggggtgcgcccgtctacttttccgccatcctgggggagcgccgggcacacgccatgaaactgggggggcaaccccccgcgtgacaacaaaaacaaccctatcctgcctcgtcccatccacctcgccntgtgcaactactagaaactcactcagctggtccgagctggcaccatttccaacggctgtgtgttgccctaacattcaccaagccctgcttccccaaaaatgccggggggggatgggcaacgccaaagctctggttcccgcggcccactgatttctctcctggacccgcaagggctgggtggcatgtttccccgtgcgctttggctaaagtggaggctgccgagcatgccattggaggcccaccgcgtccgggtgcgatttgcgctttgcactcacttaggaggtgtacgggtgcccg

SEQ ID NO: 51565 - DNA, 767 bp, Zea mays
  misc_feature: Ceres CLONE 1466441-F
  misc_feature: Encodes the peptide sequence at SEQ ID NO. 51566
  misc_feature (337)..(337): n is a, c, t, g, unknown, or other
  misc_feature (397)..(397): n is a, c, t, g, unknown, or other
tggagctccccgcggtggcggccgctctagaactagtggatcccccgggctgcaggaattcgcacgagaccattacctagaacatcctaatcgaaaagatcggagcatcccgtcccgaggaggaagacaaccggcgacgcggggggaacatggggaagacgccggtgcggatgaaggcggtcgtgtacgcgctgtcgcccttccagcagaaggtaatgccggggctgtggaaggacatcaccaccaagatccaccacaaggtcaccgagaactggatctccgccacgctcctcctcacccccgtcgtcggcacctaccaatacgccatgtggtacanggagcaggagaagctttcccacagatattaaatgcgctgcccttgacagacagcactcgnagttttcatgatgggtttcaatatcctcccatgatgatttaacatttgtttggacaatttcagtttcacgcccttttcctcgttcccatagcaaatatgaattccgggccgggcaacttatttttggggcttgcgaaaaagggaccttttggcccccgaatgtgtaaaaaaaagaaatattcttccttttttaaaaaaaaaaaaaaaaagtttttttcttccccccccccctcggggggggggcggggccccctttttcctttaaggggggatattaaccccccccctcggggccttttttttaacccccgggggggaaaaaaccggggttcccccaattaaatggcggggggaacccttcttctttggc

SEQ ID NO: 51566 - protein, 72 aa, Zea mays
  misc_feature: Ceres CLONE 1466441-F
  misc_feature (63)..(63): Xaa is any aa, unknown, or other
MGKTPVRMKAVVYALSPFQQKVMPGLWKDITTKIHHKVTENWISATLLLTPVVGTYQYAMWYXEQEKLSHRY

SEQ ID NO: 51567 - DNA, 727 bp, Zea mays
  misc_feature: Ceres CLONE 1466444-F
  misc_feature: Encodes the peptide sequence at SEQ ID NO. 51568
  misc_feature (328)..(328): n is a, c, t, g, unknown, or other
  misc_feature (329)..(329): n is a, c, t, g, unknown, or other
  misc_feature (377)..(377): n is a, c, t, g, unknown, or other
  misc_feature (378)..(378): n is a, c, t, g, unknown, or other
  misc_feature (390)..(390): n is a, c, t, g, unknown, or other
  misc_feature (391)..(391): n is a, c, t, g, unknown, or other
  misc_feature (537)..(537): n is a, c, t, g, unknown, or other
  misc_feature (565)..(565): n is a, c, t, g, unknown, or other
  misc_feature (566)..(566): n is a, c, t, g, unknown, or other
  misc_feature (592)..(592): n is a, c, t, g, unknown, or other
  misc_feature (593)..(593): n is a, c, t, g, unknown, or other
  misc_feature (604)..(604): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (642)..(642): n is a, c, t, g, unknown, or other
  misc_feature (652)..(652): n is a, c, t, g, unknown, or other
  misc_feature (682)..(682): n is a, c, t, g, unknown, or other
  misc_feature (727)..(727): n is a, c, t, g, unknown, or other
tcccccgggctgcaggaattcgcacgagaccattacctagaacatcctaatcaaaaaaaaagccagatcggcacgacgaccagagggccccccggagcggcgcggagcaatggcggcgggataccgggcggaggacgactacgactacctcttcaaggtggtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcaaggcccagatttgggacattggtggttannaacaatatcgtggtattactagtgcgtattatctggggccccgctccnnccactgccttgnntatgacgtcacttctccatttaccctttgagaacttttgaccctttcgctgcaccgggtggggggtacctcacgcaccccgcccccagaacccacccccgcgcgagccccccatctgatattcccctattcctactacccgttcanattggtctaaggatcacgctttcttcgnngtgggggggttttttttctctccccnncaacctcctgnattttgatttttactttatcgttgaaaccnnnattcanaatgagggcnttaactttctgattttaccttatcggcgcnctaaagaataccgacgtgtaaaagccgcagaaagaattcagttgn

SEQ ID NO: 51568 - protein, 103 aa, Zea mays
  misc_feature: Ceres CLONE 1466444-F
  misc_feature (16)..(104): Pfam Name: Ras Pfam Description: Ras family
  misc_feature: SWISSPROT Homolog: EC 2.7.11.1 Non-specific serine/threonine protein kinase
  misc_feature (73)..(73): Xaa is any aa, unknown, or other
  misc_feature (74)..(74): Xaa is any aa, unknown, or other
  misc_feature (90)..(90): Xaa is any aa, unknown, or other
  misc_feature (94)..(94): Xaa is any aa, unknown, or other
MAAGYRAEDDYDYLFKVVLIGDSGVGKSNLLSRFTRNEFSLESKSTIGVEFATRSLQVDGKVVKAQIWDIGGXXQYRGITSAYYLGPRSXHCLXYDVTSPFTL

SEQ ID NO: 51569 - DNA, 613 bp, Zea mays
  misc_feature: Ceres CLONE 1466445-F
  misc_feature: Encodes the peptide sequence at SEQ ID NO. 51570
  misc_feature (367)..(367): n is a, c, t, g, unknown, or other
ctccccgcggtggcggccgctctagaactagtggatcccccgggctgcaggaattcgcacgagaccattacctagaacatcctaatcgaaaacccgcccgctccgtgttcattgccccactccctcacgcctctcgcgcccgccgctccaccacccccatccacgctcagggaaagggggtctgggttgcgtacaggcgaaaggcacgcgccgccgctgccgcgcgagcctctccgtccccatcgccgcgcagatggatccgtcgtcggagcccctgtacgcgcaggtcgagccgtacgactccggggtcctcaggtctccgatgtcacacatctactacgagcagtccgggaaccgcaggccatgncgcgtgttctccacggcgtcccggagcggcacgtcgccggcaacaggaagttcttgacccgcagtctacagaatcgtctgtttgacagagggtgcagcaaaacacctcccctgcttgttaaagcaaaccctacttgggattggttgctgacatgagaaccccaggaactccttggctccctgaatggaagggtttggtgggtcaagggaaaaccttttggcctttgccctaagccagaaaccccct

SEQ ID NO: 51570 - protein, 56 aa, Zea mays
  misc_feature: Ceres CLONE 1466445-F
  misc_feature (38)..(38): Xaa is any aa, unknown, or other
MDPSSEPLYAQVEPYDSGVLRSPMSHIYYEQSGNRRPXRVFSTASRSGTSPATGSS

SEQ ID NO: 51571 - DNA, 747 bp, Zea mays
  misc_feature: Ceres CLONE 1466446-F
  misc_feature: Encodes the peptide sequence at SEQ ID NO. 51572
  misc_feature (747)..(747): n is a, c, t, g, unknown, or other
ggagctccccgcggtggcggccgctctataactagtggatcccccgggctgcaggaattcgcacgagaccattacctagaacatcctaatcgaaaagagatctccagggtacgagcgcattcgcgattttggccgcctccgccgccgtccgggaagatggcgggtctgggaaaggcgatgtacgcggtggggttctggatccgggagactggccagggcctcgaccgcctgggctgccgcctgcagggcaagtacttcttccccgagcaaatttcaaggcatcgcaccatcatgaatatctttgacaaaacccctcatgtgcataaagacgcatttgttgctccaagtgcatcccttattggtgatgatcaagtcgggtcaggagcttccatttggtatgggtccccccctcgtggtgggatgcaaacatcatacaaattggatctggcaccaatagacaagaccaattctcttatcctcgtggctaaatctaatctaattgggaaggtctttccaacaccgttggttataacgtcccactaggtccttttgctgttgttcaagggctgcacggtggaggatgaggctttttgttgtgcttgggagaacccctattagaagggggttgttgtttcaaaagccccggaatggcgggtttgcttggaaccccttcgttacggaagaaatacttaggatccccttgtgggagaaggttatgggggaggggaaccccttgctatatatttn

SEQ ID NO: 51572 - protein, 128 aa, Zea mays
  misc_feature: Ceres CLONE 1466446-F
MAGLGKAMYAVGFWIRETGQGLDRLGCRLQGKYFFPEQISRHRTIMNIFDKTPHVHKDAFVAPSASLIGDDQVGSGASIWYGSPPRGGMQTSYKLDLAPIDKTNSLILVAKSNLIGKVFPTPLVITSH

SEQ ID NO: 51573 - DNA, 789 bp, Zea mays
  misc_feature: Ceres CLONE 1466450-F
  misc_feature (280)..(280): n is a, c, t, g, unknown, or other
  misc_feature (359)..(359): n is a, c, t, g, unknown, or other
ggtggcggccgctctagaactagtggatcccccgggctgcaggaattcgcacgagaccattacctagaacatcctaatcgaaaaacgacctccctgccgagctccctccctctccgttggtgatggcatctcagagctccaagaccgcggacaccgccgcgcctccgccggaggttgcagccaccggagaggcggctccgggcgcggcttcttcaacaccggcacaaaaccctaacgctgctgcaaccgcagtggccggggccacggatctagagaaaangatgcgccgcgcggagcggtttgggatgccagtactgatgtcagaggaagaaaagcgcaagaggtcgcgccgagagaantgggaatggcccctccaggtggaagggggggaagaggcccccaccccccccccaaaaaaggttggccttggcctccgccccccttcttcaaaaggaggaacccaaaaaaaaaggccccttttggaaccattttgggcccagacgctcaaatgggccccaaaggggggaaagaaaaaaaaaaaaaaaaggccccaaactcccccaatttttcaaaaaaggcggggggggaaccccccccccccgaaaacaccgcaaaaaaaatttataaacctggaacgaccccccttgttccggggccaccttgtgtttggagccctccgcgcgggagagggggcccacaaaaattctcccctagagaaattttggagaaaactctttttttgtccccaccccccccccgggggggggggcttcttgtttttttctcctg

SEQ ID NO: 51574 - DNA, 763 bp, Zea mays
  misc_feature: Ceres CLONE 1466454-F
  misc_feature: Encodes the peptide sequence at SEQ ID NO. 51575
  misc_feature (420)..(420): n is a, c, t, g, unknown, or other
  misc_feature (433)..(433): n is a, c, t, g, unknown, or other
  misc_feature (506)..(506): n is a, c, t, g, unknown, or other
aaactggagctccccgcgatggcggccgctctataactagtggatcccccgggctgcaggaattcgcacgagaccattacctagaacatcctaatcgaaaaacagtggtcaaccgacgccgccggtgggtgcccggaatcccggatccttgtccgccctcctgctcactccactcgcctgccagccgcacaccaatcacctctgcggccggcggcgtctgcaacgccagtctctgatccgaccccgatcggcacacacgttctccatggcggagcagctcgcatcccaagatgctcccaatccccctgctccggcacagagggtactggcgacgaacacgcatggggagaaactcgtcggcctgctgcaccacatggggcctgacaaggttgtaatttctctgccatggctccacccccncccagggactatnagcctcatccctggaccttgcggcccgccttaacaaaaccaagggaaaaaagggggttcccctttgattttangggaaaagggaaaaagggagagggaaattcacttacggcaaactaaaaaaaggggggcgcggaacttgcccccgggggccctggaactccccccccggaaaagccccccctcccccactttttggtcccccccacaaaggggaaaagggggggcgttttatatgccccttttcaaaagaaggccccccgggggggataaccctcccggcggcgttttttttagaaaaaggtctttgagcccccccccaaaaaaattt

SEQ ID NO: 51575 - protein, 66 aa, Zea mays
  misc_feature: Ceres CLONE 1466454-F
  misc_feature (52)..(52): Xaa is any aa, unknown, or other
  misc_feature (56)..(56): Xaa is any aa, unknown, or other
MAEQLASQDAPNPPAPAQRVLATNTHGEKLVGLLHHMGPDKVVISLPWLHPXPGTXSLIPGPCGPP

SEQ ID NO: 51576 - DNA, 1017 bp, Zea mays
  misc_feature: Ceres CLONE 1466456-F
  misc_feature (14)..(14): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (521)..(521): n is a, c, t, g, unknown, or other
cttttttgtttccnaaatcaaaaaannnnnncccccnnnncaacactggagctcaccgcggtggcggccgctctttaatagtggatcccccgggctgcaggatttcgcacgagaccattacctagaacatcctaatcgaaaagatataggccggcgcatctcctactgtctctccctcggtctcgtcggctcattcgcttcacctccgacccgccccgccccgagcagagcgcagccctatccggagatgggatgccggacgcgaagcagcagcagcagcagcagcagcagccacaggatgcgacagccgtcgccaccggcttgtggaaaacggagaagacctccgtaaagagggggccgctgggaaggttccagacctgattaaaccaaaccttttcaagatgttggagggaaaaaaccccccttgggtgggggactctgaagagggaggaaaaaaacccgccatctccccacccacatagaagggggaacgcgctacagtctcaaaaccggttttgttncccccagaaaaacgcccgacctaaaaagaggacgttgttttaataaagtgtttgtgccacggggagcggcgttaagggcgtttaatgttggttcggataaaactcgattatagaagaggaggtggcactgtaggatgcgcccttatgattgttgattatacactaactatcggcttgtcatttatttgtataacatcgaaaggattgggctgtacagcaaccgtgtgggagatagcgtatgataggcttctgttgggtaccgctgggggacatatatattttagtggatcatgaacctcaataccaaggatcgtgagggagtcttctcatactagtcgccttttatcagcggaacgaggacatacgtgtggggagctcccatagtagattactagtctgcgcggatagggtgggtgtaccgttggaactgtgcaaggaggtctctaaatgataatacgaatatcgagaggcgatcattctcttagctatacatgtc

SEQ ID NO: 51577 - DNA, 736 bp, Zea mays
  misc_feature: Ceres CLONE 1466459-F
  misc_feature: Encodes the peptide sequence at SEQ ID NO. 51578
ggagctccccgcggtggcggccgctctagaactagtggatcccccgggctgcaggaattcgcacgagaccattacctagaacatcctaatcgaaaactccttcgttctgtttgttgtttttcttctcccgtccgcagtccgcttggcgtgcgcgacggctagggcgaccgccgccgccctacgccctacgtccagctgcccatgtcttcttcgggccccttgccggcgggaactcaccacaccaggaatcgtgctggcaaccggcgcaagtctggagatagggctgataaagctaattactcctacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtacaatgaccaaacaattgacccctcagagaaacgggtatgtactctggatctagcagctcatcatggggtcacctgaagcttcctcatcagatgaactttcctcgagaagtgcgccgtgcagtggacgctcatacagaacttgtgtcgcctgtcgacacctggaactattcgaagtcagcatctgcatcattaggcgttatgacctaattatggaaaaccgcctttcgtccagcctatggatg

SEQ ID NO: 51578 - protein, 122 aa, Zea mays
  misc_feature: Ceres CLONE 1466459-F
MSSSGPLPAGTHHTRNRAGNRRKSGDRADKANYSYNNDGEKSNVPSLKNLPPIVHHETFFSNVQNDYNQTGLVPLEGCSASEASQLLSDRWTAAINMYNDQTIDPSEKRVCTLDLAAHHGVT

SEQ ID NO: 51579 - DNA, 730 bp, Zea mays
  misc_feature: Ceres CLONE 1466460-F
  misc_feature: Encodes the peptide sequence at SEQ ID NO. 51580
  misc_feature (401)..(401): n is a, c, t, g, unknown, or other
ggagctccccgcggtggcggccgctctagaactagtggatcccccgggctgcaggaattcgcacgagaccattacctagaacatcctaatcgaaaaatagcatagccatcttcttcgtcgacaagcaggggagttaggtctcacatgcatgcttcatcacattgttgactgcataacgaaacacatcgtcgtcggatcggagatgatgagttccgtcgtcgtggatgctgctgctaccagcagcagcgagaagaagacgtcgtggccggaggtggtgggcatgtccatcaaggaggcgacggagactattctcaaggacatgcccaacgcgtacatccaggtgctgccctgttggtcgcccgtgacgctggaccttcgcccgacccgcgtcgtatcttcgntgacaccgtcgccatgacttcgacagtggggtgatacatacccaatgcaataaaacaaccccaccttttattttagggttcccggttaaaaaaaaaccagccctaaccttctggttgcccttccctgggggggggtaccttcctacctcccagcccccccttaaaaaagggaggcccccgtgttggccccccgaaaaatggggcttttgggggaataaatttcccaaaaaaaccttttttgggggtatccccccccttcaaaaaaaaaaaaaaaaattttttcccccccccccccccggggggggcccccgcacccctttcccccaaaa

SEQ ID NO: 51580 - protein, 89 aa, Zea mays
  misc_feature: Ceres CLONE 1466460-F
  misc_feature (36)..(90): Pfam Name: potato_inhibit Pfam Description: Potato inhibitor I family
  misc_feature (85)..(85): Xaa is any aa, unknown, or other
MLHHIVDCITKHIVVGSEMMSSVVVDAAATSSSEKKTSWPEVVGMSIKEATETILKDMPNAYIQVLPCWSPVTLDLRPTRVVSSXTPSP

SEQ ID NO: 51581 - DNA, 731 bp, Zea mays
  misc_feature: Ceres CLONE 1466464-F
  misc_feature: Encodes the peptide sequence at SEQ ID NO. 51582
tggagctccccgcggtggcggccgctctagaactagtggatcccccgggctgcaggaattcgcacgagaccattacctagaacatcctaatcgaaaacaaatgggttcatacttcaatggaagttcgaatagattgagtagttctattgggtatcttggttatgactcaggatcgatgttgagttccatgtctaggaattttaatgcaggtgtaaactacccgatcaatcctacaaacatgagtgcttttgctgcccttggaaatgggggtggcgtcaatttatatgggtctcccttctattgcccctgagttgggccagttgggcaacatttcaagccttgggtcagggactttagccgggaagctggagttataactaaagtttacttctggctccttttgcccaccacccatcaactggtacaattgggaaccctttttctgcctccggcatggttttggagggaaccacccaaaaccttggggaacccttttttttgggggcaatccggggggtccccttcctcgaaaggaacggccctttttcccttggcttgggaaatgtgtcccccaatagaaaccacattttccccaattttggggggaatttttttgtaccccacccccccgcagaggggtccccctttgggggggggtttcaccccccctcttttatggcggggggaagaaaaaaacccccttttttgtcgccccccggggttgtttaaaa

SEQ ID NO: 51582 - protein, 102 aa, Zea mays
  misc_feature: Ceres CLONE 1466464-F
GAPRGGGRSRTSGSPGLQEFARDHYLEHPNRKQMGSYFNGSSNRLSSSIGYLGYDSGSMLSSMSRNFNAGVNYPINPTNMSAFAALGNGGGVNLYGSPFYCP

SEQ ID NO: 51583 - DNA, 755 bp, Zea mays
  misc_feature: Ceres CLONE 1466470-F
  misc_feature (326)..(326): n is a, c, t, g, unknown, or other
ctccccgcggtggcggccgctctagaactagtggatcccccgggctgcaggaattcgcacgagaccattacctagaacatcctaatcgaaaaactctttcatttccttctaccgcagcctcagaattcccccctcccccgtagcgaaaccctagccgccacgccaaaaccaaatcccgccgagcccgaaattttccggcgggttccttgccgcgaatcgattgatttcgagcgattcgactcctttgtgatctctcggcggggtagagcgcggtcgaccgtcggccatgtcgaggtgcttcccccctaccgcaccgtggtacgtgncgaacccagtggccgtggccgaaccggagtcgacggctaagggttggtgaacttcggatttacccaccacgtgcccgatcggttgttcaaacgggaggttttgcccgaatcttggttttgccccggcctaaattgggaattgcccctgcccctgagaacctacccaaactggaaaaaggttggggccttggggaacggccaaagggccccccaacgaggtggaaaatttaatggtggggccggggcgcaaaaaggggttaaccggtttttcaaaaagggggaaggggtttccgggggcttttaaaaaggggagaaacacaccccttataaaaggggggttttgttcaaaaaaaaaaaaaaattttttttccccccccccggggggggggcgccgccctcccccccctattggggtataaaccccccccc

SEQ ID NO: 51584 - DNA, 738 bp, Zea mays
  misc_feature: Ceres CLONE 1466479-F
  misc_feature: Encodes the peptide sequence at SEQ ID NO. 51585
  misc_feature (353)..(353): n is a, c, t, g, unknown, or other
  misc_feature (356)..(356): n is a, c, t, g, unknown, or other
  misc_feature (384)..(384): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (424)..(424): n is a, c, t, g, unknown, or other
  misc_feature (450)..(450): n is a, c, t, g, unknown, or other
  misc_feature (469)..(469): n is a, c, t, g, unknown, or other
  misc_feature (474)..(474): n is a, c, t, g, unknown, or other
  misc_feature (477)..(477): n is a, c, t, g, unknown, or other
  misc_feature (486)..(486): n is a, c, t, g, unknown, or other
  misc_feature (511)..(511): n is a, c, t, g, unknown, or other
tggagctccccgcggtggcggccgctctagaactagtggatcccccgggctgcaggaattcgcacgagaccattacctagaacatcctaatcgaaaaaaaaaacgccgcagcggcactgcggtagcagcatcgcgcggcaagctcacctcatccctctttcaccccacctctgcaattgcaagcaaagctccggcctccggatcaggatcacactgaccaccgcgagcgcgtgccggcgtccagtggttacgtcgagggagcctaggctagcgaggaacaagcagccaccagcccgccacgatgctcgtgaggagcgcctccacgccggtccctcgcgcgctgcacccttccnggnctgcactcgcgggcgtctcctccccggncgtgcactttcgcgagtctccggggtcggcnnngctacangcgccggccatttcctgccacctggnccgggcccggtccgggtcnaacanaangctccgcanccccggggccgggcccggatggccnaagtgttcaagaaaaactccggtcttgccgggggcgcgcggaaaacaaaaaccaaacttttccctcccctttggaaagaggcccccagggcgggcgggcgcctcaaaaactctattttgggggcccgtggttccccaaaaaaaaaggagaaaccccccccaaccccccagggggggggggtttttctccccaattttttgtggggcgcaaaaaaagaaccctttttc

SEQ ID NO: 51585 - protein, 78 aa, Zea mays
  misc_feature: Ceres CLONE 1466479-F
  misc_feature (3)..(3): Xaa is any aa, unknown, or other
MAXVFKKNSGLAGGARKTKTKLFPPLWKEAPRAGGRLKNSILGARGSPKKKEKPPPTPQGGGVFLPNFLWGAKKEPFF

SEQ ID NO: 51586 - DNA, 749 bp, Zea mays
  misc_feature: Ceres CLONE 1466481-F
  misc_feature: Encodes the peptide sequence at SEQ ID NO. 51587
  misc_feature (653)..(653): n is a, c, t, g, unknown, or other
ctccccgcggtggcggccgctctagaactagtggatcccccgggctgcaggaattcgcacgagaccattacctagaacatcctaatcgaaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttctgccgcaagaagacggctgtggccgtcgcctacaccaagccggggcgcgtgctgatcaaggtgaacggcgtcccgattgagctcatcaggccggagatgctccgcctcaaggccttcgagcccatcctgctggcggggcgctccaggttctaggacatcgacatgaggatccgcgtcctaggcggcggcaagacgtcgcagatctacgccattcgccaggccgtcgccaaggggctcgtcgcctactaccagaagtacgtcgacgaagccgccaagcatgacgtcgaggtactcttgcaccggtacgaccgcacccttctcgtcgacgaccccatgcgctgcgagcagaagaaagtcggtgtcggcggcgcccgcgccaggtcccagaaatctaccgttgagcgcgtcgctgcccgcgcttgccgtatcnatgcctggggttgccccaccttgccagttcgatgcctgtacccggtgctttatttttccatcgtcggaactactaagggggttcataacctaacgg

SEQ ID NO: 51587 - protein, 66 aa, Zea mays
  misc_feature: Ceres CLONE 1466481-F
MSTVLQRPTPGTVQCFCRKKTAVAVAYTKPGRVLIKVNGVPIELIRPEMLRLKAFEPILLAGRSRF

SEQ ID NO: 51588 - DNA, 764 bp, Zea mays
  misc_feature: Ceres CLONE 1466483-F
  misc_feature: Encodes the peptide sequence at SEQ ID NO. 51589
  misc_feature (339)..(339): n is a, c, t, g, unknown, or other
  misc_feature (453)..(453): n is a, c, t, g, unknown, or other
  misc_feature (454)..(454): n is a, c, t, g, unknown, or other
  misc_feature (459)..(459): n is a, c, t, g, unknown, or other
ctccccgcggtggcggccgctctagaactagtggatcccccgggctgcaggaattcgcacgagaccattacctagaacatcctaatcgaaaattagggaacgtcggagaaagccaagtctcgaacctgtcagcaatccgctgcccaagcctttcaccaacgcctggtcgccgccgatcccaaaaggccgccatctttttcctgaaaaccacgagcagttcactacccatccgccatagtccgaaagttaccaaatcctcctgcgaggccccagcaccgaatgccccagcacaacaaggcggcatcgtttgagaggaagcggctagaggacctgctgccnggctagatgacggaagtggcgggacgccccgggacgtcgggcggcctggcgctgcgggcgggccagttcgtcttcgccgccgcgtccatctgcgccatggcctccgcgcccggnntcacnaactacacagccttctgctacttgttggcacctatgggactaccagccctatggaactaaaggcttgaatgtcttgattgccatgccctgacattgaaaaaaagacttccacaaactcttccacaggaattatttgtttttgggaattgggaaaaaaaatttctttcctttgcgcggcagggccaactgcgagggaaattggctttttaaaagggatggctatttgggaaaagggactcccaccccctttggaaaaaaaacaaggggcgcggattaaaatttttttggagaaattataggccccc

SEQ ID NO: 51589 - protein, 57 aa, Zea mays
  misc_feature: Ceres CLONE 1466483-F
  misc_feature (37)..(37): Xaa is any aa, unknown, or other
MTEVAGRPGTSGGLALRAGQFVFAAASICAMASAPGXTNYTAFCYLLAPMGLPALWN

SEQ ID NO: 51590 - DNA, 778 bp, Zea mays
  misc_feature: Ceres CLONE 1466489-F
  misc_feature: Encodes the peptide sequence at SEQ ID NO. 51591
  misc_feature (580)..(580): n is a, c, t, g, unknown, or other
  misc_feature (778)..(778): n is a, c, t, g, unknown, or other
aaagctggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagttgcgtgccatggcatgctctgagtctgagatgatgatgatggctgatggcggcgtccntgtcctcccctggcctcctggggcgcttctggcgagcagtgtgttgtgttgtgtgggtgccgcacgctagcaggctagccatgtgccctggctgtgttgtgtcaccatccatctataatcttatccataccccaaaaaaaaaaaaaaaaaagcttatcgataccgtcgacctcgagggggggcccggtaccccattcn

SEQ ID NO: 51591 - protein, 82 aa, Zea mays; identical to SEQ ID NO: 43085
  misc_feature: Ceres CLONE 1466489-F
  misc_feature (1)..(80): Pfam Name: Metallothio_2 Pfam Description: Metallothionein

SEQ ID NO: 51592 - DNA, 771 bp, Zea mays
  misc_feature: Ceres CLONE 1466490-F
  misc_feature: Encodes the peptide sequence at SEQ ID NO. 51593
  misc_feature (473)..(473): n is a, c, t, g, unknown, or other
aaagctggagctccccgcggtggcggccgctctagaactagtggatcccccgggctgcaggaattcgcacgagaccattacctagaacatcctaatcgaaaaatccatcaatcctcatcgccacccaacccgccgagtccccaagcaagttgagcatccatccatccatggcgggaggcaagtccaccggcaatgccgcgcgcagcaggaagcgcgtcgaggcaaccgtcctcaagcgctccagggacgggagcgccttcaccagatgcgaggcctgcaacaaggatgtccccgtcgtcctcatcgacatgcacagctgcagcctcgacgagaagatcaggatgacgctcgaggcgcaggtcgtcgagaagaccgtcgaagtcgcccagtgcgaccgcaagaagtcctccgcccagggaggtggtaacaaggacggccagcgcaagcgctcgcccaacgccttcttcttcttnatggacaacttcgggaggaattccaggccacccatcttgaaacacaaagtgtcccccccctttcaaaggaaggagggaaaagtggaattcccttgccaaaccaagaaaaaaacccttattttaaaaagccccgaatctcagggtaaagccaaaaagggggggggcgggggataaaacaatgttcccccttaaaacccaaaaaaaataccccgggggggaacccccccccaaaaacccccaaagggggggggttctccccaaaaaaaaagaataaattgtgccacaaaaaaaaaaaaaa

SEQ ID NO: 51593 - protein, 159 aa, Zea mays
  misc_feature: Ceres CLONE 1466490-F
  misc_feature (102)..(102): Xaa is any aa, unknown, or other
MAGGKSTGNAARSRKRVEATVLKRSRDGSAFTRCEACNKDVPVVLIDMHSCSLDEKIRMTLEAQVVEKTVEVAQCDRKKSSAQGGGNKDGQRKRSPNAFFFXMDNFGRNSRPPILKHKVSPPFQRKEGKVEFPCQTKKKTLILKSPESQGKAKKGGGGG

SEQ ID NO: 51594 - DNA, 805 bp, Zea mays
  misc_feature: Ceres CLONE 1466494-F
  misc_feature: Encodes the peptide sequence at SEQ ID NO. 51595
aaagctggagctccccgcggtggcggccgctctataactagtggatcccccgggctgcaggaattcgcacgagaccattacctagaacatcctaatcgaaaaagttccgctcttcgtctttgggggccattgcccgtgcgtcacccgagcccgtgcccggaatctttgtagaagcgtctggaggactcccacccggctgccagccatggctgagaatctggcgcccgagaagcgccactccttcgtgcacaacgggcagaaggtgttcgagtgggaccagacgctggaggaggtcaacatgtacatcgagctcccgaagggtgtgccaaccaagctatttcactgcaacatccaggctagccacgttgaggtcggcatccgcggcaacccgccataccctcaccatgaccccaccacaccagtgaagactgactcgtcgttctggacaatagaagatggtgagatgcatatcccactgcaaaaaaaagagaaggggaaaacgtggtcatctccaaacaagggcaagggaattttggatcctatggctgaaaaaccaaaccaaaaccggctttagcctccaaaggtttaaggaaaaaaaccctgggttccaatttttccggggctcttttaggggaacctggccccgaccacaaaacctttggggggggggaacccctccaagggaacaccccccccgcggggtggggtttctaaaatatccccccgtttttgaaaaaaaacccagggccccttttattttgttaaaaaaccggtggggggcgtttaagaaaaataattcccaaaa

SEQ ID NO: 51595 - protein, 122 aa, Zea mays
  misc_feature: Ceres CLONE 1466494-F
  misc_feature (19)..(93): Pfam Name: CS Pfam Description: CS domain
MAENLAPEKRHSFVHNGQKVFEWDQTLEEVNMYIELPKGVPTKLFHCNIQASHVEVGIRGNPPYPHHDPTTPVKTDSSFWTIEDGEMHIPLQKKEKGKTWSSPNKGKGILDPMAEKPNQNRL

SEQ ID NO: 51596 - DNA, 742 bp, Zea mays
  misc_feature: Ceres CLONE 1466500-F
  misc_feature: Encodes the peptide sequence at SEQ ID NO. 51597
  misc_feature (435)..(435): n is a, c, t, g, unknown, or other
  misc_feature (464)..(464): n is a, c, t, g, unknown, or other
  misc_feature (614)..(614): n is a, c, t, g, unknown, or other
ggagctccccgcggtggcggccgctctagaactagtggatcccccgggctgcaggaattcgcacgagaccattacctagaacatcctaatcgaaaaaattggcacttccgtaccccgaccccggccaccgtgtggaaacagaaacagcaatggcggggaggctggtgccgagcacgaagaaggcgatggagcaccgggaggagaagcccaaggtgccgtcgagcgacccgggctccgaccccgacctggtgcagctggtggccgggcagcagccgcccaacatctcggagatgaagccgctgacgcgggaggcgtacggcggcgggatgtacgcggccgaggaggagggcggccggcggaggggccccgcgcggccgcgcgcgagcgccacgcagagcgccgacgggcccgaggagcatcgcgctggcgcgaggnccatccacccgccgccgccgtccaccggngaccgcgacctcgacatcaccggccagtcctacatccagtagccgcatgtgccggctgaccagcgccgcgcttgggcgttggccattggcgttgtgtgtgtgtaccccgtacagtaccgtaagaacttgctagtatacttgggtgtgganttgccaaagtgtccttgtcccgtcccttggttaaatgggtccgacttcctagttgccaacaataagggttggactcggcctttccaaaaaaaaaaaaaactcctttcggtcccgccccccccgggggg

SEQ ID NO: 51597 - protein, 118 aa, Zea mays
  misc_feature: Ceres CLONE 1466500-F
  misc_feature (96)..(96): Xaa is any aa, unknown, or other
MAGRLVPSTKKAMEHREEKPKVPSSDPGSDPDLVQLVAGQQPPNISEMKPLTREAYGGGMYAAEEEGGRRRGPARPRASATQSADGPEEHRAGARXIHPPPPSTGDRDLDITGQSYIQ

SEQ ID NO: 51598 - DNA, 761 bp, Zea mays
  misc_feature: Ceres CLONE 1466506-F
  misc_feature: Encodes the peptide sequence at SEQ ID NO. 51599
  misc_feature (443)..(443): n is a, c, t, g, unknown, or other
aaagctggagctccccgcggtggcggccgctctataactagtggatcccccgggctgcaggaattcgcacgagaccattacctagaacatcctaatcgaaaagctgctagctagtgctacctttcaaaaaacccctacatcctgccatccatccgcggtccgccgccgccgccatctcctcccactctcttccccccactcctaccaaaccctattcaatatccatttctccatccatggcgtggcgcggccccgccacccgggccgtcctcgccgccgtccgccgcccggcagcggccgcgcgcctccacgccccgcgccgccgcgtcccgcctgccttcgccaccacctcctcccggctccgtccgcgcggcctctggcggcgttgatgggcccccggtgacggcgccccccgcgaagggggcgctcacggaaatcccgtncccaaccccccccctgcttcaatctttcccagggaaacggaaaaaatggttatgaagaaaagccttctaaaacccgccaaaggactaagacctttggtcaaccccccctttccaaagagaaaaaaaggtttttttggggaaaaaaacctttattggtttttcccccccaaaagctcaaaaaaaatccccaccaaaccatttccccctttgtgtttaaaaaaccttaatttttaaaccccccgggggggtttccgggctaaaacactttataaaaaaattttaggggggttccccaaaataataattctctcaccactg

SEQ ID NO: 51599 - protein, 62 aa, Zea mays
  misc_feature: Ceres CLONE 1466506-F
MVMKKSLLKPAKGLRPLVNPPFPKRKKGFFGEKNLYWFFPPKSSKKIPTKPFPPLCLKNLNF

SEQ ID NO: 51600 - DNA, 742 bp, Zea mays
  misc_feature: Ceres CLONE 1466508-F
  misc_feature: Encodes the peptide sequence at SEQ ID NO. 51601
ggagctccccgcggtggcggccgctctttactagtggatcccccgggctgcaggaattcgcacgagaccattacctagaacatcctaatcgaaaagagggagcggggataagcgagggaggagggggaaaccgaacatgctcctgctgcgcggcgccagggcggcgtcggcttgggcggcatccaccgcggtgtccgcaggcgccagcagcagcaggtccatatccattcggctggcccccgtcgccgcattgtcctcgggcggaaggaagaggaagggccagcggcggggctaggccaagcccccgagcccgccgccgccgccgcccctgcctcggcagggctagacccctagcagcaagaagaagtccggcgcgaggccgtcgggcgagggaaacaagacccacttggtggagctggaataagcgcgcggcccgcggaggccggagggcggcgaggcgaggaaggggaatacgcatcagcaccagcatcatgaggagaaggccaatgcgaaaaggctggtgaagtggaagtgcgctagcgggtgcgttgcgtgttgcatgctagacaaggggcccgacttccctattcccgacgagatcttcgccgaccatcccgatgacctccagctgtacaggagtatgatcggctctgatggatggtgcattaactacgacaaggccacccgcacctgcaacatctaccaagaccgaccttccttctgcaggatggaaccaaagatt

SEQ ID NO: 51601 - protein, 61 aa, Zea mays
  misc_feature: Ceres CLONE 1466508-F
MLDKGPDFPIPDEIFADHPDDLQLYRSMIGSDGWCINYDKATRTCNIYQDRPSFCRMEPKI

SEQ ID NO: 51602 - DNA, 831 bp, Zea mays
  misc_feature: Ceres CLONE 1466509-F
  misc_feature: Encodes the peptide sequence at SEQ ID NO. 51603
  misc_feature (383)..(383): n is a, c, t, g, unknown, or other
  misc_feature (494)..(494): n is a, c, t, g, unknown, or other
aagctggagctccccgcggtggcggccgctctagaactagtggatcccccgggctgcaggaattcgcacgagaccattacctagaacatcctaatcgaaaagtattaggacagaagtcgattctttaagaccagcatctggagctgctccaaatgcagccctaattttccggcgctacttccaaatagtcgccctctcaacttttgttgggtccgtctgtggattgtccccggcctcctttccgtcgcgtccaaatcatcctcataccccgcagcatctccacgccgccacacctcgtcgcgtcgcgtcgtctccgccgagaagatggtcggacccagcctctacaccgagatcggcaagaagacccaggatctgctgtacanggactaccagacagaccacaagtttcaccctcactacctacagctccaaatggcgtccctgtcccctgctactagcacaaaggaaagctgacctgatcttcccggggaatncattccccagataaagaacaaaaacgtggccctaaaattggaaagccaaccccagagccaaaattcctttccacccgtttccgtggcaaggaatttggcacccccgggagggaaaacatctctttaattttttttgttccccgaaacaaaattgtggaagagggggcccccccctttttcgaaagaaatcgcgggaaaaaaaagcaccgggtttttttaaaaaacatcctggggaaacccccccctgttttttttttaaaaaaaacccccccgggggggaaaaaattattttttttttggccgggggggatacccaaaaaaaagggggggtgtgtcc

SEQ ID NO: 51603 - protein, 49 aa, Zea mays
  misc_feature: Ceres CLONE 1466509-F
  misc_feature (20)..(20): Xaa is any aa, unknown, or other
MVGPSLYTEIGKKTQDLLYXDYQTDHKFHPHYLQLQMASLSPATSTKES

SEQ ID NO: 51604 - DNA, 734 bp, Zea mays
  misc_feature: Ceres CLONE 1466513-F
  misc_feature: Encodes the peptide sequence at SEQ ID NO. 51605
aaagctggagctccccgcggtggcggccgctctagaactagtggatcccccgggctgcaggaattcgcacgagaccattacctagaacatcctaatcgaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcct

SEQ ID NO: 51605 - protein, 179 aa, Zea mays
  misc_feature: Ceres CLONE 1466513-F
  misc_feature (64)..(179): Pfam Name: Thi4 Pfam Description: Thi4 family
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLL

SEQ ID NO: 51606 - DNA, 765 bp, Zea mays
  misc_feature: Ceres CLONE 1466523-F
  misc_feature: Encodes the peptide sequence at SEQ ID NO. 51607
  misc_feature (690)..(690): n is a, c, t, g, unknown, or other
  misc_feature (691)..(691): n is a, c, t, g, unknown, or other
aaagctggagctccccgcggtggcggccgctctagaactagtggatcccccgggctgcaggaattcgcacgagaccattacctagaacatcctaatcgaaaagcaactcgcaacacagacgccgccgcccaaagaaagacgtcaactccaggagacaagatagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcacatctgtcagctatggaaacgttggccatgcttctcaagtaatgaaataattccgttgtcacctcatgctacatacagcagattggtgttatgagttaaatcctgtgaaactttagcattctgtaaccgtggatgagtttatggagttccttgtgtggcgcctcannatcagttctcgtcaaagattgtaatctgatggcttcccatgtgacacttgtaggcggctgcaataaacttactt

SEQ ID NO: 51607 - protein, 112 aa, Zea mays; identical to SEQ ID NO: 51410
  misc_feature: Ceres CLONE 1466523-F
  misc_feature (11)..(109): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase

SEQ ID NO: 51608 - DNA, 767 bp, Zea mays
  misc_feature: Ceres CLONE 1466526-F
  misc_feature: Encodes the peptide sequence at SEQ ID NO. 51609
aaagctggagctccccgcggtggcggccgctctagaactagtggatcccccgggctgcaggaattcgcacgagaccattacctagaacatcctaatcgaaaaactgtacaacatccgatccgaaacctagcaacacccccggacagacgggcgcgaactcaaaccctagaaacggtagccatggattcgggaggcggaggagggagcggcgcgcacaaggcggcctcgggctccgcgccctcgccggcgcctaaccccacggcgatgctttcggcgctcatgagcaagcgcgccaagctccaggaggagctccgctccatcgagcgccaggtttatgatatggagaccacctacctacaggagactaatcaatttggaagtgtgctgaaagggtttcgaatcttttttgtcatccctcaaaaacacctctaacccttagcgctcctcgaaatttcaggctgacgagaaggttattctccctgtcatccgttactcctccaggcggtttgatgacattttgctggaccaaatgatggaaaaaagtttggagccgtctttcttaggggggaagcccccctggaacggggaaaggaaaccaaaaaagggagggccccctggggggaaaaacggaaaaaaatcccccctcaagacccccaaccgggaaaaaaaaaaaccaacaacccccccccaaacgccgggggggggtgtaactttttttgccccacccccagagttcaaaaagcccccccccgcgtttgggggggagc

SEQ ID NO: 51609 - protein, 83 aa, Zea mays
  misc_feature: Ceres CLONE 1466526-F
  misc_feature (25)..(77): Pfam Name: NuA4 Pfam Description: Histone acetyltransferase subunit NuA4
MDSGGGGGSGAHKAASGSAPSPAPNPTAMLSALMSKRAKLQEELRSIERQVYDMETTYLQETNQFGSVLKGFRIFFVIPQKHL

SEQ ID NO: 51610 - DNA, 815 bp, Zea mays
  misc_feature: Ceres CLONE 1466542-F
  misc_feature: Encodes the peptide sequence at SEQ ID NO. 51611
  misc_feature (419)..(419): n is a, c, t, g, unknown, or other
  misc_feature (595)..(595): n is a, c, t, g, unknown, or other
aaagctggagctccccgcggtggcggccgctctataactagtggatcccccgggctgcaggaattcgcacgagaccattacctagaacatcctaatcgaaaaaccgcagccctagcgcgccgccaccttcaccttcgcagccctagccgccgccgccgcctccattgctgctatacccgcaaccatgggtcccgtgctgaagcgcccgaccccgggcacagtgcagtgtttcgggcgcaagaagacggccgtggccgtggcctacacgaagccaggccgagggatgatcaaggtgaacggcgtcccgatcgagctgctccgtcccgagatgctgcggctcaaggccatggagcccgtgctgctggaggggaggtccaagttaaaggacatcaacacgcggatcctcgttgccccccccngggaagagggcgtagatctacgccaatcggccaggcccgtcgccaagggtcccgggggaatactacaaaaaggtacgatccaccaaggcgggcgaaaaaaggagatcaagggaaattttctgtggggctagcgaggagtaaccttccctcggtcgccgaaccccccggcggttggnaaggcccaaaaaaaatcggcgaggccgaagggcgcccggcgccaagggttccagaagatcctaacaggttgaggggccaagcgcccgggcgggacccgccggggcgggggctcccgctttaggaaaccgactctttaagaaaactccagataaatagacacgggtgggcgaaattcaatagggcctcgcaccagggttataaatccaatacaaacgtctg

SEQ ID NO: 51611 - protein, 121 aa, Zea mays
  misc_feature: Ceres CLONE 1466542-F
  misc_feature (17)..(122): Pfam Name: Ribosomal_S9 Pfam Description: Ribosomal protein S9/S16
  misc_feature (79)..(79): Xaa is any aa, unknown, or other
MGPVLKRPTPGTVQCFGRKKTAVAVAYTKPGRGMIKVNGVPIELLRPEMLRLKAMEPVLLEGRSKLKDINTRILVAPPXEEGVDLRQSARPVAKGPGGILQKGTIHQGGRKKEIKGNFLWG

SEQ ID NO: 51612 - DNA, 783 bp, Zea mays
  misc_feature: Ceres CLONE 1466554-F
  misc_feature: Encodes the peptide sequence at SEQ ID NO. 51613
  misc_feature (345)..(345): n is a, c, t, g, unknown, or other
  misc_feature (396)..(396): n is a, c, t, g, unknown, or other
  misc_feature (399)..(399): n is a, c, t, g, unknown, or other
  misc_feature (403)..(403): n is a, c, t, g, unknown, or other
ctggagctccccgcggtggcggccgctctagaactagtggatcccccgggctgcaggaattcgcacgagaccattacctagaacatcctaatcgaaaaaaaaaatcactcgtcccatttctcgcgtccccaggccacggtcgcgagcaaggctaccccactgtctcgatccaccgatttccctccctcttctgtgcctccacggatcttctcgttgtggaagcggaggcggacgctggaggcgtctcggcgcgaggatttgcgagctgctgcggtggtgggaaatgaggatctgcgaatcgggagaacgtgacgacgttgcgggcctggtgttttcagcagagcnagcaggagaagtccaggcgagcggcaagctcgtacggctaaaggcaaacangcnctcntcggggccgggccgaagggggttgttctacccgacgctggtttaaaaaggtttgggcaaacgggttcaaagggaaactccgggggggggaatccccccaaccatttattttgggggggccctttcctttcccaagggatttcccccgttaaaaccccttggaaataaaggggggttaacccttaaaaaaccctaaaaaaccctttgcccccctttttttacccggtttaggagagatggcccgggattatcaaaaaaaaaaaacccccccccccctctgcggggaattttctccaaatattttttctcccgaaaagacaagggggggttattttttttttttttggagagaaagaaaacccccccttttttgttttttgt

SEQ ID NO: 51613 - protein, 54 aa, Zea mays
  misc_feature: Ceres CLONE 1466554-F
  misc_feature (21)..(21): Xaa is any aa, unknown, or other
  misc_feature (38)..(38): Xaa is any aa, unknown, or other
  misc_feature (39)..(39): Xaa is any aa, unknown, or other
MRICESGERDDVAGLVFSAEXAGEVQASGKLVRLKANXXSSGPGRRGLFYPTLV

SEQ ID NO: 51614 - DNA, 749 bp, Zea mays
  misc_feature: Ceres CLONE 1466559-F
  misc_feature: Translation starting site: 178
  misc_feature: SWISSPROT Homolog: EC 3.2.1.23 Beta-galactosidase
ggagctccccgcggtggcggccgctctagatctagtggatcccccgggctgcaggaattcgcacgagaccattacctagaacatcctaatcgaaaaacttcgcccatccacttcgcccatccgcaccgcgcgtgtgcacaacgtcgccggaaccggagaagtgagggggagctggagatggacaaggacaataggctccgcgcccgagcgggggagaaggcgtccaagagcaggagccacgggtccacggcgctgttcgtcgcggtagactacgccttcctgctcgccttcgccggcttcctcgcctacctcgtcgggtcgcggatcctcccctccgccgtcagcttcgtctagaccggcccgcgttcgtggatctctctcttttttccttccactttttttttgttgttgccccttgcttggagccaatggtggcgagagaaccgagatcttgccggccgggtggttctcgtttcgatctgattgccgctcatgcgatgtaatccgaccgcattttgacgagaagagaactagcggtgcttcttggcagttcgcttggtaatgagacaaatctttgcctgttcagttgccaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttg

SEQ ID NO: 51615 - DNA, 742 bp, Zea mays
  misc_feature: Ceres CLONE 1466563-F
  misc_feature: Encodes the peptide sequence at SEQ ID NO. 51616
  misc_feature (371)..(371): n is a, c, t, g, unknown, or other
  misc_feature (373)..(373): n is a, c, t, g, unknown, or other
  misc_feature (422)..(422): n is a, c, t, g, unknown, or other
  misc_feature (467)..(467): n is a, c, t, g, unknown, or other
  misc_feature (481)..(481): n is a, c, t, g, unknown, or other
  misc_feature (498)..(498): n is a, c, t, g, unknown, or other
  misc_feature (518)..(518): n is a, c, t, g, unknown, or other
  misc_feature (538)..(538): n is a, c, t, g, unknown, or other
  misc_feature (543)..(543): n is a, c, t, g, unknown, or other
  misc_feature (544)..(544): n is a, c, t, g, unknown, or other
  misc_feature (555)..(555): n is a, c, t, g, unknown, or other
  misc_feature (567)..(567): n is a, c, t, g, unknown, or other
  misc_feature (576)..(576): n is a, c, t, g, unknown, or other
  misc_feature (577)..(577): n is a, c, t, g, unknown, or other
  misc_feature (590)..(590): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (638)..(638): n is a, c, t, g, unknown, or other
  misc_feature (659)..(659): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (708)..(708): n is a, c, t, g, unknown, or other
  misc_feature (726)..(726): n is a, c, t, g, unknown, or other
  misc_feature (727)..(727): n is a, c, t, g, unknown, or other
aagctggagctccccgcggtggcggccgctctagaactagtggatcccccgggctgcaggaattcgcacgagaccattacctagaacatcctaatcaaaaaataaaataaaaccttgacaagaacgaattctcctccggctctcctcttctcgagcgttttcggcaccacggagcagtaggatggcggcggctgccccaacgagagcagaggtgctgtcgctcttcctttccttacaccgaacggcgaagaatttcgcggactccaacatccgcgagtacacacgccgacccgccgcggactccttccgcgaaaaccgcgccctcgccgatgcgtatgtcgccgccgcggcgttctcgggggggaggaggnanctacaggttgcgaagcggcaagcggtggtttactctccccccccccccnaagccaaaagcgtgatggatttaaaggggcactgatggctgcaanattttcattcccancattcccgttccagatncatggctttaatgagatgangaaacaatacagtgctccgnaggannactcccacggngatggtcacganaaagttccnntctgggccagtanattattaaattttnnnngctacctacaccaccgaaggtggctgnnngntacctttctaactcaaggggnggaaccggnnncccattccccacagtggggaataaagaaacaaaaggcntagttctcgcgcccgttnnccccgcccacccctg

SEQ ID NO: 51616 - protein, 91 aa, Zea mays
  misc_feature: Ceres CLONE 1466563-F
  misc_feature (6)..(70): Pfam Name: Complex1_LYR Pfam Description: Complex 1 protein (LYR family)
  misc_feature (64)..(64): Xaa is any aa, unknown, or other
  misc_feature (81)..(81): Xaa is any aa, unknown, or other
MAAAAPTRAEVLSLFLSLHRTAKNFADSNIREYTRRPAADSFRENRALADAYVAAAAFSGGRRXLQVAKRQAVVYSPPPPXAKSVMDLKGH

SEQ ID NO: 51617 - DNA, 767 bp, Zea mays
  misc_feature: Ceres CLONE 1466564-F
  misc_feature (333)..(333): n is a, c, t, g, unknown, or other
  misc_feature (614)..(614): n is a, c, t, g, unknown, or other
ggagctccccgcggtggcggccgctctagaactagtggatcccccgggctgcaggaattcgcacgagaccattacctagaacatcctaatcgaaaagcacccgcgaagacgcggagcctccactccccgtctcgcttcctcctctggatctagccgacgccgccctcaccctgtcacccaccgacgtcgccgtcgccgtcgccgtcgccacctatatcacccaccgcctctgaagaagaagacgcggatccgagggtagttaactgctgaggaagaagagccggtacggagaagacgcgaagcagtacgtctccgatctgggatgtggtaggntcatcctgatttgacgggcagctcactgatacgagttcctgggaggagaagctagacaattctgttcccgaggaagaggaggatgtgaactcttctaagacttgcccctgcctttcccccggcctggcggaaaagaaagagcccttttccttcgggtgtaaaccgggcaattttaccaaaacggccccaaaacaagttgccggcccatgggggcaggaaaacatgggtggggaaatgtggaaaacagggtttggaaatccacccccccccctttttttccntttttaaggggggaaaaagggaaaaaaaccccggcgggggtttggggaaatttttgggcacccaaaaaacccacccaatttttttgggtttttttttaaaaaaaacgggaaaaaacctctccgggggggggcccccaagaagaaaaaagaaaa

SEQ ID NO: 51618 - DNA, 741 bp, Zea mays
  misc_feature: Ceres CLONE 1466569-F
  misc_feature: Encodes the peptide sequence at SEQ ID NO. 51619
ctggagctccccgcggtggcggccgctctagaactagtggatcccccgggctgcaggaattcgcacgagaccattacctagaacatcctaatcgaaaaaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcaggcggtgggcggcgggcagtgcccggccctggggtgcgcggcggacctcaacgccgggtgcccgccctcgcagcgcgtgccgggcgtccgggggcggcgtggtggcgtgcaagggccccgcgggctacttcaagaagcggtgcccgctgacgcgcaccacgcccaccgacgtggagcccgtgccgcaacggtgcttggcgcccggcgagctcaaggtcgtcttctgccag

SEQ ID NO: 51619 - protein, 212 aa, Zea mays
  misc_feature: Ceres CLONE 1466569-F
  misc_feature (34)..(212): Pfam Name: Thaumatin Pfam Description: Thaumatin family
MAGTAKTPVLGFLLALALVATSTPAAATTLTLHNLCPYPVWPLVSPNTGFPAISENTGRLDGGGRGLVSFRFPDSFWAGRVVARTGCSSGHSRCETGSAAPATVVQLVVHAEGQDLASYSVSLVDGFNVPAVVSPQAVGGGQCPALGCAADLNAGCPPSQRVPGVRGRRGGVQGPRGLLQEAVPADAHHAHRRGARAATVLGARRAQGRLLP

SEQ ID NO: 51620 - DNA, 765 bp, Zea mays
  misc_feature: Ceres CLONE 1466572-F
  misc_feature: Encodes the peptide sequence at SEQ ID NO. 51621
  misc_feature (621)..(621): n is a, c, t, g, unknown, or other
tggagctccccgcggtggcggccgctctagaactagtggatcccccgggctgcaggaattcgcacgagaccattacctagaacatcctaatcgaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaagtcccgcggcttcggcttcgtcaccttctccacggaggaggcgatgcggaacgccatcgaggggatgaacggccccgagctgggacggcccgcaacttcaccgtcaacgaggccccagtccccccgccgcccttgaagcccccgccgggggttaccggggggggccggtgaagccggcgggttacggggggggcggcgccccttatggcgggggcggttaacggggtggggggggttacgggggggggggggtcccggggggggggcgggggccaacgggggggnaaccgtggggggggtttcggccccccccccggaaattggaaaaattaggggggggcgcccccgccaaaatttttggttccccccggggtgttccccccccccaggggttttttctccccgggcgggtgtggtggcccccctttt

SEQ ID NO: 51621 - protein, 91 aa, Zea mays
  misc_feature: Ceres CLONE 1466572-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQKSRGFGFVTFSTEEAMRNAIEGMNGPELGRPATSPSTRPQSPRRP

SEQ ID NO: 51622 - DNA, 728 bp, Zea mays
  misc_feature: Ceres CLONE 1466574-F
  misc_feature: Encodes the peptide sequence at SEQ ID NO. 51623
  misc_feature (535)..(535): n is a, c, t, g, unknown, or other
tggagctccccgcggtggcggccgctctagaactagtggatcccccgggctgcaggaattcgcacgagaccattacctagaacatcctaatcgaaaactccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctccaaaatatgattcgtctggtctggcgcgcgtgagtccagctcgtgtgtcgtgtgtgtctctgtgtgaggtgtctgcgggcgtgtgtgtatgtatggagtccgccgcgacagcngctgccgaagaagtgtgcgcatggtgggtggtacttgcttcgacgcgccactgtttggcgcggcgataatgtactaccctgctgcgttttctggttatcactgggatgatttattttgaaaaaaaaaaaaaaaaagtttaccgataccgctcaaacctcgaggggaggccgggaacccaattcgccctattgt

SEQ ID NO: 51623 - protein, 57 aa, Zea mays; identical to SEQ ID NO: 43282
  misc_feature: Ceres CLONE 1466574-F

SEQ ID NO: 51624 - DNA, 746 bp, Zea mays
  misc_feature: Ceres CLONE 1466576-F
  misc_feature (354)..(354): n is a, c, t, g, unknown, or other
  misc_feature (691)..(691): n is a, c, t, g, unknown, or other
aagctggagctccccgcggtggcggccgctctagaactagtggatcccccgggctgcaggaattcgcacgagaccattacctacaacatcctaatcgaaaacttctagctgtaaaggaaaggaaggcaaaggacgggaatgcatttgctcgtgaaatgctcgacgaacggacaaagaaggctgaagcatggcaccacaaagctgccagtcgtgtggcgtattccaaaccagccgatccgatcacctgtgcaacatttgctcaggatgtcattgaagggagagcgagcgtttcacaggcccacgagcacaaacaccagcccctgatatttggacctgcaagcctttgtggcggcngtctgaccagtgaaagggaagaatggcagcgcaagtttttcaaccccagtacaggatgcaaacatgaccaaaaaaaagctggcttgcccaaatgaaaatgatggaaagtgcaaaaaggaccccccaaatgagaaaaaacaaacccccgggcccaaggtaccccaccccattcccaaaaggggaaggggaaaaaaccccaaaaggccagggccagcgggggaaatggaagacaaaccctccggggggggaaaaaaaaacccccccgggggtaaatgaaaaaaaaaacccccgtgtggaaaccggggggtttgccccccttttttttttttccccagcnccgggtttttttaagggcgcgcccaaaaaggggtgttccccccccgccccccccc

SEQ ID NO: 51625 - DNA, 767 bp, Zea mays
  misc_feature: Ceres CLONE 1466580-F
  misc_feature: Encodes the peptide sequence at SEQ ID NO. 51626
ctggagctccccgcggtggcggccgctctagaactagtggatcccccgggctgcaggaattcgcacgagaccattacctagaacatcctaatcgaaaatctgttgtggctggtttccagtgggcatcaaaggagggtgcactggctgaggagaacatgcgtggaatttgctttgaggtctgtgatgtcgttcttcatgctgatgctatccacaggggtggtggtcaggtcattcccactgccaggagggtcatctatgcctctcagctcacggccaagccaaggctgctggagccagtctacctggtggagatccaggccccagaaaatgcacttggtggtatctacggtgttctgaaccagaagagaggtcatgtctttgaggagatgcagaagccgggtaccccgctccacaccatcaaggctttcctcctgtcatcgagtcctttggtttctccagccaactgaaggccgcaccctccggtcaggcgttcccccgggtggccttaaccttgggaaatgaggggtcaaaacctttggaggccggccccaggttggcaagtgggggcggaaatccccaaaaggaggggcccaagaaacgaagaccccccctttttagatgttaggacacccccaaaaatttttggggggggggagaacggttccccccccggttaaaccccaatccccccccggggaaaacgcgcccccccaaattttttttttgtgtttattgccaaagccccccttttattaaaaaaattttgg

SEQ ID NO: 51626 - protein, 154 aa, Zea mays
  misc_feature: Ceres CLONE 1466580-F
  misc_feature (3)..(92): Pfam Name: EFG_IV Pfam Description: Elongation factor G, domain IV
  misc_feature (94)..(155): Pfam Name: EFG_C Pfam Description: Elongation factor G C-terminus
GAPRGGGRSRTSGSPGLQEFARDHYLEHPNRKSVVAGFQWASKEGALAEENMRGICFEVCDVVLHADAIHRGGGQVIPTARRVIYASQLTAKPRLLEPVYLVEIQAPENALGGIYGVLNQKRGHVFEEMQKPGTPLHTIKAFLLSSSPLVSPAN

SEQ ID NO: 51627 - DNA, 774 bp, Zea mays
  misc_feature: Ceres CLONE 1466591-F
  misc_feature: Encodes the peptide sequence at SEQ ID NO. 51628
  misc_feature (376)..(376): n is a, c, t, g, unknown, or other
  misc_feature (399)..(399): n is a, c, t, g, unknown, or other
agagctggagctcaccgcggtggcggccgctctagaactagtggatcccccgggctgcaggaattcgcacgagaccattacctagaacatcctaatcgaaaaaggcttctagggttttcgcgccgccgccgccgccgcttcgtcgtctccgccgcagcgatgccgtcgcacaagaccttccggatcaagaagaagctggcgaagaagatgcgccagaaccgccccatcccctactggatccgcatgcgcacggacaacaccatcaggtacaacgccaagcgcaggcactggcgccgcaccaagctcggcttctgagcgcgcggatcggccggctcctgcgtcggaattctagggtctctacctttcctttggtttnaacgatggggcgtgtgtttctcnaacctaacaaacaccccccccacgcttttggtaagattttgatgacgctaagaggattgatgctaccatgctgaactcaggattccatggtgattgggatgctaaattcaagaacctctgttaaacacgcagggacaaaacagacaaaaaccttatccatacccgcaacctcgagggggggcccgtgacccacttccccctcaagggagtcgggttccgcggccccgcgggcctctgcttttacgacgccctgactgggaaaccccctgactttcacccacttgaacgccttgaccggactaccccccttcccgccacggggcgctggtggccagagagcgcctgctcccatctctccctcctccacctgagcgc

SEQ ID NO: 51628 - protein, 51 aa, Zea mays; identical to SEQ ID NO: 2355
  misc_feature: Ceres CLONE 1466591-F
  misc_feature (9)..(51): Pfam Name: Ribosomal_L39 Pfam Description: Ribosomal L39 protein

SEQ ID NO: 51629 - DNA, 779 bp, Zea mays
  misc_feature: Ceres CLONE 1466592-F
  misc_feature: Encodes the peptide sequence at SEQ ID NO. 51630
  misc_feature (376)..(376): n is a, c, t, g, unknown, or other
aaagctggagctccccgcggtggcggccgctctagaactagtggatcccccgggctgcaggaattcgcacgagaccattacctagaacatcctaatcgaaaaaaagctggcccccagatcaatggaagggacggggagcccttcggcagctcaagccctggttctcgccgccttgatcctcatctgttcctgcgtcaccgctcgtccggaacaggacctcaaccgaatctatcgaagtgccggcgaactcctcgaggacgaccccttccgatcactatccgggcacgcgacttagttctctcccaagtaccacacgaacgtgttcgcgaatgactcgcactagcctgagcagatgttcgccccggagatctttttncaccccttcctgctgcccaacgcggttaagaaccttcccccccaccagaagcacttgttctacgcccccgactaccccaagtgcatccactctacgagggaccatcccctcaccgtcaagacccgcgaatgattagaccccttttttgttcttatcacactggtgcctatttgaactcgacggagggtcccgaacattacttgcaaatccccctaaactttaaacggccttcaaagtaccaaaaagacgggcctctccctaattggttcccccaaatgctccaccggtactaacgggagttcactatctactggctagtataaccccctttcagccacgggtgttaagctttcattaaccgtccgactaaatctggtttccctttttaaaagaataagaaaag

SEQ ID NO: 51630 - protein, 51 aa, Zea mays
  misc_feature: Ceres CLONE 1466592-F
  misc_feature (8)..(8): Xaa is any aa, unknown, or other
MFAPEIFXHPFLLPNAVKNLPPHQKHLFYAPDYPKCIHSTRDHPLTVKTRE

SEQ ID NO: 51631 - DNA, 782 bp, Zea mays
  misc_feature: Ceres CLONE 1466604-F
  misc_feature: Encodes the peptide sequence at SEQ ID NO. 51632
  misc_feature (443)..(443): n is a, c, t, g, unknown, or other
  misc_feature (469)..(469): n is a, c, t, g, unknown, or other
tcttaactagtggatcccccgggctgcaggaattcgcacgagaccattacctagaacatcctaatcgaaaaacgcaaaatcgcactccatctgaaatcagctgggacgacgaagaaatgtcctctagcgatcaaaacccaactgccactcctggattgtcggatcccaccgatccctcgcagacaggatggagaaggacggtgtcctcgcttgtatgcgacatgggggcgtacctcccacaagtcctaaagccagagatgtaaaagaaaaagaagacttgcagcttcacgctgatctcacaggacttgtatagcctattggagtttttgcatttcttatgaccacctacaacagaataaacttcaatgggctctttataaacccccccccttcccccatttccctgcttttgcctgccaaagcatcgacctcaccaacacccncaacagggcccggaaactgggcccantttatggtcgggctctcatgtgttcgcttatagttgccccaagttccgcggatgtttgtactgaattcgtgctattccctacagtttttttgtgttgttcggaacaatgcaagtgtactccctatgtaggtccccgccatgtgtggtttgagacccacttcagtgtggacctcgcgttatgattatttatccagtttgtctgtctcccacctttgtgtgtggtatacccatgtggatcccacacctctgttcttattttgctttatccacccggttggcatgttcctccccagtgttgccaccccttttcatt

SEQ ID NO: 51632 - protein, 48 aa, Zea mays
  misc_feature: Ceres CLONE 1466604-F
MSSSDQNPTATPGLSDPTDPSQTGWRRTVSSLVCDMGAYLPQVLKPEM

SEQ ID NO: 51633 - DNA, 763 bp, Zea mays
  misc_feature: Ceres CLONE 1466605-F
  misc_feature (1)..(1): n is a, c, t, g, unknown, or other
  misc_feature (247)..(247): n is a, c, t, g, unknown, or other
  misc_feature (248)..(248): n is a, c, t, g, unknown, or other
  misc_feature (253)..(253): n is a, c, t, g, unknown, or other
  misc_feature (254)..(254): n is a, c, t, g, unknown, or other
  misc_feature (260)..(260): n is a, c, t, g, unknown, or other
  misc_feature (261)..(261): n is a, c, t, g, unknown, or other
  misc_feature (270)..(270): n is a, c, t, g, unknown, or other
  misc_feature (271)..(271): n is a, c, t, g, unknown, or other
  misc_feature (279)..(279): n is a, c, t, g, unknown, or other
  misc_feature (334)..(334): n is a, c, t, g, unknown, or other
  misc_feature (337)..(337): n is a, c, t, g, unknown, or other
  misc_feature (347)..(347): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (357)..(357): n is a, c, t, g, unknown, or other
  misc_feature (366)..(366): n is a, c, t, g, unknown, or other
  misc_feature (405)..(405): n is a, c, t, g, unknown, or other
  misc_feature (413)..(413): n is a, c, t, g, unknown, or other
  misc_feature (475)..(475): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (641)..(641): n is a, c, t, g, unknown, or other
naaagctggagctccccgcggtggcggccgctctagaactagtggatcccccgggctgcaggaattcgcacgagaccattacctagaacatcctaatcgaaaaatctgcggtttcttccacgcaccaatcatttcggccacactgcacacgaacgaaactcgctcgtccttcgcctccatcaacagccgatccgtattcagttcccgtgccgtgcccacctgggggaacccgatcgatgggaaactnngctgnntctcgnnagaaggccnntcgtcgcnggtggcagcggcagtgcgggctccgtgcattacgccaggacgaaccccgtgtggntgnaggaacagangnnnagagcntgcaaaggncaagggcgccggccacgccgccggcgggctgccaccggnagattaangaatccaggattccccaaagaaaacacactggagacctgcctgcgccctaaaagacagcaanaccgccgtggctgcggaatgccctttccagaaactttttttccagaaacccccnnnnnagggggggagagaagctcaaatgtcccgggaaagggagaaagggccattggggggccctctttttaaaacaaaccccaagagaaacagacccgggctctaatataaancccaaaaccgggcccctaaaaaaaccccgcggttttaaaaaaaaagacccccccccaaaaccccgggggggggagaaatacaccattttttggccccatttaaacaaaaaaaagaaaataaa

SEQ ID NO: 51634 - DNA, 797 bp, Zea mays
  misc_feature: Ceres CLONE 1466608-F
  misc_feature: Encodes the peptide sequence at SEQ ID NO. 51635
  misc_feature (461)..(461): n is a, c, t, g, unknown, or other
  misc_feature (547)..(547): n is a, c, t, g, unknown, or other
  misc_feature (633)..(633): n is a, c, t, g, unknown, or other
ctggagctccccgcggtggcggccgctctagaactagtggatcccccgggctgcaggaattcgcacgagaccattacctagaacatcctaatcgaaaaatccgaaccgatccttacagagagacacacccagcgcgcgagatatctacatcgatcatcatcaccaacgagcgagccggccgagcagcaccgatggcggcgtacatgcgcgtgacccaccgcgacgaggaaggcaagaaggtgacggagaagatgccggtcccggagacgcggcgcccggacacggccaagcacttcgagcgcaaactggaggagcagggcctccaccgcttcgagcagcacccggcgaacgcgccccggggcgtgggcatgggcgccccgccccccaagtccgggcgcggcggcaagtaaaacccaccccttcccggcagcgtcgtcgaggaccagctcgacccggcgccncccgacatggaccccaatgaccccaactacgatgagggaggggcggaggacgatgacgatgaagcgcccaccgaggcggaccctcngcgaagtcgaggtcgctaaggaccccaaaagcacggcaggcgttcacgagggtcgacgccaccccccggcctggctccaggaccanaaacagaaaaaggactggccttttccgggaaaccccctagactcctataagaactgggcgccagcgccgtttcgaattttggctccccggtccaatcagttccacatccaacattccggcttttaattaatcccggcgtttagccgatttatccgattcccgca

SEQ ID NO: 51635 - protein, 72 aa, Zea mays
  misc_feature: Ceres CLONE 1466608-F
MAAYMRVTHRDEEGKKVTEKMPVPETRRPDTAKHFERKLEEQGLHRFEQHPANAPRGVGMGAPPPKSGRGGK

SEQ ID NO: 51636 - DNA, 782 bp, Zea mays
  misc_feature: Ceres CLONE 1466610-F
  misc_feature: Encodes the peptide sequence at SEQ ID NO. 51637
atagctggagctccccgcggtggcggccgctctataactagtggatcccccgggctgcaggaattcgcacgagaccattacctagaacatcctaatcgaaaagaaagatgcaaaacgaccttctcctgtcctgcatctgcatgcaataagcagccgctttagtgctgccgtgcagagaggtacttccatgctgctcctggccgtgccggccgtgttggccgggttcctcaaggcgttccgcctcgccttcctgctttggccgctcaacctcgcgctcccgctggcgcgcgacctgccgcgggcctgcatcacggtccgggccatcacgtccttctacaccgccgggctgcggggctacgtctctctgtgataaagtgacgtgcagctgctgcaagcgcatagccagttggaccaacagccggtgtcaaaaaccgacgccgcctcctcctcatcttcctcctcctcggcgctcggattggcgtggacgcgcgaggaagccgatgtcgtcgcccatgccttgctccgctttcgacgacctctactgaatatcttgaagggaatcttcttcccacggttatgttcgtatggcctcatattccccggcccctcccttgtattactttgatcgagggtaattaaaggatcataacattcactccctcaaagatattttggtccctcaaaaccttccctatccgcgcggcccgcttttttagccccccccaccctcgctctcctggatatataccctcttctgtattacgcccttaccccactcactt

SEQ ID NO: 51637 - protein, 60 aa, Zea mays
  misc_feature: Ceres CLONE 1466610-F
MLLLAVPAVLAGFLKAFRLAFLLWPLNLALPLARDLPRACITVRAITSFYTAGLRGYVSL

SEQ ID NO: 51638 - DNA, 772 bp, Zea mays
  misc_feature: Ceres CLONE 1466616-F
  misc_feature: Encodes the peptide sequence at SEQ ID NO. 51639
aaagctggagctccccgcggtggcggccgctctagaactagtggatcccccgggctgcaggaattcgcacgagaccattacctagaacatcctaatcgaaaagtcccatcgttcctctctctctgccccgcctacgcctcgccccagacgcatcaaaccgctctcctctccctccctgccccctcgcaaccccgaagaagccccccacacgcaaggccgcaaacgcgccgcgcaccggaaggccccagggagcgacacgaggcggcctcattgcggcatggctgctatggccgccgctggcggcgtcgggctccatctcattggcgctgccacggccacgctcatcgcggcggtccttgttgcggccgtgctggggcgccgccgccgggcccgggcccaggcgcctccggtggaagggaaacccgcgccggaggcaggctgcgcggtcggtgacggcgcgggtcccgacggcgggacggacgtcatcatcgtcggcgccggagtggctggatctgcgctggcgtacacgctcggaaaggatggccgccgggtgcatgtcatcgagagggatctgacagaacctgacagaattgtgggcgagctgttgcaacctggaggttacttgaaattaattgagttaggccctccagattgtgtggaagaaattgatgcccaacgggtgcttgggttacgcatattcaaagatggaagaacacaaagcttgcttatccctttagagagttccattctgatgttgctggtaggagctttc

SEQ ID NO: 51639 - protein, 165 aa, Zea mays
  misc_feature: Ceres CLONE 1466616-F
  misc_feature: SWISSPROT Homolog: EC 1.14.99.7 Squalene monooxygenase
MAAMAAAGGVGLHLIGAATATLIAAVLVAAVLGRRRRARAQAPPVEGKPAPEAGCAVGDGAGPDGGTDVIIVGAGVAGSALAYTLGKDGRRVHVIERDLTEPDRIVGELLQPGGYLKLIELGPPDCVEEIDAQRVLGLRIFKDGRTQSLLIPLESSILMLLVGAF

SEQ ID NO: 51640 - DNA, 829 bp, Zea mays
  misc_feature: Ceres CLONE 1466617-F
  misc_feature: Encodes the peptide sequence at SEQ ID NO. 51641
  misc_feature (370)..(370): n is a, c, t, g, unknown, or other
  misc_feature (374)..(374): n is a, c, t, g, unknown, or other
atagctggagctccccgcggtggcggccgctctataactagtggatcccccgggctgcaggaattcgcacgagaccattacctagaacatcctaatcgaaacttcagacgagcgagcgagccaccgagagagagggcgagagtgagtgagtgagagggagagtgagagtgggggattcaagtttcaaactcactatcgagggggataggaaggtggtcatcggtccatagctagctcgtcgtcgaccatggctgactggggccccgtggtgatcgcgacggtgctgttcgtgctgctcacgccgggcctgctgttccagctgccggcgcacggccgcatcgtcggcttcggcaccatgcacaccagcggnatcnccatcctcgtccacgccgtcctctacttggggttggcgccacgcggcctcatcggcattggggtccacttctacccccgggtaactaggggggcttctaaggtcacaccccctgcgtttcttctcctcaaaaacgggcctttgcttcccccgaaagggacaataggccccccaatatccctgaggttaaaaaaaaaaaacaagtcttcgttccccgaaacccccccagaatgtgggggatttttttgggggatatttttgggggttttttgttcacaaaaaaaaaaaaaaaaatttttttccatccccccgcacctccgtgaggggggggcgcgcacccaaatttcccctcttatggagtgtttttattccccccccctcgggcgccccttatttaaacaccttggggtggggagaaaaccgcgggtgggcccactatatatgcgcggggggggg

SEQ ID NO: 51641 - protein, 194 aa, Zea mays
  misc_feature: Ceres CLONE 1466617-F
  misc_feature (43)..(43): Xaa is any aa, unknown, or other
MADWGPVVIATVLFVLLTPGLLFQLPAHGRIVGFGTMHTSGIXILVHAVLYLGLAPRGLIGIGVHFYPRVTRGASKVTPPAFLLLKNGPLLPPKGTIGPPISLRLKKKNKSSFPETPPECGGFFWGIFLGVFCSQKKKKKFFSIPPHLREGGARTQISPLMECFYSPPLGRPLFKHLGVGRKPRVGPLYMRGGG

SEQ ID NO: 51642 - DNA, 755 bp, Zea mays
  misc_feature: Ceres CLONE 1466622-F
  misc_feature: Encodes the peptide sequence at SEQ ID NO. 51643
  misc_feature (698)..(698): n is a, c, t, g, unknown, or other
  misc_feature (755)..(755): n is a, c, t, g, unknown, or other
atagctggagctccccgcggtggcggccgctctagaactagtggatcccccgggctgcaggaattcgcacgagaccattacctagaacatcctaatcgaaaactatacccagctactcgcacgcagatccacccacccacccatcgttccttccgttccgtccgtccacttgccgttgccgaccataacccgctcccggaggacggcgggatgagggggcaagccaacggagtggaggaccgccggcagcggggcgacgaccacgaggcggacaacgacggcgaggaggcggaggaagaggagggcgacgacgagggccgccaccggggccagggcccgccgcagcagcggcgccaccaggcccagaggccgtactccggcccgcagcagcagccgcgcccgccgccgccgctcgccaggaacgtcggctacgtcggcaagcaccgcctctccgccgccatcgcccgcctcgaccaggagctccagtccctccaggacgagctggacgagcttgagaccatggaatctgcgtccgcagcgtgccaggagtaagcagattttgagcgtgtagcgttgtgttttccacatcatcatcatcacgtgctgtttcttctcgttgttgatgtatggttggccttgtgaacgaaacagagtggtcacgagtacggaaaggaagcctgacccgctttcttctgtcnacagtgggcccggagactcgtcttgggacaagtgggttcagcgggtgccctcccgcn

SEQ ID NO: 51643 - protein, 113 aa, Zea mays
  misc_feature: Ceres CLONE 1466622-F
MRGQANGVEDRRQRGDDHEADNDGEEAEEEEGDDEGRHRGQGPPQQRRHQAQRPYSGPQQQPRPPPPLARNVGYVGKHRLSAAIARLDQELQSLQDELDELETMESASAACQE

SEQ ID NO: 51644 - DNA, 766 bp, Zea mays
  misc_feature: Ceres CLONE 1466629-F
aaagctggagctccccgcggtggcggccgctctagaactagtggatcccccgggctgcaggaattcgcacgagaccattacctagaacatcctaatcgaaaaaacttcccacagatagattccgcgggctgcgagcatcccccacctcatcggcccccgcgtgcggcggcggcgactctacctgacctgtcctgcgtcctcccgctttccagccagcaagccagactccgcccctctccgaaggctccgatcgtctggtttcgtccagatccggctccgctgaggctctagatcgcgtcgcgcacgatgccacgcgacctgtcgcggtcgcggtctccgccgcgccggcgtcggcggtcgccatcacccgagcggtaccgcggccggaggggccgtagggaccgaagccctagccgtagcaggtccccctatcgcccctcgtatagaaggaggagccctttgccttccccgagaaggcgtgagagctgttctccatctcctaggaggcgcaatagtccacctccatcacggaagcgttacagaagaaagagcagtccgagtgtcattagctctccagttactgcatctcaaagttccccaccttgggtggaaagagataagaatgctattgatacgcaaaagctagaagaagaaaaagaaaggcgccggaaaggaagttgaacttagactaatagaggaggacacagctaaaagagttgagcaagctattaggaaagacgttgaggagagtctgaaatgtgatgaa

SEQ ID NO: 51645 - DNA, 784 bp, Zea mays
  misc_feature: Ceres CLONE 1466634-F
aagctggagctccccgcggtggcggccgctctagaactagtggatcccccgggctgcaggaattcgcacgagaccattacctagaacatcctaatcgaaaactcccctcctccgcacaaacgcgtcgcatccgctccacaggatcctcggcgccgagtccaagatcttctacctcaagatgaagggtgactaccacaggtaccttgctgagttcaagtcaggtgcatagaggaaggatgctgcggagagcaccatgaatgcctacaaagctgctcaggatattgctcttgctgatctggccccaccccaccccatcaggctcgggcttgctctcaacttctcagtgtctactacgagatcctcactaccctgaccgtgcttgcaccttgcaaagcaggcctttgatggagcatctccgaactacaagcctgggaaaaggagtcctaaaggaaagaatttgaatcatgggctccggggggacaatttgacccttgggacttccaacccaggagaaaccccgaaattaataacaggaaggagtcggcccccaaaaatcccccccccggggggcaaaaaagaggttcccatcccccccccttgttgtgttccttatgtggggaaattatacaaaaggggcgcctcaattttttaagaatttttttctaacaccccctttggttttcccccccccccccccggggggggggggaaacacccccccccctcccccccgttttttttaaaacacaccacaaattccccccgccgtttttttaacaaaaaa

SEQ ID NO: 51646 - DNA, 763 bp, Zea mays
  misc_feature: Ceres CLONE 1466637-F
  misc_feature: Encodes the peptide sequence at SEQ ID NO. 51647
  misc_feature (708)..(708): n is a, c, t, g, unknown, or other
aaagctggagctccccgcggtggcggccgctctagaactagtggatcccccgggctgcaggaattcgcacgagaccattacctagaacatcctaatcgaaaatctggggtcgagctcctcctcctcctccccacggtccctcgcaggctcccagcccgccttgctcgcgagcctccgcaaaaccctagaccaagacctacccctagccctatctctcccacacccgcactgggagatggactgcgtcggcacgccccgcgagccggaagacgtgttccgagatttccgcgcgcggggatctggaatgatcagaccgctctccaccgaggtgcataacttcaacaagaagagtaacccatataaagagactctgtgtttgtctggacttcccgatgactgatggcaagagagcctgcctgcagaagaggttcctcctgaactacctaaggcagctctggcatttagtttagctcgcgacgggatggaagaaacacattgactgtccctactctcggtgaacagtgatgcttggttgctggctgtggccattaacgtcggcgcaagatttggctctgacgcccaaaccatgacctgcctttctgcatgatcaataaccgtcactacgatatatgaagttgtcgcggtaactgccgagaagcgaccagagacaagactctgcttagcctgcgcactagcactacacctgancacagactggattgactggattttccttgatcagtacgtttgcctaattatctac

SEQ ID NO: 51647 - protein, 54 aa, Zea mays
  misc_feature: Ceres CLONE 1466637-F
MDCVGTPREPEDVFRDFRARGSGMIRPLSTEVHNFNKKSNPYKETLCLSGLPDD

SEQ ID NO: 51648 - DNA, 721 bp, Zea mays
  misc_feature: Ceres CLONE 1466639-F
  misc_feature: Encodes the peptide sequence at SEQ ID NO. 51649
tggagctccccgcggtggcggccgctctagaactagtggatcccccgggctgcaggaattcgcacgagaccattacctagaacatcctaatcgaaaagtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgatggaaaaaaaaaagaaaaagagcttatcgataccgtcgacctcgagggggggcccggtacccaattcgccctatagtgagtcgtattacgcgcgctcactggccgtcgt

SEQ ID NO: 51649 - protein, 62 aa, Zea mays; identical to SEQ ID NO: 5990
  misc_feature: Ceres CLONE 1466639-F
  misc_feature (1)..(62): Pfam Name: TMA7 Pfam Description: Translation machinery associated TMA7

SEQ ID NO: 51650 - DNA, 770 bp, Zea mays
  misc_feature: Ceres CLONE 1466640-F
  misc_feature: Encodes the peptide sequence at SEQ ID NO. 51651
aaagctggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgactcaaagctttccccaattcccccccttctcccatttctcaccaccgacggcgctccccccgttcaacaacaccatgagggagtgcatctcgatccacatccgccaggctggtatccaggccggaaacgcgtgctgggagctgtactgcctcgagcatggcattcaggctgatggccagatgcccggtgacaagaccattgggggacgtgatgatgctttcaacaccttccttcactgagactggcgctgggaagcacgtcccccgtgctgtttttgttgaccttgagcccactgtcatctatgaggagaggactggcacctaccgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggactccagggcttcctcgtcttcaacgctgtatgtggaggaacgggctcctgggcttggctctctcctcctggagcgcctgtctgctgactatgggcagagtcccagctccggtatcacgtgtacccatcccccccagtgccccatccgtgc

SEQ ID NO: 51651 - protein, 132 aa, Zea mays
  misc_feature: Ceres CLONE 1466640-F
  misc_feature (24)..(132): Pfam Name: Tubulin Pfam Description: Tubulin/FtsZ family, GTPase domain
MAFRLMARCPVTRPLGDVMMLSTPSFTETGAGKHVPRAVFVDLEPTVIYEERTGTYRQLFHPEQLISGKEDAANNFARGHYTIGKEIVDLCLDRIRKLADNCTGLQGFLVFNAVCGGTGSWAWLSPPGAPVC

SEQ ID NO: 51652 - DNA, 780 bp, Zea mays
  misc_feature: Ceres CLONE 1466645-F
  misc_feature: Encodes the peptide sequence at SEQ ID NO. 51653
  misc_feature (408)..(408): n is a, c, t, g, unknown, or other
  misc_feature (417)..(417): n is a, c, t, g, unknown, or other
aaagctggagctccccgcggtggcggccgctctataactagtggatcccccgggctgcaggaattcgcacgagaccattacctagaacatcctaatcgaaaaattcacaacttccgctgcgcctcgactcgtagcccgaaccctatccaccgggccggaggcgagagagcagccatggcgcggtgcctcgcgctcgtcgccctcctcgtactcggcctcgccgccgccgccgcctccgcggccgacgcgcccttcgtcgtcgcgcacaagaagatttcgctctcccgccccaagccgggcgtcgagcgcgtcgccgtctccgtcgacctctacaaccagggatccgcgactgcctatgatgtgtccattaatgacaactctaggtcaaaagaggtgtttgagcttgtncccccacanaaatccaagaccttgggaaaggtttgaccctggggccacggcttcaactcctatggtcctggaaaccaaaaccaaggggaagttcctgggtttcccagctatcattaaatagcgtgttcccccaaagacggttcttcgggaggtaactcaattcccctccttcccctgggaattttctcgctgaagaaccccccaaaaaaaaagtttgaaggggcgtaaaaggtttgtggaaaaataacgggccacttggggggggtggtcctttttgtggggagggttttctccttttggcggggcccgtaataaaatttttttcgggggaagcaaaaaaaaagcggttttttttctttagggcgcgggggg

SEQ ID NO: 51653 - protein, 89 aa, Zea mays
  misc_feature: Ceres CLONE 1466645-F
  misc_feature (81)..(81): Xaa is any aa, unknown, or other
MARCLALVALLVLGLAAAAASAADAPFVVAHKKISLSRPKPGVERVAVSVDLYNQGSATAYDVSINDNSRSKEVFELVPPXKSKTLGKV

SEQ ID NO: 51654 - DNA, 770 bp, Zea mays
  misc_feature: Ceres CLONE 1466646-F
  misc_feature: Encodes the peptide sequence at SEQ ID NO. 51655
  misc_feature (734)..(734): n is a, c, t, g, unknown, or other
aaagctggagctccccgcggtggcggccgctctagactagtggatcccccgggctgcaggaattcgcacgagaccattacctagaacatcctaatcgaaaaaccaccactcccaccacttcgagcgcctcctcctgtctcgtcctcgtcccccgtccccccgtcccctcctccggcgcccgatctaattcaagatgactcctgccggccatgctggaggtggtcaaagttctctggcctagctgtttggagatggtgagcctgcacagcctgctgcaccaccagctgcgaacccagcacctgctgacaaaccagcactggcaccctgccgatgtaaccaagcagattccagctggcattccaggtacccgggcgaacaactactaccgtgcagatggccacaacacgggcaacttccttgacggaccgctccttcaaccaaggttcatgctgctcccggcggtggctcgtccctgggctacttgtttggcggcaagtgatctctgttaatgatgctgcgatgaattggcctgtatctctgttatccctgtggcgaacactggaagtgtttggtttcagcactttaccacctgcgtcgatgtactctgtctgtatggatcattgtctccaggctgacctcctgcttgacagccagcttgcctaagacctgtcgcattgcaactaatcgtcttcatctcaaaagttggtgtgtccaagaaagaaaacaaaagcttntcaatcccctcgacctcgagggggggcccagtaccc

SEQ ID NO: 51655 - protein, 99 aa, Zea mays
  misc_feature: Ceres CLONE 1466646-F
MLEVVKVLWPSCLEMVSLHSLLHHQLRTQHLLTNQHWHPADVTKQIPAGIPGTRANNYYRADGHNTGNFLDGPLLQPRFMLLPAVARPWATCLAASDLC

SEQ ID NO: 51656 - DNA, 728 bp, Zea mays
  misc_feature: Ceres CLONE 1466649-F
  misc_feature: Encodes the peptide sequence at SEQ ID NO. 51657
aagctggagctccccgcggtggcggccgctctagaactagtggatcccccgggctgcaggaattcgcacgagaccattacctagaacatcctaatcgaaaagtttaacattatcccgcttggagcgacaacttctgtaaatggacgccaccgtcgtcgccgtcccctacgaccatgatgattccgactgccgccaccccctgctcgcccggaacgaagagatccacctctactcagattcccctatccgtctacatcctccactggatgctgcggcgacccagctcgaggaccagcggaggccagaaagagtggcctctctggacgtgttccgcggcttcaccgttgccttgatgatactcgtggacgacgccggctgggcgtggccggatatccaccacgcgccgtggttcgtggttacggtggctgacttcgtcgtgcctgccttcctcttcatcagtctgcgtctccgccgtactcgtattcaagaaaatggtaaacgagactgctgctactaagaaggctgcagttccggcttcaaaacttttcatattgcgtgtgatgttgcaagggggatacattcctggacgacacaaattaacttatggggttgatttggatcatattcgatggctaggtgtgttgcagaggatatgtattggatacgttgtattcacaatgtcagacatttggcttgacatcgatagtttgatggatcacctgtaccct

SEQ ID NO: 51657 - protein, 125 aa, Zea mays
  misc_feature: Ceres CLONE 1466649-F
  misc_feature: SWISSPROT Homolog: EC 2.3.1.78 Heparan-alpha-glucosaminide N-acetyltransferase
MDATVVAVPYDHDDSDCRHPLLARNEEIHLYSDSPIRLHPPLDAAATQLEDQRRPERVASLDVFRGFTVALMILVDDAGWAWPDIHHAPWFVVTVADFVVPAFLFISLRLRRTRIQENGKRDCCY

SEQ ID NO: 51658 - DNA, 764 bp, Zea mays
  misc_feature: Ceres CLONE 1466651-F
  misc_feature: Encodes the peptide sequence at SEQ ID NO. 51659
aagctggagctccccgcggtggcggccgctctagaactagtggatcccccgggctgcaggaattcgcacgagaccattacctagaacatcctaatcgaaaaatcgcaacccgcagcagttcatcacttacacagccatacacatcacctgtaaatcgaccggtgtcatacgcgaggatggattaccaggggcagaccggccacgccaccgacaaggtggaggagtacggccagcccgtggccgaccacggcggcgccaccggcgggcccacggggacgcacggcgccgccgccgccgcgggtgccgggcagctccagccgaccagggacgaccacaagaccgacggcgtcctgcgccgctccggcagctccagctccagctcgtctgaggacgacggcgctggcggcaggagaacccaccgcatgaaggataatatcaaggagaagctccccggcagagcccacaaggacgccaccgggcagcagcacacgccggcagccggcgagtacgcaggcaccggcaccggcacgcacggcgcgtaggtcaccggcgagaagaagggtgtcatggagaagatcaaggagaaccttccgggggacagcactaggtgaagctagggaactagcgatcgacctgtgatgtgtctgcgttccgccgaacctcgataccatgcgtactttctgcttgccctcgtacggaaaaataatgaccggcgtttcaaggtgcccgaaatatattaggttgcggggcggacgaacttcggg

SEQ ID NO: 51659 - protein, 121 aa, Zea mays
  misc_feature: Ceres CLONE 1466651-F
  misc_feature (11)..(119): Pfam Name: Dehydrin Pfam Description: Dehydrin
MDYQGQTGHATDKVEEYGQPVADHGGATGGPTGTHGAAAAAGAGQLQPTRDDHKTDGVLRRSGSSSSSSSEDDGAGGRRTHRMKDNIKEKLPGRAHKDATGQQHTPAAGEYAGTGTGTHGA

SEQ ID NO: 51660 - DNA, 736 bp, Zea mays
  misc_feature: Ceres CLONE 1466652-F
  misc_feature (673)..(673): n is a, c, t, g, unknown, or other
aagctggagctccccgcggtggcggccgctctagaactagtggatcccccgggctgcaggaattcgcacgagaccattacctagaacatcctaatcgaaaaatgatgattgtttgttttctaagctcgttcgccctctcttttctctccgtccaacgacggcgcgattcagatccaggcatacaggccatccttccgccgccgcggactgcgcctaatcttccttctccagcagccgggcgttcccgtcgtcctcgatcgtcccctggactggatcgcaacggagatccagccggacctgcggtggtcccttccttttctcgcgacgagagtctgtcagatgatgacccataaaatgaaggtttccggaaatgtgagtgtgtgattcagtatatttcttgtgtgcacaacaagcctgacaggaacatctcctcatgggaagcccatgtcctgctgagaaggatatgccgtatgttcttctgggaaggatatgccacacccagtgatttcattgcaactggaacgatcgatgacagtcaaaacaaagcagacggtgatgagtcgatattgtgctagattatttgttggttctacgcttaactagtctgctcggcagggttatagtttcgatgcccacctgtacataccgagatcccattcctttctttttgtgncatgttatggtacactgactgtcatcaccttttcacgcccgctgaccatatgacgctgcccgg

SEQ ID NO: 51661 - DNA, 745 bp, Zea mays
  misc_feature: Ceres CLONE 1466654-F
  misc_feature: Encodes the peptide sequence at SEQ ID NO. 51662
  misc_feature (1)..(1): n is a, c, t, g, unknown, or other
  misc_feature (11)..(11): n is a, c, t, g, unknown, or other
  misc_feature (668)..(668): n is a, c, t, g, unknown, or other
  misc_feature (696)..(696): n is a, c, t, g, unknown, or other
nccgccccccnccaatagtggagctccacgcggtggcggccgctcctagaactagtggatcccccgggctgcaggaattcgcacgagaccattacctagaacatcctaatcgaaaacttgttcttttcccacccggctacccccgtcgtcgccgccgctttccccgtggtttcagagctccagtcggctagctaggccgcctggctaatctccctgccttctataagtacaggttcattgtgtgctgtgctcccagctccatcactgacacaagagagcacgctactactcatcactcgccaacgtgcagagatcagggaagcggcactccatccactgactgaccgctcatggcgaaggtccacctctacgtcgccgcggcctgcgccgtcgtcctcgcgctcgccaccccggccctcgccggtgaccccgacatgctgcaggacgtctgcccggctgactacgcctccccggtgaagctgaacgggttcgcgtgcaaggcgaacttttcggcggacgacttcttcttcgacgggctgaggaacccgggcaacaccaacaacccggcgggctccgtggtgacggcgggccacgtggagaattcccgggcgtgaaccgctgggcgtctcctggcgcgcatcgactacgcgccggggggcagaacccgncgcacacgacccgcggcgcaccaaaatnatcttctcctcaacggtagctcaagtcggcttctcccaccgccaagggt

SEQ ID NO: 51662 - protein, 87 aa, Zea mays
  misc_feature: Ceres CLONE 1466654-F
  misc_feature: SWISSPROT Homolog: EC 1.15.1.1 Superoxide dismutase
MAKVHLYVAAACAVVLALATPALAGDPDMLQDVCPADYASPVKLNGFACKANFSADDFFFDGLRNPGNTNNPAGSVVTAGHVENSRA

SEQ ID NO: 51663 - DNA, 829 bp, Zea mays
  misc_feature: Ceres CLONE 1466655-F
  misc_feature: Encodes the peptide sequence at SEQ ID NO. 51664
aaagctggagctccccgcggtggcggccgctctagaactagtggatcccccgggctgcaggaattcgcacgagaccattacctagaacatcctaatcgaaaaagcgattgattccgacaaaactgtgatggtcacgtttaagcatgatgacaagttaccagaaaatgtggaatgtggcttccagtgtgcacttctctatactactgtatatggacaaaggaggatccgagtcataaacctctcactttcatgtacaaatttgcttgccaatcttttccggtatgctgatttggacacacaggttgcatgcttcctgaatcaagctgctaatggcatctcgacctcttcattacctcgtattcgggatgagacaacgaactcatgcatacatattcttcaatcttagcgcacacaccgtgcatctgtaatctcatcggggcaagtcgatgctcccgaaggcacgaaaacggctgaccttataaaggccaggaactggcaaaaagggtaggttttgaaaattgagggccaaataaatgaaacgctcccaattggaaacccccggggcccccaaattttgcgaaaaaaaatttttgtcccccgggggatcccaaaaatggtcccaacgcgctaaatcccccccccggggaggaggaaaaaaaccccctgtgccccctcccctttttttttcccaaaggggaaattgtccaaaaaagggggggcccctttttttttggaaaaccggggagaaagggccctttcccccaagaaaaaaaagggaaaaccggcgctcccccaaaaaaaaaaaccaggggcttcttctttgggggga

SEQ ID NO: 51664 - protein, 92 aa, Zea mays
  misc_feature: Ceres CLONE 1466655-F
MVTFKHDDKLPENVECGFQCALLYTTVYGQRRIRVINLSLSCTNLLANLFRYADLDTQVACFLNQAANGISTSSLPRIRDETTNSCIHILQS

SEQ ID NO: 51665 - DNA, 771 bp, Zea mays
  misc_feature: Ceres CLONE 1466658-F
aaagctggagctccccgcggtggcggccgctctagaactagtggatcccccgggctgcaggaattcgcacgagaccattacctagaacatcctaatcgaaaacctggcactgggaacttcgttcgccccgttgtctccggctgtcgtcccccgatccctcccctcacacgatgcccggctgcccgtctcctggtgcctgggaactctctcctcgtggtgcaggcacccgagaccaccgcccccacccatgcacctcgagctgcgggagcttgcgccccgcctccccagtcgtgctatcctggcgggctaaccctactacgcgctggccaacggctgcccctggacctgctgcggagataagaactgcatacgctgatggctcatactctgtcaatgctactcctgcatgtgcacccagtgacctacgtgttacctccgtgcggtctgacggaggagactagctaattcttgctgttagattggtacatcgtcgtcgatgtgtgggtttcgagaagtaccggctgttgcgtgccgtgatattgctctgattctgagatgatgatgatggctgatggagatgccccgccctcgactgttctcctgcggaccttctgcattgagtgctgatgactcctggcatgcagcttttgtaaactgaagctcagacgcctgctgggtgagcgcacatacttctccaacctgagcacttgttcaccttttgagtgatgcgaggcccatttactcatgtcagctcccgggaggacacgggtg

SEQ ID NO: 51666 - DNA, 746 bp, Zea mays
  misc_feature: Ceres CLONE 1466659-F
  misc_feature: Encodes the peptide sequence at SEQ ID NO. 51667
aaagctggagctccccgcggtggcggccgctctagaactagtggatcccccgggctgcaggaattcgcacgagaccattacctagaacatcctaatcgaaaaacacctctctcgctgcctttatttcctgttggcgacgctctcgccaggtcttcggcggcccgttcgtcggcgactatcgcctccgtttgccaggtcttcgacatccgttcaccgtccactggtgcccaccagccagtacatctggaacaatggtgatttaccttatcacacctgaaaccgacaaggtatccaaagatggagaaaacgataaacttaaattcggactttcatctatgcaagggtggcgtgcaactatggaagacgctcactcggctttgctagatcttgacaatgacactgcatcctttggtgtttttgatggacatggaggaaaagtacttgccaaattctgtgcaaaatatctacacatagaagttctccataccgaagcctatgctgctggtgacctgcgtgctgctgtccacagagcttacttaagaatggatgaaatgatgcggggtcaaagaggatggcatgaactccaagcacttggagataagataaatcagttcactggcataacagaaggcttgatttggtcccctacagcaagtgattcacatgatagacatgatgattgcgctttcgaggacgtctagctatgtgacgacgacgaattcattgtgtgtagcatgtgatggcat

SEQ ID NO: 51667 - protein, 149 aa, Zea mays
  misc_feature: Ceres CLONE 1466659-F
  misc_feature: SWISSPROT Homolog: EC 3.1.3.16 Phosphoprotein phosphatase
MVIYLITPETDKVSKDGENDKLKFGLSSMQGWRATMEDAHSALLDLDNDTASFGVFDGHGGKVLAKFCAKYLHIEVLHTEAYAAGDLRAAVHRAYLRMDEMMRGQRGWHELQALGDKINQFTGITEGLIWSPTASDSHDRHDDCAFEDV

SEQ ID NO: 51668 - DNA, 702 bp, Zea mays
  misc_feature: Ceres CLONE 1466661-F
  misc_feature: Encodes the peptide sequence at SEQ ID NO. 51669
  misc_feature (565)..(565): n is a, c, t, g, unknown, or other
agtggatcccccgggctgcaggaattcgcacgagaccattacctagaacatcctaatcgaaaaaggccgccgcctctcctactgcatctccctcgctctcgtcgcctcgttcgcttcggctccgccccgccccgccccgagcagagcgcagccctatccggagctgggatggcggacgcgaagcaacagcagcagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccagttgggtgagggctctgctggtcaggtcacaaggaacatgcttgcaaatgagggtgtccgttctttgctacagggtttgtccgccgggatgctgatgcaagcgacgtacacgactgctcgacgtggatccgttagggatctagctaccaaagcagttgaaaagaatgaaggggagccattgcctctatttcgagagcttttattggtctgactgctggagcactggntgcttgtgtgagagtctgctgatctggactcattagaatgaagcgattcgaccttgccattgaaaaagacgcacttatagaagccttccatgactctaccgatctaggtgaggagggatcctggcctttgaggggga

SEQ ID NO: 51669 - protein, 126 aa, Zea mays
  misc_feature: Ceres CLONE 1466661-F
  misc_feature (27)..(112): Pfam Name: Mito_carr Pfam Description: Mitochondrial carrier protein
MADAKQQQQQQQQQPQQAAAAATGVWKTVKPFVNGGASGMLATCVIQPIDMVKVRIQLGEGSAGQVTRNMLANEGVRSLLQGLSAGMLMQATYTTARRGSVRDLATKAVEKNEGEPLPLFRELLLV

SEQ ID NO: 51670 - DNA, 1196 bp, Zea mays
  misc_feature: Ceres CLONE 1466663
  misc_feature: Encodes the peptide sequence at SEQ ID NO. 51671
acccaaacgtttcgatatcccagagtggtgtggccgccgccggcggcttctttctccccttccattccgctccccgtgacgtcaccgaccaggcaagcactccgctccaccagagccgcctcgcctgtctgtccgagccacacacataccgtagcgcgcgtcccgaggtcggcggagcagggtcgggaggagggaatggcggtggtgggcgtcctcgcgctgcagggatcctacaacgagcacatggccgcgctgaggaggatcggagtgaagggggtggaggtgcgcaagccggagcagctcctcggcatcgactcgctcatcatccccggtggcgagagcaccaccatggccaagctcgccaactaccacaacctgttccctgcacttcgagagttcgttggaggtggaaagcctgtctggggaacctgtgctgggctcatctttcttgcaaacaaagcagtagggcaaaaaacaggggggcaggaacttgttggaggattagattgtacagtccaccgaaacttttttgggagtcagcttcaaagctttgagacagagctttcggtgccaaagctttcggagaaggaaggagggaatgatacatgccgcggtgtatttatacgggcacctgctatattggaagtaggtccagatgttgaaatattggcggattgccctgttcctgttgacagacccagcattacaatatcatttggggagggtactgaggaagaagagtattcaaaagatcgggtaattgttgcagtgcggcaagggaacatcctcgcaactgctttccacccagaattgacatcagactccagatggcatcgtttcttcttggacatggataaagaatccccagcaaaggcgttttctgcgctctccctgtcgtcatcgtcaagagacactgaaggcctgccaaagaataagccgtttgatctgcccatttttgagtaacgctacacacaagacaaaccaaaagattgaaggaatgaagaaactgaccgtatttattatcaatcatcatttagccggttacaaaaacagccagctgagaatctgtcatactcagccgaaaaaagtgttgtctggtagctaacttgtacggataaaaaataatcacgctgtgtgctgtacgcaattctcatcagataaagcgaaacattgttttcccaaaaaaaaaaaaaaaa

SEQ ID NO: 51671 - protein, 255 aa, Zea mays
  misc_feature: Ceres CLONE 1466663
  misc_feature (6)..(222): Pfam Name: SNO Pfam Description: SNO glutamine amidotransferase family
  misc_feature: SWISSPROT Homolog: EC 6.3.5.3 Phosphoribosylformylglycinamidine synthase
MAVVGVLALQGSYNEHMAALRRIGVKGVEVRKPEQLLGIDSLIIPGGESTTMAKLANYHNLFPALREFVGGGKPVWGTCAGLIFLANKAVGQKTGGQELVGGLDCTVHRNFFGSQLQSFETELSVPKLSEKEGGNDTCRGVFIRAPAILEVGPDVEILADCPVPVDRPSITISFGEGTEEEEYSKDRVIVAVRQGNILATAFHPELTSDSRWHRFFLDMDKESPAKAFSALSLSSSSRDTEGLPKNKPFDLPIFE

SEQ ID NO: 51672 - DNA, 674 bp, Zea mays
  misc_feature: Ceres CLONE 1466666-F
  misc_feature: SWISSPROT Homolog: EC 1.4.1.2 Glutamate dehydrogenase
  misc_feature (11)..(11): n is a, c, t, g, unknown, or other
  misc_feature (15)..(15): n is a, c, t, g, unknown, or other
  misc_feature (538)..(538): n is a, c, t, g, unknown, or other
  misc_feature (539)..(539): n is a, c, t, g, unknown, or other
  misc_feature (559)..(559): n is a, c, t, g, unknown, or other
  misc_feature (669)..(669): n is a, c, t, g, unknown, or other
tccaccgcggntggngcggccgctctagaactagtggatcccccgggctgcaggaattcgcacgagaccattacctagaacatcctaatcgaaaagagtttgtcagggacaacaagtccgttggaagcttccggttggatgggatccctcctgcacctcgtggtgtcccacaaattgaagtgaagtttgatattgatgcaaatgggatactctcagttgctgccattgataagggcactggaaagaaacaggacatcaccatcactggtgctagtacgttacctaaggatgaggttgagagaatggtagaagaagccgataagtttgccaaggaggacaaagagaagagagatgcaattgacacaaaaaatcaggccgattctgtggtctaccagactgagaagcaactgaaggagcttggcgataaagtccccgctcccgtgaaagagaaggtggatgtgaagctccaggagctcaaaaggcaatatctggtggaatcacacagagtatgaaggatgccatgtctgctttgaaccanngagtgatgcagattggccangcaatgtataaccagtctggtgctagtgctgctgggcctactcctggtgctgaagctgggcctacccctggtaccggacagcgcagaatggatgggatgtcattgatgcngactc

SEQ ID NO: 51673 - DNA, 762 bp, Zea mays
  misc_feature: Ceres CLONE 1466668-F
  misc_feature: Encodes the peptide sequence at SEQ ID NO. 51674
  misc_feature (729)..(729): n is a, c, t, g, unknown, or other
tggagctccccgcggtggcggccgctctagaactagtggatcccccgggctgcaggaattcgcacgagaccattacctagaacatcctaatcgaaaacgaagacaccgatctcgcggacaaacttacaacatatggatatggcgacggcgaagctgaactccccggctaccagcttgctcgctggcggcgcgcacgcgccgatctgcgacccgcccgctgcacgacggtgatccgcgccgccgcaggctcctactcggacgagctcatctccaccgcgaagtctgttgcttcccctgggcgtggaattctggcaattgatgagtcaaatgcagcatgtggaaagaggttatcatctattggttgggacaacacagaattgaaccgccaggcttacaggcatcttttgctgacaactgctggtcttggtgaatatatttctggcgctattcttttcgaggacaccctttatcactcaactacccacggcaagaagtttgttgactgcttgaatgatcacaatatcatgcctggcatcaaggtagacaagggtttggttccattgcctgcatccaacaatgaatcatggtgccgaggtcttgatggtttggcttcaaggtgtgctgattactatgagcagggggcgcgcttctcaaagtggaggactgttgattagcatccttggggactatctccattacgcagcagggagcaacatggggacttgctcnatatgcggctatagcccaggaaatggctcagtc

SEQ ID NO: 51674 - protein, 49 aa, Zea mays
  misc_feature: Ceres CLONE 1466668-F
  misc_feature: SWISSPROT Homolog: EC 4.1.2.13 Fructose-bisphosphate aldolase
MPGIKVDKGLVPLPASNNESWCRGLDGLASRCADYYEQGARFSKWRTVD

SEQ ID NO: 51675 - DNA, 734 bp, Zea mays
  misc_feature: Ceres CLONE 1466670-F
  misc_feature: Encodes the peptide sequence at SEQ ID NO. 51676
aagctggagctccccgcggtggcggccgctctagaactagtggatcccccgggctgcaggaattcgcacgagaccattacctagaacatcctaatcgaaaaacacgatggttttgactggcgaacaggatctgaagcccctgtctggacctgtccgcgtctgggaagcggtcgacgtgggtggttatgcaggaaggccgaagacaatcaccgggttccggacacactccacggcggtcttgctcgcagcaggggacagagctgaactggcaactgaaaaatacattccactgaccccggtactagagggctgtgtgatcctgaacaagaacctgcagtaccaggaagagtgaagacccagatagcatgttggtgttcccgaggcccgtccagatatgcagcctcgaagccaaaccgtttgcgcggccttggatatctatcttgtttattgctcagcggcagagggatcctggtctctccttgcggggtccgtgtccatgattgattctaatgttacgggagctgtgtctaactgaaagagcggtctctggtgggcttaactcgcagtacgaccgtatttattaattactggaggacggttagaaagcttactctgtacagtgaggtgatgacatggtggcataggcgtagcgtacttttctttttggcgttcatctcgggcaatcgatatcatacatagtcccttgttttgactgtgtgcaacatcataatccg

SEQ ID NO: 51676 - protein, 81 aa, Zea mays
  misc_feature: Ceres CLONE 1466670-F
MVLTGEQDLKPLSGPVRVWEAVDVGGYAGRPKTITGFRTHSTAVLLAAGDRAELATEKYIPLTPVLEGCVILNKNLQYQEE

SEQ ID NO: 51677 - DNA, 837 bp, Zea mays
  misc_feature: Ceres CLONE 1466671-F
  misc_feature (369)..(369): n is a, c, t, g, unknown, or other
  misc_feature (371)..(371): n is a, c, t, g, unknown, or other
  misc_feature (812)..(812): n is a, c, t, g, unknown, or other
aaagctggagctccccgcggtggcggccgctctagaactgtggatcccccgggctgcaggaattcgcacgagaccattacctagaacatcctaatcgaaaaatcttcactcccctcccgcatttctgtccaccctcctggcctggccagccactgccgcaagcccgcaccgcaactgcagttgagtgagaccagttccgccccccctagataatcctcccctcctccagggacggcaggccgtgccgtgccgtcccgactgaccagaccagaccagaccagagagagctagtgcgtgccagcgcgctgtcgtaaagagagacttcgttctaaacctcccggtgagacgatggaacccgtcagtccatgncngcctcccggggggtcccccggccccccttgtatggccgttccctattttccccacccgccccccggctaaaggtcggggtccaattcgcccggggaaaaacccagaaaacgctcgggggggccccccccctttgggatcggacccctggccaaaattggtccggttaccccccccccccccaaattttttgcccccccccccccgggttttattctcgcaccgccccccctctccgccggagaggaaaaatcgcccccccataataagagggggcccccccaaaaaacccccttgggaaacaatgagaccccgtttttccccccaccaaagattgttttaaaaaaaaaaaagttggtggtgtcccccccccccccccccaaaaaaaaaaaccaggtgtttttttctccccccccccggccggggggggggaaaaaaaaaanccccccctttgttgttgtaaccccc

SEQ ID NO: 51678 - DNA, 748 bp, Zea mays
  misc_feature: Ceres CLONE 1466680-F
  misc_feature: Encodes the peptide sequence at SEQ ID NO. 51679
  misc_feature (723)..(723): n is a, c, t, g, unknown, or other
  misc_feature (727)..(727): n is a, c, t, g, unknown, or other
ctccccgcggtggcggccgctctagaactagtggatcccccgggctgcaggaattcgtctcacccctaatcgaaaatgttaacagaagcatattaatcttatgctaggtcggtgaatatccgcctctcctgccattcacccatgaggatttctcctcaagcggcgttggatggtggcattagagcccggatgcgccatcgggtgtttctgttttctcgaaaggagatcgtcgttttcggtatgttatggtcgctatgcctctgacctcctttagcccctgttcgtggccataagtcaacgggacacgcgtagctacaagaggaggtctagatgagcaaaggcctaggtttgtcgacgagtatgttatttttagtcaaagcgctagtcgtcgttcgacaattgtcagttcaactgctttaacatgcgacgcgtggggtttcctttcttagcttcccctgtgttgtagaagtatttgctgtgttgtgctagcacttgtttgtactctatgagctaccacatttatataaagtgctctgcctcgcttctctaagaaggagggtgctttcaacagaaataatcaaggagacgctcgcagctacccattcgccctatagtgagtcgtattacgcgcgctcactgggccgtctttttcaacgccgtgactgggaaaaccctgacgttacccaacttatgcgccttggaaaacatccccctttcggccgntggngtaaaaacgaacacgccgccc

SEQ ID NO: 51679 - protein, 40 aa, Zea mays
  misc_feature: Ceres CLONE 1466680-F
MRISPQAALDGGIRARMRHRVFLFSRKEIVVFGMLWSLCL

SEQ ID NO: 51680 - DNA, 769 bp, Zea mays
  misc_feature: Ceres CLONE 1466682-F
  misc_feature (749)..(749): n is a, c, t, g, unknown, or other
ctggagctccccgcggtggcggccgctctagaactagtggatcccccgggctgcaggaattcgtctcacccctaatcgaaaatttgccctgcagaaattccccctgggcgctggaggcgccaagctcgcgccggtgagcacctcccatggcgtggccatctccctgctgttgccagggccgacgagtccaagtcttgtctctagccttccttgccgactatggctgcccagcagctcgtcacctccctctctagtgcatgccccggctgtcatttccccacgccgagcgtgccctctcgccatcctttgccttgctgctcgcagctgagtttcctactcgtcgcagctcgcgcaccacctgttcgacgttatgcacagtagctgcatgtctcagattatcgcagcagcgagctccttcgccggcgcctgtccacaacagcagtcccgacgcgacactgtgacccttggtgaggcaccttgctgtcctagccgctggatcgagctttgtcccagcccgcagcttgctatcgtcgagtattgggcttgccgtcgatgtcgtgcttgtcatgcgcagcaagaaccacagcgccacgacttgttccagctcgacgagagcagccacatcgtcgtcgacccgtgcccttgtcgtcatgcctcgcgcattccatgctcgacgaaagccccaagctgtggacagcatgcggacatgcgcgacacgagtcggccaggaccgagtagatgatgatcgntgcaagtgatgtggtgccaa

SEQ ID NO: 51681 - DNA, 786 bp, Zea mays
  misc_feature: Ceres CLONE 1466683-F
  misc_feature: Encodes the peptide sequence at SEQ ID NO. 51682
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
tccccgcggtggcggccgctctagaactagtggatcccccgggctgcaggaattcgtctcacccctaatcgaaaaatcggattcaactcacctaccccaccccctcgattccttcccagctctggctacttcctacgccaccaccgcccgctccggcctcggctcctcgagcaagctgccatggctgccgccgcgctgagggagcaactcaacgctctcctctcctccatgttcgcctcgggtctggtggacgagcagttccagcagctgcagatgctgcaggaagacgggggcacgccgggcttcgtcgccgaggtcgtcaccctcttctgcgacgacgccgacaggatcatctccgagctcgccgctctgcttgaccagcccatcgtggacttttgataagcccacccctacctgcatcatctcaaagggagcagcgccagaacttgtacggcagaacatttttacttccccattcagcaaggtcagttgtcaacttcctgccgatgttggcggctcacaaagtgaatttacttgcatgcagttccgtcggttatgcaggaaagaacagagacggggcatcatggcattggctgttgtgagaatgattcatgatctgcgcataattcagacatgcttcactgagcacacccatcacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 51682 - protein, 72 aa, Zea mays
  misc_feature: Ceres CLONE 1466683-F
MAAAALREQLNALLSSMFASGLVDEQFQQLQMLQEDGGTPGFVAEVVTLFCDDADRIISELAALLDQPIVDF

SEQ ID NO: 51683 - DNA, 736 bp, Zea mays
  misc_feature: Ceres CLONE 1466686-F
  misc_feature: Encodes the peptide sequence at SEQ ID NO. 51684
  misc_feature (693)..(693): n is a, c, t, g, unknown, or other
aaagctggagctccccgcggtggcggccgctctagaactagtggatcccccgggctgcaggaattcgtctcacccctaatcgaaaaatacgccccaatcgccgccgccagagccgcggagctctccactcctctcttacccttcctctccccacccacgaagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggagccgcaggactgtgaaccgtccttatggtggagtactctctggaattgctgttagggagagaatcattcgtgctttcttggtcgaggagcagaagattgtcaagaaggtcctgaaaatacaaaaaaccaaggacaagacagctgcaaagtaaatctccaggaatggggaagcctagccctgttttgtacactgcgaaaattaattttggtggatggaaaatctaggtgccttgttgagcatttagcatgtgagtttagagattctggacactgaatccctttcacctttgaatngttggaatatcgggaatctggtccccctaggtgcttttattat

SEQ ID NO: 51684 - protein, 119 aa, Zea mays; identical to SEQ ID NO: 10753
  misc_feature: Ceres CLONE 1466686-F
  misc_feature (5)..(103): Pfam Name: Ribosomal_L34e Pfam Description: Ribosomal protein L34e

SEQ ID NO: 51685 - DNA, 770 bp, Zea mays
  misc_feature: Ceres CLONE 1466689-F
  misc_feature: Encodes the peptide sequence at SEQ ID NO. 51686
aaagctggagctccccgcggtggcggccgctctagaactagtggatcccccgggctgcaggaattcgtctcacccctaatcgaaaacactctacccgcacagcgcccctcgcccccacaccccaacccaaccatccgctccttgtcgccttccgacgctgagtttgctggtgtcgatttgcgccggcggatgctcgatctggtagctgcatgtgccgacctactcgtcgaatccgttatctaacgtaatggatgggcaaggcacaaagcacaggattttgatggtgtccgactttttctttccaaactttggtggggtggaaagccatatctactacctgtcacaatgtctacttaagcttggccataaggttgttgtcatgacacatgcatatggaaacagatctggagtacgatatgtcacaaatggtttaaaggtctattatgtaccatggaggccattcctgatgcagaatacacttcctacactatccttgacgtttccaattgtaaggacaattattattcgagagaagatttctgtcgtgcatggacatcaagctttttcaacactgtgtcatgaagcattaatgcatgctaggacaatgggatattgatcaggcaatatgtgtctcacatacaagcaaagagacactgtcttggagtctgggatatctccagagaaagttttcatggttcctaatgcagttgacactggcatggttactccctctcccaggcgctttaactgtgatgaaatagttatggttt

SEQ ID NO: 51686 - protein, 122 aa, Zea mays; identical to SEQ ID NO: 47963
  misc_feature: Ceres CLONE 1466689-F
  misc_feature (47)..(122): Pfam Name: PIGA Pfam Description: PIGA (GPI anchor biosynthesis)
  misc_feature: SWISSPROT Homolog: EC 2.4.1.198 Phosphatidylinositol N-acetylglucosaminyltransferase

SEQ ID NO: 51687 - DNA, 770 bp, Zea mays
  misc_feature: Ceres CLONE 1466693-F
  misc_feature: Encodes the peptide sequence at SEQ ID NO. 51688
  misc_feature (635)..(635): n is a, c, t, g, unknown, or other
aagctggagctccccgcggtggcggccgctctagaactagtggatcccccgggctgcaggaattcgtctcacccctaatcgaaaaaggccgcgccgccccagcaaatctcacgcacagaaacaccaaagccccaaaggcccaaactcaccacctcccaatggagaacggcgacgaaaccctcgcctcccccacagccgcctccgagacggacgcgctccacggcggcatcacgcatgaggatcaagtccccatcacccaccccgcaaagtcctacgtcacgctagccgacgaccaccccgctcctaacggcggcctcctgaaacacgaggagggcggtgcccacaccaccgcgaagtcctacgcagctgtcgccgcccaaaccgagatcgaggacctccgcgccgccaagctcgacctggaagagaagctcgctgaggcccaccgtgagaacaactccttcgccgaggagacgcaccgcagcgaggggatcttcgcgcaggcccggaaggaggtcaccatcaactagttcgccaccacctctgccgataaggacgtcgcctcgctccgcacggaggtcgaatgcctcgatgctgttctcaagatcgataagggctatcacgaactggacacgcanagactccatgaggtctcccaggaggtggatgccgtgcgccatgagaactcaagctacgagatgagatcatacccctgaatgcttccgcaccgcaagctgagccacaaatgaaggtcatctgcacctgcctctgag

SEQ ID NO: 51688 - protein, 122 aa, Zea mays
  misc_feature: Ceres CLONE 1466693-F
MENGDETLASPTAASETDALHGGITHEDQVPITHPAKSYVTLADDHPAPNGGLLKHEEGGAHTTAKSYAAVAAQTEIEDLRAAKLDLEEKLAEAHRENNSFAEETHRSEGIFAQARKEVTIN

SEQ ID NO: 51689 - DNA, 751 bp, Zea mays
  misc_feature: Ceres CLONE 1466704-F
  misc_feature: Encodes the peptide sequence at SEQ ID NO. 51690
  misc_feature (690)..(690): n is a, c, t, g, unknown, or other
ctggagctccccgcggtggcggccgctctagaactagtggatcccccgggctgcaggaattcgtctcacccctaatcgaaaactcctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctcacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcggcaccggcatgtacgctgcgccgctctcggtcatgaaattggtgatccagacnaagagcgtggaatacatgcccctggtcctgtccctggctccctcggcacagcatctgctgg

SEQ ID NO: 51690 - protein, 179 aa, Zea mays
  misc_feature: Ceres CLONE 1466704-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVSVFFGTGMYAAPLSVMKLVIQTKSVEYMPLVLSLAPSAQHLL

SEQ ID NO: 51691 - DNA, 720 bp, Zea mays
  misc_feature: Ceres CLONE 1466706-F
ggagctccccgcggtggcggccgctctagaactagtggatcccccgggctgcaggaattcgtctcacccctaatcgaaaaaaattagacggataatatcgtcctccgcgggacaaggcacctcacgagcccttctcgtcctcagatctagcgccgcctccttcaccctgctgctggccgcctggccggcgagctcctcagcgtggaagaagacaaaaaacgttatagtgaagaggaggggttgattgctgcattcaaaagtgtcggggataccttatccaatgctactgagaaggttgccacaggggacactgatgtgccagatgatctttttatagtttgataaacctttcaggttttgagcagacccacatatctctgtatttcaattatctggtggcgcaccctcacattgctagagccttcaacaagttgtcattccaccacaagttaatctgggctcgcaatttcgtcagtgaaaactacctaggagagtgaggacacttggtacgtaggcttggagggttcttttgcttgaacccatagaacaatgaactgcgatctatgtgtaaccagtactgtgagggcagttagtagataggcttggacggttcttttgcttgaactacatataacaatgaaatgtcgtctaagtatgtcagcggattttgcttgaactgcagattttgtggaagcctaaacttggtattatgtgcaatgc

SEQ ID NO: 51692 - DNA, 748 bp, Zea mays
  misc_feature: Ceres CLONE 1466707-F
  misc_feature: Encodes the peptide sequence at SEQ ID NO. 51693
ctccccgcggtggcggccgctctagaactagtggatcccccgggctgcaggaattcgtctcacccctaatcgaaaaactgccgtcttcactgctgccaggcgccagccacggcccacggccaatgcaattgcagttgcagttgcaattgcacggcacccatttccagagccgtcctcaattagctagtcaaatctcgctatcctttccccaccatccagatcttccctttcatggacgccgccgtctccaccctcaccgctctcgccatcttcgcgagcaccgtcgagcacggtcggtgcaggcctccgccacgctttctaaattgcttccctcccggtcccggggcaccgcacgacatgaacccacagctgcagtatctgtctaatctgtacaatgacctgctgatggtgtttcggtttcgagaagagaaaacggtcccacaactcgttaattcaaagcaacccatccgttgtggtgaacaggggaaaacttctgatttgggtgatgcatcggagtccgattcggatggggattgtcaatctggcaaagaacttgcaccaccagttcagaagcatacaagagccaaccggaagcatatagatagcattactttagttgatatagctcagtacttccatcttccaatccgagatgcatcaaagacactcaagattggggtcagcatattgaagaggaaatgccgacagtatgggatacctcgttggcctcaccggaagaatcagtcat

SEQ ID NO: 51693 - protein, 172 aa, Zea mays
  misc_feature: Ceres CLONE 1466707-F
  misc_feature (122)..(172): Pfam Name: RWP-RK Pfam Description: RWP-RK domain
MDAAVSTLTALAIFASTVEHGRCRPPPRFLNCFPPGPGAPHDMNPQLQYLSNLYNDLLMVFRFREEKTVPQLVNSKQPIRCGEQGKTSDLGDASESDSDGDCQSGKELAPPVQKHTRANRKHIDSITLVDIAQYFHLPIRDASKTLKIGVSILKRKCRQYGIPRWPHRKNQS

SEQ ID NO: 51694 - DNA, 759 bp, Zea mays
  misc_feature: Ceres CLONE 1466715-F
  misc_feature: Encodes the peptide sequence at SEQ ID NO. 51695
  misc_feature (562)..(562): n is a, c, t, g, unknown, or other
  misc_feature (594)..(594): n is a, c, t, g, unknown, or other
  misc_feature (683)..(683): n is a, c, t, g, unknown, or other
  misc_feature (684)..(684): n is a, c, t, g, unknown, or other
  misc_feature (689)..(689): n is a, c, t, g, unknown, or other
  misc_feature (751)..(751): n is a, c, t, g, unknown, or other
aaactggagctccccgcggtggcggccgctctagaactagtggatcccccgggctgcaggaattcgtctcacccctaatcgaaaaccggttccccgcggcatactctttcctgcgctctctctctcggttctgccgtgttcctcgcgtgcgctgtgtctccggtggcgccgcctccgccgcctccgtcgccctgcgccagattcgtggatatggctgataatgagaaagaagtgggggagggaaccaccccccgaggggcggattgggaagttgtgactctcacagcatctgcctatgaagcggcgccaggacctgtcggaacagaagtaaagcctgttaatgaaaatcaagagcatagttcatccaatgcactgctcatgtctgaccactttgtgtttccgccgagtgagcacgagaacctgccaatacaaaccagtttcgatgagatacagcctgagaaggatgtgcagaaacctagtaccactgtggaggattatagtattaagaatgttgttgggtctgagagagttcagtttgatgatgaagggaaagacctcttanatgatgatgtggagatgagagatgacacaccntgggtacggttcatcccacgctgaaatgatgcacatggttttgttgttcacgatgatgggtgttgagtcccgtgaagattttgatgaannatcangccacccttcagatcctgcagacagcaggagctgtgatactggcgccctcatgcaatgttgnttgaagaa

SEQ ID NO: 51695 - protein, 135 aa, Zea mays
  misc_feature: Ceres CLONE 1466715-F
  misc_feature (118)..(118): Xaa is any aa, unknown, or other
MADNEKEVGEGTTPRGADWEVVTLTASAYEAAPGPVGTEVKPVNENQEHSSSNALLMSDHFVFPPSEHENLPIQTSFDEIQPEKDVQKPSTTVEDYSIKNVVGSERVQFDDEGKDLLXDDVEMRDDTPWVRFIPR

SEQ ID NO: 51696 - DNA, 742 bp, Zea mays
  misc_feature: Ceres CLONE 1466717-F
  misc_feature: Encodes the peptide sequence at SEQ ID NO. 51697
  misc_feature (742)..(742): n is a, c, t, g, unknown, or other
tccccgcggtggcggccgctctagaactagtggatcccccgggctgcaggaattcgtctcacccctaatcgaaaactcttcgcttctaactccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaaaaagagcgacaacaccaagtactacgagatcctcggggtgcccaagtcggcgtcccaggacgatctcaagaaggcctaccgcaaggctgctatcaagaaccaccccgacgagggcggtgaccccgagaagttcaaggagctcgcacaagcctatgaggttttgagtgatccagagaaacgtgagatttatgatcagtatggtgaaaatgcccttaaggaaggaatgggcggtggaggatcccatgttgatccatttgacatcttctcatcattttttggaccctcttttggaggaggtggtggaaaccgccggggaaaacgccaaggaggggaaaaaatgtatttcaccccacttaagtttctctgggaaaatctttacaatgggccctcaaaaaagctctctctttcgcgcatgtgctctggctccaagggcaggggcaagggctccaaatccggtggccccaaggggagggccctgggtn

SEQ ID NO: 51697 - protein, 167 aa, Zea mays
  misc_feature: Ceres CLONE 1466717-F
  misc_feature (13)..(71): Pfam Name: DnaJ Pfam Description: DnaJ domain
MFGRAPKKSDNTKYYEILGVPKSASQDDLKKAYRKAAIKNHPDEGGDPEKFKELAQAYEVLSDPEKREIYDQYGENALKEGMGGGGSHVDPFDIFSSFFGPSFGGGGGNRRGKRQGGEKMYFTPLKFLWENLYNGPSKKLSLSRMCSGSKGRGKGSKSGGPKGRALG

SEQ ID NO: 51698 - DNA, 830 bp, Zea mays
  misc_feature: Ceres CLONE 1466718-F
  misc_feature: Encodes the peptide sequence at SEQ ID NO. 51699
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
nccggggccccnnnnnnnntnnnnnnnnnnnnnnnnnnnnnnnnnnttttttnnnnnnaaaactgggactccccgcggtggcggccgctctagaactagtggatcccccgggctgcaggaattcgtctcacccctaatcgaaaagttgggtagtagtaaaaccaggtaggtgtggctggctcgtgcagcggcggcagtgagagcgatgagcgcggcggcggcggcgagctcggtcaccaagttcatcaaatgcgtcacggtcggcgatggggccgtcgggaagacctgcatgctcatctgctacacctgcaacaagttccccacggattatatccccaccgtattcgacaacttcagcgccaatgtctccgtgggtgggagcatcgtgaacttgggcctctgggacacggcaggtggggggtggggcgacatagattgtcaactagtgtttccatctcttctgttttctgccgcaaaccgccggtttggatgcaggccaggaggattacagcaggttgaagcctctcagctacaggggtgccgaggggttcatcctccccttctccctggtcagcagggcgagctatgaaaaccgcctcaagaaagtggatggccgaactttccccgattttcacctactggtccctggagttctggttggacccaaactagaatctccgtgaaaacagatctaacccttggggaccattcggcggggttccatcctccccccggaacggggaaaaaaacctcaggaaaccaaatagggcgctgttgggctaactagaaatcgccctcccgaaaccccaggggaaccgctaagggcttgc

SEQ ID NO: 51699 - protein, 127 aa, Zea mays
  misc_feature: Ceres CLONE 1466718-F
  misc_feature (15)..(122): Pfam Name: Ras Pfam Description: Ras family
MSAAAAASSVTKFIKCVTVGDGAVGKTCMLICYTCNKFPTDYIPTVFDNFSANVSVGGSIVNLGLWDTAGGGWGDIDCQLVFPSLLFSAANRRFGCRPGGLQQVEASQLQGCRGVHPPLLPGQQGEL

SEQ ID NO: 51700 - DNA, 774 bp, Zea mays
  misc_feature: Ceres CLONE 1466726-F
  misc_feature: Encodes the peptide sequence at SEQ ID NO. 51701
ctggagctccccgcggtggcggccgctctagaactagtggatcccccgggctgcaggaattcgtctcacccctaatcgaaaaatcggactcatctccttcgattcagcagaggacagcgctctgcctctccactacttgacagccacggatccttccatccctcgcctagcgaacagacccggctggccatcctcaacgcacccctcccattttccattcggatgtatgcgtgggtgaccagcacatcgaggagttccacaagcacacatgaggtatctgaaactgaatccaaagtacgaagtcagtaatgaggagtgtgtctctctcaggcttgaactgtcgcagagttcagtgaaactcgacactatctttgaggcatctttcaagttcatgatatatgatcagttaatcggaaagcacaaggtgcatctaggtaaccacagcttccagactgcaagtacgagctctgccatcgcattcatgttacctctgaaagcactcagacaatcctctagatttattgtcaataacagctgcgtatttggcattggcttcatcaaagttgccactatcaaagttaacacgacgctagaaacactgtttgtcaggaagatgaacatcttcaacgaggccaaagtttacacttggaaaatcgaggatttctctgctctgaagaacccgtcccactcaccggagtttgagatcgctggatacacatggattatctctttgaatccatcctacgatggtaacagcctgtccttattcctgaa

SEQ ID NO: 51701 - protein, 168 aa, Zea mays
  misc_feature: Ceres CLONE 1466726-F
MRYLKLNPKYEVSNEECVSLRLELSQSSVKLDTIFEASFKFMIYDQLIGKHKVHLGNHSFQTASTSSAIAFMLPLKALRQSSRFIVNNSCVFGIGFIKVATIKVNTTLETLFVRKMNIFNEAKVYTWKIEDFSALKNPSHSPEFEIAGYTWIISLNPSYDGNSLSLFL

SEQ ID NO: 51702 - DNA, 765 bp, Zea mays
  misc_feature: Ceres CLONE 1466733-F
  misc_feature: Encodes the peptide sequence at SEQ ID NO. 51703
  misc_feature (397)..(397): n is a, c, t, g, unknown, or other
  misc_feature (419)..(419): n is a, c, t, g, unknown, or other
aaagctggagctccccgcggtggcggccgctctagaactagtggatcccccgggctgcaggaattcgtctcacccctaatcgaaaacttcttcttttctgtttctttttctccccctccagccgcccgtcctctcggtctccgaccacgactgtgcgccttcctaagtaaccctagctcggcgccctccctccgcgacatccaagcccggcaatctcatcgtcgcgcttgcaccgttacgcagtgcgacctctgcgtcttcgaatccaggaaggtagagaggaggaggaggtttgtggcaggatttgaccagcccaatggttccatccgagatggggagcgtcgccaccgccgtcagcacgcctgctgcggacaagctgctccatgggcggatctcngccaacaagtgcaagaaaccangcccgaggaagattcataaggctgagagggagaagcttaaacgagaccaccctaatgatctctttgttgagctgggtaatatgctagaagcagatagacggaacagtgggaaagcatggctactgactgaccctactcggaatataagaagacttgcttgttcaagtaaactctcttcgaaaggagataccgacctacaaaaccaatctcatttatgtaacaatgaaaagggatgaagagcacggaagaaaacggcgtgcctcccaaagaaatttccaaacttcaaaacaagtttacgatggggggtttccaggcagcccagcaagttggggcgctggcaaccccc

SEQ ID NO: 51703 - protein, 112 aa, Zea mays
  misc_feature: Ceres CLONE 1466733-F
  misc_feature (35)..(35): Xaa is any aa, unknown, or other
MVPSEMGSVATAVSTPAADKLLHGRISANKCKKPXPRKIHKAEREKLKRDHPNDLFVELGNMLEADRRNSGKAWLLTDPTRNIRRLACSSKLSSKGDTDLQNQSHLCNNEKG

SEQ ID NO: 51704 - DNA, 756 bp, Zea mays
  misc_feature: Ceres CLONE 1466734-F
  misc_feature: Encodes the peptide sequence at SEQ ID NO. 51705
  misc_feature (728)..(728): n is a, c, t, g, unknown, or other
  misc_feature (735)..(735): n is a, c, t, g, unknown, or other
ctccccgcggtggcggccgctctagaactagtggatcccccgggctgcaggaattcgtctcacccctaatcgaaaattcctcgtgcccgtcccctcaggcgctcttgctggttctggaagccggagcatcggcgctgtcgctcaggtctgtccattcccctccaaagccctaaagctaggcttcctgtgctaacccgaatcaagcaagccccgtcaacctcccccgccgtcgtcttcttctctgttgctctcctctccaccgggtccccatctcctcccttcaccgccccagaactcctcactcgggcgctgccgctgcgaggtctccgtggcatcgggccttcgtcattacgcagcagacgaagcagtgggaaacttggaactgcatgcacccaaggcaaaacgtcggtcatatatcccaacgaaaaatggaacagccatgatgcttccgctccatattcattacgaagatgtactacgtcaggatctgttgctcaaacagaatcatgccaatatcatgcaagttccagggttgtttgaggtcaaattagcaccaaaagctggctctgatctcaagatcccaattgggaaaatggccatggaggttttgagtggtcagagattcaaagaggcaaaaattgaccctttcgccaaagcaagaaagtcttctcgaaccaatccatttattggggccgacaaggacagtagcactgtcttcgcgcaacaanctgttcntcgagggcatgcaatgtacaa

SEQ ID NO: 51705 - protein, 105 aa, Zea mays
  misc_feature: Ceres CLONE 1466734-F
  misc_feature (97)..(97): Xaa is any aa, unknown, or other
  misc_feature (99)..(99): Xaa is any aa, unknown, or other
MMLPLHIHYEDVLRQDLLLKQNHANIMQVPGLFEVKLAPKAGSDLKIPIGKMAMEVLSGQRFKEAKIDPFAKARKSSRTNPFIGADKDSSTVFAQQXVXRGHAMY

SEQ ID NO: 51706 - DNA, 754 bp, Zea mays
  misc_feature: Ceres CLONE 1466737-F
  misc_feature: Encodes the peptide sequence at SEQ ID NO. 51707
aagctggagctccccgcggtggcggccgctctagaactagtggatcccccgggctgcaggaattcgtctcacccctaatcgaaaaagagaaacacctctgagcattctaaagctcatacccctctccttccagagcatttcacatcggtctcatctccacctgcttgcatccagcgcctcgtcactctgcaaaacaacagcacatacctccaaaggatgagccgcagcaacaggaagagctctaggggccttgacctgaaactgaacctctcacttcctgcaacaggggactcctccaggagggcgatggctgatgaggagtcatccccgagctcctgcctatcgtcatagaacgagcatggcctgcagtgatccaacagccctgaggccacatccatggttcttgctgcctgtcctcgctgcttcatctacgtcatgctcccacaagatgaccctcggtgcccccagtgcaagagccctgttctccttgactttctgcacgacaaccacaacagctgtaggaacaacagtaataatagctgcaagacgagcatgaggcgatgagcaatatggttacataggcggcacgacatctacaaaataatttatatgaagtcctaggtccagtagttctatttgcctagtcattgcttcagtgtaactgtgatatatccattctaaaactgcgagctagcacccttgcgttagtatcgcaattttgatatatcaccgatacgctgagtgaggctgataa

SEQ ID NO: 51707 - protein, 55 aa, Zea mays
  misc_feature: Ceres CLONE 1466737-F
MVLAACPRCFIYVMLPQDDPRCPQCKSPVLLDFLHDNHNSCRNNSNNSCKTSMRR

SEQ ID NO: 51708 - DNA, 753 bp, Zea mays
  misc_feature: Ceres CLONE 1466738-F
  misc_feature: Encodes the peptide sequence at SEQ ID NO. 51709
ctggagctccccgcggtggcggccgctctagaactagtggatcccccgggctgcaggaattcgtctcaccccctaatcgaaaaagaaaaaaaatatttgtttggtgagccacgctcccatccggatccgcgggggaggacggcgatttcgtccccagcctcatgaggtcgggaaggggttcccgcacccacatttgtgaacctcgccggcgcccatcccctgccttcacgaacccgccgccgcccgtcccctactcttcctcgtgcacccaccgtcgctcgtcccctcgtcttccttgcgcactcgccgtcgcctcctcctcaccctcacgcacttgaggccagctgcagaacgaggtcggacggcggagacgaggtcgaggtctacgacctcctcaacttgcgcaagactgccgagactgcagggacaagctctttgctgcctcgtcagctgctagctgacttctcgtgatacacaagggtttttcatcaacaagtggtcgccagaagaactgaaacatcaagatggcgtttgcttttaggtcatgccattcaggagatgatgctaagctaaataatcacatctatgtgtacactgagactgttttattatgagactatgttttattatgatgcactgagactatgtttgtgtacactgagactgttttattatgatgcactgagactgttttattaagcagtgtggagttctcggctgctgttctcatttttaatgcaagtgtgttcaatg

SEQ ID NO: 51709 - protein, 58 aa, Zea mays; identical to SEQ ID NO: 46606
  misc_feature: Ceres CLONE 1466738-F

SEQ ID NO: 51710 - DNA, 768 bp, Zea mays
  misc_feature: Ceres CLONE 1466740-F
  misc_feature: Encodes the peptide sequence at SEQ ID NO. 51711
  misc_feature (758)..(758): n is a, c, t, g, unknown, or other
ggagctccccgcggtggcggccgctctagaactagtggatcccccgggctgcaggaattcgtctcacccctaatcgaaaaaaactaaaaataattcagcgacagatatcttcgactcctcgttcgtggttccccatcgtcatcgccatggatttctcttaggctcacccgtccgctcagctcgcttccttccccactctctctgatcccgtcgcacttccctcctcgctgcagcccctctattattgcgattaccgtttcctcactgccctttcctttttcggtcggcagcaatcaccggggcaagcgaaccctcgatttgcgtccccgctctctgctagcgcccctaaaagaggagcgaagcgatgtctatgccggagacgggtcaggccgcggagagggatgagcagcaacagtcccgagggatagcactgatgcagggcatctgcgccgtggtgtaccgcaaggccgataacacgccctgccccatcaagcagggtctctacttgggatctgttggagcagcattcaataaggacgctctcaagagcttgaacatcacccatatcttgatcgttgcaaagtcactggatccagtatttccagctgaatttaattacaagaagatcgaagtacttgatatcccagacactgatctgttaaagcattctgatgaatgctttggtttcatagatgaagctataagctctgggagcaatgttttggtccattgctttgctgggcggtcaagagtgtgancatcgttgtt

SEQ ID NO: 51711 - protein, 130 aa, Zea mays
  misc_feature: Ceres CLONE 1466740-F
  misc_feature (38)..(131): Pfam Name: DSPc Pfam Description: Dual specificity phosphatase, catalytic domain
  misc_feature: SWISSPROT Homolog: EC 3.1.3.48 Protein-tyrosine-phosphatase
MSMPETGQAAERDEQQQSRGIALMQGICAVVYRKADNTPCPIKQGLYLGSVGAAFNKDALKSLNITHILIVAKSLDPVFPAEFNYKKIEVLDIPDTDLLKHSDECFGFIDEAISSGSNVLVHCFAGRSRV

SEQ ID NO: 51712 - DNA, 747 bp, Zea mays
  misc_feature: Ceres CLONE 1466741-F
  misc_feature: Encodes the peptide sequence at SEQ ID NO. 51713
  misc_feature (679)..(679): n is a, c, t, g, unknown, or other
  misc_feature (721)..(721): n is a, c, t, g, unknown, or other
ggagctccccgcggtggcggccgctctagaactagtggatcccccgggctgcaggaattcgtctcacccctaatcgaaaaactcgcacgccgccttcaattcatccccctgtgcagcaggcccagccggacgctctctcctgatcttcctccgccgtctcctcctgtcacccgcttgctttgaatccccttcttctgctccgccatcgcgacgcgccgacatgactgggtcttctaagaagcatgacctcaaatctaagcaaaaattggaaaagaagattagtttttacacaaaagtaaaagatgcagttacttccttaaatgctaagaagactgtcagtaagaaaaataaacagagtcggcgccagaagaaacttaaagcatacgatctgtcggcactttctgagttcctcccagaaccagctgcaccagagcagaagactgaagcaaagctgaactgcaagtcaagacagacattagtgttgcaggagtctgctcatcttaaggctgtactggacaacccgcagttccagcttgacccatttgctgcgatccatcagcacctgctggcaacgcagccgcctgcagctgcaaagaaggacgacacagcggggaatcaggggaaggttttcaaggacaagacaagcacgaggaagaaaggcacatcgtcaatctctcangcaatggatatctgatttgtgtccttcagtactagtaacttngtccgatgtcgactgcccgtgatcac

SEQ ID NO: 51713 - protein, 157 aa, Zea mays
  misc_feature: Ceres CLONE 1466741-F
  misc_feature (153)..(153): Xaa is any aa, unknown, or other
MTGSSKKHDLKSKQKLEKKISFYTKVKDAVTSLNAKKTVSKKNKQSRRQKKLKAYDLSALSEFLPEPAAPEQKTEAKLNCKSRQTLVLQESAHLKAVLDNPQFQLDPFAAIHQHLLATQPPAAAKKDDTAGNQGKVFKDKTSTRKKGTSSISXAMDI

SEQ ID NO: 51714 - DNA, 737 bp, Zea mays
  misc_feature: Ceres CLONE 1466742-F
  misc_feature: Encodes the peptide sequence at SEQ ID NO. 51715
ggagctccccgcggtggcggccgctctagaactagtggatcccccgggctgcaggaattcgtctcacccctaatcgaaaaccacaacgagagcagagcaggcaagacagctcgcaccagcggtccatccatccccatggcgcccgccttcggccgctccatctccttcccgctgagcccggcacgctcctcctcctccacgaagcaggcgcgccacgtgcgctccatcagcctcccgacctgccgcgcgcacccgctgctcgcccacctccacgccacagcccgcgccgcccgcgcctgggccgccgccaccgccgacccctgaaccaccaccaccacctccccgtcctcgggcctcacccacctcgccgcgctccaggccgagctcgccgagctcctcgacctccctgagccccgcgccgcgctcgctacagcctgcgccaccgccttctcggaccgcctcctggacggcctcctgtcactggcccacgcgcacggagcgtatcgagagacgctggtcgacctctagcgccgcgccgccgatgcccatgccgttcagcgcatccgcaacgcgactcgcctctggtgggccatcctcgcgccgccctggacgagaaaggcctgacccgcctaccctactctgtgcgaagagacacctgtgcagcttgctggatgccactgccagaagcgacggccgcaaagcctgagtagccgggaagctccctgatgccctgggcg

SEQ ID NO: 51715 - protein, 62 aa, Zea mays
  misc_feature: Ceres CLONE 1466742-F
MAPAFGRSISFPLSPARSSSSTKQARHVRSISLPTCRAHPLLAHLHATARAARAWAAATADP

SEQ ID NO: 51716 - DNA, 752 bp, Zea mays
  misc_feature: Ceres CLONE 1466743-F
  misc_feature: Encodes the peptide sequence at SEQ ID NO. 51717
  misc_feature (623)..(623): n is a, c, t, g, unknown, or other
ctccccgcggtggcggccgctctagaactagtggatcccccgggctgcaggaattcgtctcacccctaatcgaaaagagtgaggagtctgtgtgaccagtgctcgccgtcgtcccctgcctctggccctctgctagccgctaggcgacgggcctttcgccgggcgacgggcacaccgcccctgttaccatggcagcgatgaatactggtatgggaggtttaggtggcaggccgatacatccacaagcaaatccttttggaactgccttgcagggtgctggaccaggattgatccgtactgggctagaaacatatggcggaaggattttagattcaagttctgagtttatgcagagcaatataacacaatatttgtccgaccctcagtactactttcaagtcaacagccagtatgtgaggaacaaactgaaggtcatcttgttccctttcttgcacaggggtcactggacaagaataactgaaccagtaggaggaaggctatcctacaaacctccagtccaggatatcaatgcaccggacttgtacatccctttgatggcatttggcacctacattgtagctgctgggtatgccttgggtgttcttgggaggtttacccctgangcactggacctacagttttctaaagggtactttgggtggttccttgcagtcgtcctcatcaaaggtctgctgtactccctgggaagcgccaagctcccttgctgacatcgtggcgtaatgctgatattc

SEQ ID NO: 51717 - protein, 179 aa, Zea mays
  misc_feature: Ceres CLONE 1466743-F
  misc_feature (34)..(180): Pfam Name: YIF1 Pfam Description: YIF1
  misc_feature (145)..(145): Xaa is any aa, unknown, or other
MAAMNTGMGGLGGRPIHPQANPFGTALQGAGPGLIRTGLETYGGRILDSSSEFMQSNITQYLSDPQYYFQVNSQYVRNKLKVILFPFLHRGHWTRITEPVGGRLSYKPPVQDINAPDLYIPLMAFGTYIVAAGYALGVLGRFTPXALDLQFSKGYFGWFLAVVLIKGLLYSLGSAKLPC

SEQ ID NO: 51718 - DNA, 741 bp, Zea mays
  misc_feature: Ceres CLONE 1466745-F
  misc_feature: Encodes the peptide sequence at SEQ ID NO. 51719
ctggagctccccgcggtggcggccgctctagaactagtggatcccccgggctgcaggaattcgtctcacccctaatcgaaaacatttccctggaacatccagtctccaagactcgaacaaaacggggcagagtcaccctgctgaagaattggatctttcctgagtactattttgctaacatgacgagttaattatcgcagaggaggtacggctgccgcgctatgatgctggaaacggtggctgcggtaccggggatggtgggcggcatgctgcttcacctgcgctcgctccgccgcttcgagcacagcggcggctggatccgggcgctgctggaggaggcggagaatgaacgcatgcacctcatgaccttcatggaggtggccaagcccaagtggtacgagcgcgcgcttgtcctcgccgtgcagggcgtcttcttcaacgcctacttcctcggctacctcatctcccccaagttcgcgcaccgtgtcgttgggtacctcgaggaggaggccatccactcatataccgaatacctcaaggacctcgaggccggcaagatcgagaacatccccgcgccggccattgccatcgactactggcagctcccagctgatgcgacgctcaaggatggggtttgggccgtggtgcgctccgatgaggcgcaccaccgcgacgtcaatcactttgcgtcggacatacatttccagggtatgcagctcaaggagacacctgcgccgattg

SEQ ID NO: 51719 - protein, 173 aa, Zea mays
  misc_feature: Ceres CLONE 1466745-F
  misc_feature (1)..(173): Pfam Name: AOX Pfam Description: Alternative oxidase
MMLETVAAVPGMVGGMLLHLRSLRRFEHSGGWIRALLEEAENERMHLMTFMEVAKPKWYERALVLAVQGVFFNAYFLGYLISPKFAHRVVGYLEEEAIHSYTEYLKDLEAGKIENIPAPAIAIDYWQLPADATLKDGVWAVVRSDEAHHRDVNHFASDIHFQGMQLKETPAPI

SEQ ID NO: 51720 - DNA, 758 bp, Zea mays
  misc_feature: Ceres CLONE 1466746-F
  misc_feature: Encodes the peptide sequence at SEQ ID NO. 51721
  misc_feature (700)..(700): n is a, c, t, g, unknown, or other
ggagctccccgcggtggcggccgctctagaactagtggatcccccgggctgcaggaattcgtctcacccctaatcgaaaaaaactgtcaaaacggggacacaggccagatggtgcttctgcgcgtttgccgtcacttcggccacctgcgcttcgcctccttcctctcaatggcggcgccccagcaatccgctcccctgtccgggtcggcgcccaagaggctcagggcgatggccacagacgccgctgcagtgccgaatcccccagcctctagtggctgccccgcgatgaaggcggagttcgccaagcacgccgagtacctcaacaccctgaatgacaagagagaaaggcttgtgaaagctagtcgggatattacaatgaacagcaaaaaggtcatctttcaggtccacagggacgaagttctctcgaaggcagaaaatgatcttgctgcagttgttaatcaatacattgcaaaactagtaaaagaattacaaggaactgacttctggaaactcagaagagcctacacctttggtgtacaagaatatgtcgaagctgcaacactctgtagattttgcaagactggcactctattaagccttgctgacatcaatgattctttactagcactaagtggtcaatctgttgagcccttacagttaaatgtgcttgactatcttttaggggttgctgatttgtccngagagcttatgaagctcgcaataggccgtatatctggatggggaagttgaatatgcaa

SEQ ID NO: 51721 - protein, 213 aa, Zea mays
  misc_feature: Ceres CLONE 1466746-F
  misc_feature (75)..(213): Pfam Name: Translin Pfam Description: Translin family
  misc_feature (198)..(198): Xaa is any aa, unknown, or other
MVLLRVCRHFGHLRFASFLSMAAPQQSAPLSGSAPKRLRAMATDAAAVPNPPASSGCPAMKAEFAKHAEYLNTLNDKRERLVKASRDITMNSKKVIFQVHRDEVLSKAENDLAAVVNQYIAKLVKELQGTDFWKLRRAYTFGVQEYVEAATLCRFCKTGTLLSLADINDSLLALSGQSVEPLQLNVLDYLLGVADLSXELMKLAIGRISGWGS

SEQ ID NO: 51722 - DNA, 716 bp, Zea mays
  misc_feature: Ceres CLONE 1466748-F
  misc_feature: Encodes the peptide sequence at SEQ ID NO. 51723
  misc_feature (716)..(716): n is a, c, t, g, unknown, or other
gcggtggcggccgctctagaactagtggatcccccgggctgcaggaattcgtctcacccctaatcgaaaaaacaagtctctcggccaggtctccctctccccggctctccgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacaccgctggccaggaaaggtttcagagtcttggtgttgcattctaccggggagcagattgttgtgtcctagtctatgatgttaattctatgaaatcatttgacaacctgaacaactggcgagaagagtttctaattcaggctagcccatcagatcctgataatttcccttttgttctgttgggtaacaaagttgatgtagatggtggcaacagcccgcgtggtatctgagaaaaagcaaaggcatggtgtgcttgcaaaggggacatcccgtactttgagacgtctgctaaggacggaacgaatgtggaagacgctttccgtgtatcgtgaagaacgcctctgagaatgacccagagan

SEQ ID NO: 51723 - protein, 138 aa, Zea mays
  misc_feature: Ceres CLONE 1466748-F
  misc_feature (10)..(136): Pfam Name: Ras Pfam Description: Ras family
  misc_feature: SWISSPROT Homolog: EC 2.7.11.1 Non-specific serine/threonine protein kinase
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSPRGI

SEQ ID NO: 51724 - DNA, 705 bp, Zea mays
  misc_feature: Ceres CLONE 1466750-F
  misc_feature: Encodes the peptide sequence at SEQ ID NO. 51725
  misc_feature (703)..(703): n is a, c, t, g, unknown, or other
gcggtggcggccgctctagaactagtggatcccccgggctgcaggaattcgtctcacccctaatcgaaaaccaaggagcagaataagcgaggagctttgcatgagaagctcaagattctccgcagcgttactcactctcatgcgggggataaagtgtcgataatagcggacgcgtcatcgtacatcaaggaactaaagcagaagatcgcgaagctaagccaagagatggcatcgtcgtctccgcagcacgccactagtgtctgccaacaacaaccgtcgtcgtcgtcggtgagtgtgggagtcctgctggacaagaagggccgtttcctcgtcagtgtgttcatggacgagagctgcggcccgccgccggccgggctactcgcttccgtcctcgaggccttcgacgagatcggactcacggtgcttgaggctagggctacctgcgctggttcctttcggctagaagctgtaggagaggaagtagtagtagatgggggcctcatcgtcgacgcgcacgcggtggagcaagcagtagttcaggcaatcaagaattgccctgcaaatcattaaactaatcgacctagtcctccaattcgatcgatcgagttgacgatgcgctgctggtggagcacaaagttcatgtcaagctagagactccgagctatatatacatatactggattcgcatcgtacttttttaagnag

SEQ ID NO: 51725 - protein, 114 aa, Zea mays; identical to SEQ ID NO: 46202
  misc_feature: Ceres CLONE 1466750-F

SEQ ID NO: 51726 - DNA, 752 bp, Zea mays
  misc_feature: Ceres CLONE 1466756-F
  misc_feature: Encodes the peptide sequence at SEQ ID NO. 51727
ggagctccccgcggtggcggccgctctagaactagtggatcccccgggctgcaggaattcgtctcacccctaatcgaaaaactataaaatgccctcgcggcctcacctccattattgccatccatcacatcctctcccaccttactcaagctagtgcgagcatagcaatggggttcgcccggaagagtggagttgcagcagtaggggtttggtggctcctcctgctcgccggcgtgctgttgcctttggcggcggcatttggccggcacgccgatgccggcaacgacatgtgcgacatcaagtgccagcatcacagcgacccggccaggaggcagcagtgcgtggatgagtgccatagccgggagcaccatcaccctagcagagagttttgcgagatgaagtgccagcaccaccaggaccctgcaaggaaagagatctgcgtacagcagtgcatgagctatggtctcagccaccgtgcgagtgccagtgttgttgatgagggtgaaaagcgcttccatggctgggaaacgacggtggccggaggaatcctcgaggcggtgtgacgacgtacgacgttatataacagtacgtcataattaataaaataagctacacccgcgtttcccttatatatatgtcttgctatgcatagagatatcatggcaaaggcataggaataaagtgcgtgcgatatgcatgtacgtgcatgttcgtagtaatcttacagagattacgcagaaattttactagaa

SEQ ID NO: 51727 - protein, 131 aa, Zea mays; identical to SEQ ID NO: 16978
  misc_feature: Ceres CLONE 1466756-F

SEQ ID NO: 51728 - DNA, 731 bp, Zea mays
  misc_feature: Ceres CLONE 1466757-F
  misc_feature: Encodes the peptide sequence at SEQ ID NO. 51729
  misc_feature (239)..(239): n is a, c, t, g, unknown, or other
  misc_feature (240)..(240): n is a, c, t, g, unknown, or other
  misc_feature (363)..(363): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
acccgcggtggcggccgctctagaactagtggatcccccgggctgcaggaattcgtctcacccctaatcgaaaaatcgaaatgcctacattatgattgccatcgccgggaaaggtttcttcaaagcttcagtgctcgcaactggattaataatgaagaacattctgcgcatcggaaaagtcaacgtcattggagatgtcatcctcttcctgggaaaactctgtgtgagcctattcgtgnntggcgctgttctccgccccttttcctgatgttagacacccacaagtacaaagtcccgcaacacaagacaagaatatccctgctcccagtttattcccctggtcccggggtaaacatggggggnccccccctttcccgggggccttttaacccttttaagttccccccgcggaaaagaacctttttttttcccttttttgggccccggtgttgggtggtatttttcaaaaaaaatgggccccaaattcccgaaaaaaccaccccccccctaaaaaaattccccctcccccccccgggtgtctttggcccaatggaaaaacgcccctaaaggtaaacccaacccccaggggggggaaaccggggcgccaaaatatggcgcccccccagctttggaaatgggaaaacccctgtgaaaaaaaccggggggggaaaaaattnnnaaaaataccgaacagcccaaaggggcccttggaacaggggccttttttcccc

SEQ ID NO: 51729 - protein, 58 aa, Zea mays
  misc_feature: Ceres CLONE 1466757-F
  misc_feature (50)..(50): Xaa is any aa, unknown, or other
MIAIAGKGFFKASVLATGLIMKNILRIGKVNVIGDVILFLGKLCVSLFVXGAVLRPFS

SEQ ID NO: 51730 - DNA, 804 bp, Zea mays
  misc_feature: Ceres CLONE 1466767-F
  misc_feature: Encodes the peptide sequence at SEQ ID NO. 51731
  misc_feature (437)..(437): n is a, c, t, g, unknown, or other
  misc_feature (446)..(446): n is a, c, t, g, unknown, or other
  misc_feature (447)..(447): n is a, c, t, g, unknown, or other
aaaactggagctccccgcggtggcggccgctctagaactagtggatcccccgggctgcaggaattcgtctcacccctaatcgaaaattttgtcagaaaacaacgtgtgaggatggtgcactatcgaagcccttgtacataatggcattcaggcgaatcccacgttccataatggcataattccatatttctccagctgttccgccgagcgaacgacccacaagcagaagccacccattggcgtacgctaggcgatcggagcatcccgtcccaagaggagaaactccggccggcgacgcgggggaaaatgggcaagacgccggtgcggatgaaggcggtggtgtacgcgctgtctcccttccagcaggaagagaacccggggctgtggaaaaacctcacgtcggagatcccccaccaggtccaccgatgagtggatcntccccacgnntctcccttcaccccgttgttgggcccctaacaataaccccatgtggtacaaaaaagcaggaaaaagcttttcccaccaaatccttaaaggggaatgcccctccaaagttgctgggggcttggtccccagtgtgaatttttcaaggaagggggtggaaaaaactgggcaaaggccatttcttttagcgcgggtttaaattcaagccttttttaccccctttccataccaaatcccaggaaaccgggccccggcaaaaaatattttgggccgtggcaaaagggcaccccttttgtcccctagagtgggagaaacaaaaaaaaatctcctgcccccaaagaaaagaaaaaccaacccccc

SEQ ID NO: 51731 - protein, 40 aa, Zea mays
  misc_feature: Ceres CLONE 1466767-F
MGKTPVRMKAVVYALSPFQQEENPGLWKNLTSEIPHQVHR

SEQ ID NO: 51732 - DNA, 745 bp, Zea mays
  misc_feature: Ceres CLONE 1466772-F
  misc_feature: Encodes the peptide sequence at SEQ ID NO. 51733
ctggagctccccgcggtggcggccgctctagaactagtggatcccccgggctgcaggaattcgtctcacccctaatcgaaaaccctcgttttatttcctctgctccctctccgcttctctccactatcctaccaggcaccactcgcatcgtgtgctcagtcagatccccgtcccgcatttcctaaggccagttggcattgaagacgatgactgcttctgcagctgctggtgtgcagatggtggctgcacgcccttgcatttcggcctcgccaggaattcttaccgcacgggtttctaggactgattgcatgctcagtaccactgctacattccccaaaatcagctgctcctggcctctaaggtttaagcgcaatgatgttgttgtaagagcaatatcggaagagtgtggcccgcaggggcttcccattgatctcagaggtaaaagggcattcattgctggagttgctgatgataatggctatggatgggcaattgcgaaggcacttgctgcggctggtgctgaaattcttgtgggtacatgggtgccggcacttaacatatttgagacaagtctgaggcgtggaaagtttgatgaatcacggaagctgccagatggatcctctatggatattgttaaagtctatccacttgatgctgtctacgattcccctgatgatgatcctgaagatgtctaatcgaacaaagatatgcaggggcatccaactggacagtaaacgaagttgtt

SEQ ID NO: 51733 - protein, 162 aa, Zea mays
  misc_feature: Ceres CLONE 1466772-F
  misc_feature: SWISSPROT Homolog: EC 1.3.1.9 Enoyl-[acyl-carrier-protein] reductase (NADH)
MTASAAAGVQMVAARPCISASPGILTARVSRTDCMLSTTATFPKISCSWPLRFKRNDVVVRAISEECGPQGLPIDLRGKRAFIAGVADDNGYGWAIAKALAAAGAEILVGTWVPALNIFETSLRRGKFDESRKLPDGSSMDIVKVYPLDAVYDSPDDDPEDV

SEQ ID NO: 51734 - DNA, 803 bp, Zea mays
  misc_feature: Ceres CLONE 1466773-F
tggagctccccgcggtggcggccgctctagaactagtggatcccccgggctgcaggaattcgtctcacccctaatcgaaaagaattaacacatacagaggagagtcacaacacaaatccgaagaagccggagagtgaaaaaaaatggcagcgacgactctttccatcgcaaccacaatccgctcctcctctcacctcactcccgcttctccccatgtcttcccttcccgaccaaacacaaccgcatttccctttcgcctcggttcatcttctccgacactaacccaccgtgcaacccacctcccgtccatatccgccgtcgaggccccggagaaaatcgagaagatcggatccgaaatctcgtccctcactcccgaagaagcacgcatcctcgtcgactaccttcaaggacaaggtcgggggtcccgcccgttttccttaactcccgcttgacgggctttgggcttctcccggaaaacagggccgttcccccccccttcctggaaaaaacaaaaacgggtttccaagtggggcctacaaaaaaaccccaaaaaaagggcggtatttcggggaaaaaaaagggggaaggcgctttacaaaacctggcgcaaaaagaaaaaaagaaggcttttctcggagggtgcccaaaaaaatttaaaaaaagggtggccaaaggtgttttctaaaaaacaaaaaccccccttaaaaaaggggcgccccggtcccctctttaaaaaggggtgttttttttttttccacaaaagagaaaaaacttccccgcgggggggggaaaaaaaaaagtgg

SEQ ID NO: 51735 - DNA, 718 bp, Zea mays
  misc_feature: Ceres CLONE 1466775-F
  misc_feature: Encodes the peptide sequence at SEQ ID NO. 51736
  misc_feature (638)..(638): n is a, c, t, g, unknown, or other
aaagctggagctccccgcggtggcggccgctctagaactagtggatcccccgggctgcaggaattcgtctcacccctaatcgaaaacatacaccgtcacctattacgcctgtcttgcctacaactatacacttttcagccccagtatctgctcctgcaattgcccctgagcttgcatcaggggctgttggtgtgcctccacctgttagtgctgtggtacctgagctgtcagaactggatgttcacaatgaggagaagttgctgagggagctggaggaaatgggttttaggcaggtcgatctcaacaaggaaatcctcaggcagaacaattacaatctggagcagtctgtcgatgacctatgtggcgtcaatgaatgggatcctctccttgcagagctggaagagatgggatttgatgacacagagatgaacaaggagctgcttgcgaagaatgagggaagcatcaagcgagctgtgatggagctcattgccagggagaagaaggacaagtgaaagatcgtgtgctatctaagtatatattccgtaaaataatgagaacgctgtgcactgccgtgcagccctggtcgtctcaagcttgcttatgggaattcttctgttaggtccttcctatatccgccnggtctgcggggtaatgaactatcaagtaggtggaacggggcgtttaacagtaccctgccatgccactggaattggtgtcc

SEQ ID NO: 51736 - protein, 77 aa, Zea mays; identical to SEQ ID NO: 49228
  misc_feature: Ceres CLONE 1466775-F

SEQ ID NO: 51737 - DNA, 755 bp, Zea mays
  misc_feature: Ceres CLONE 1466780-F
  misc_feature: Encodes the peptide sequence at SEQ ID NO. 51738
  misc_feature (737)..(737): n is a, c, t, g, unknown, or other
taactggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaaaacattctgttccaagcgtgaactgctcgagtttgcttattatcatggaggcggctgtagttctcttttccaccgcgacctcttttttttcctaaggaacgtacattgtcatttttggaagcttctgagaggatggcgggcgcgtgaactatgaatgtatgaatcactccaaagctaaactgtttgagtactatgctaagctgaggagctgcattacatcatgtggtggagcgcgagggaggcttctttatcggacagcctcccttgtcaccgacgcaatcaggcacccccccaagccgtggaatacgctggggttggcttttggcatgaaaacaccgcctgtgttttgtcataagtccaatccctaactagagaaaacaggaagcttttttaatcccagtggtttcccccttcctacaaaaatttgggattgcctctttggacataagcccggaaaaaagcggtttcttaaaaaaaaaaaaaaaaaaccgagncccgtccgaggtatcccg

SEQ ID NO: 51738 - protein, 72 aa, Zea mays; identical to SEQ ID NO: 47952
  misc_feature: Ceres CLONE 1466780-F

SEQ ID NO: 51739 - DNA, 764 bp, Zea mays
  misc_feature: Ceres CLONE 1466782-F
  misc_feature: Encodes the peptide sequence at SEQ ID NO. 51740
  misc_feature (701)..(701): n is a, c, t, g, unknown, or other
aaagctggagctccccgcggtggcggccgctctagaactagtggatcccccgggctgcaggaattcgtctcacccctaatcgaaaaaactgtcacggccgcttccagcacgcatcattctcgtctcccgtctcgagagattgcagggggcggcgctcgaagctggaggaagcggacgggttcgcgatggggtccgagggatcctcgggtccggtcgtcgttcccagaaactttaggctgctagaagaactagaacgtggtgagaagggcattggtgatggaactgtgagctatgggatggatgatgctgatgacatatatatgcggtcctggacaggaactataattggtcctcccaatactgttcacgagggacgaatctaccaattaaagctgttttgtgatacagattatccagataaaccaccgacagtccgattccagactcggatcattatgacatgcgtgaaccaggaaactggattggcacttgtgcatttttgtttcttacagcgtgcaacctgccaagggcaatttacgaatgatattaggcccattgcttagctagcactttttctaggttgaaccaagtctatttcctatgcttggctagtgggaaagggaacatacaatggaggacatcctggtcagcttataaagggagatgtcaactcctcagaaccgcaggctgtaccagcctcntgaaggtcacgaagatcaaagagtagagctcacagggctgtcccttagatgtgtcgtcatgta

SEQ ID NO: 51740 - protein, 125 aa, Zea mays
  misc_feature: Ceres CLONE 1466782-F
  misc_feature: SWISSPROT Homolog: EC 6.3.2.19 Ubiquitin--protein ligase
MGSEGSSGPVVVPRNFRLLEELERGEKGIGDGTVSYGMDDADDIYMRSWTGTIIGPPNTVHEGRIYQLKLFCDTDYPDKPPTVRFQTRIIMTCVNQETGLALVHFCFLQRATCQGQFTNDIRPIA

SEQ ID NO: 51741 - DNA, 626 bp, Zea mays
  misc_feature: Ceres CLONE 1466787-F
ccaatggtagaggggcccccctctagacctggtgcggtaaaaggggcttccccaagaaaaaacggcgccgcacacctccggccggtcccggcccggtcccgcccgccgtgggtggccccgggcccgcccgccggccccagccgtggccaccgcggtcgccccctttgttttctccagtctggagtttctctagttttctccagtttgcagttcgcatagcccttctactatctcttgctactctatctgcggctttggtacttccattcccctactagccccacgaactgctgcatgatgctacccccgccgcttccattaccctgcaagcccacagtctattatggatttcccacctaaagttgtttgtccattcatgacccatgttcatgtgcaatagctacaactttcaaggtatttgagagaatgctcaaaaaggtgcgtcaacagatctaaagcatcggttgaacagacataatggtgaatcaacaaggaactcggtcgggcatctctaaaaggttcagtttggttgtaatcaccaactacaggaatgtggataccaatgacgtcttactccatcagaagctactagctccctaatgaagaaccaaattgcttgaaaaaaa

SEQ ID NO: 51742 - DNA, 719 bp, Zea mays
  misc_feature: Ceres CLONE 1466791-F
  misc_feature: Encodes the peptide sequence at SEQ ID NO. 51743
cgattgggtacgggccccccctcgagccctgcagtggtaaaggagagtataaccgaataaaaatacctttgttgctccctagctagctccagactagatcacgtgccggtctgcaatttgagtagtgtgcatcctaacatggggcaacgagaaaaggaagtgatcccgctgatgaccccgtacaagatgggacagctggagctctcccaccgagtggtgctggcgccgatgacacgatgccacgccatcggggacgtgccgcatccgaacaccatcttttactactcgcagcgcacctgcaggtgcgccctgctcatcaccgacggaacgagggtgtctcgccccgcgcagggttttcccgggtctcccggtatatggacaaaagagcaggtggtagtcttgtaatccaataatataccccgtccacagggaggggcgcgctcttcttctgctatatcagccactgttggaaagggatccccccatgaatttccaagctggacggtccaggggcccgtgcttcaaatatagcccgcaaaagtttcccccccggaggccggaatccctgtcccgggggtttatcccagggccgaattgttgtttgggggagccataaaaaaaaattcccgggggaatttgttggaaaaaattttggggtggcctcctcttcgggcacaaaggtgcaaaactggaggggacgggggattttccatccgccg

SEQ ID NO: 51743 - protein, 88 aa, Zea mays
  misc_feature: Ceres CLONE 1466791-F
  misc_feature: SWISSPROT Homolog: EC 1.3.1.42 12-oxophytodienoate reductase
MGQREKEVIPLMTPYKMGQLELSHRVVLAPMTRCHAIGDVPHPNTIFYYSQRTCRCALLITDGTRVSRPAQGFPGSPGIWTKEQVVVL

SEQ ID NO: 51744 - DNA, 733 bp, Zea mays
  misc_feature: Ceres CLONE 1466792-F
  misc_feature: Encodes the peptide sequence at SEQ ID NO. 51745
  misc_feature (1)..(1): n is a, c, t, g, unknown, or other
  misc_feature (31)..(31): n is a, c, t, g, unknown, or other
  misc_feature (269)..(269): n is a, c, t, g, unknown, or other
  misc_feature (405)..(405): n is a, c, t, g, unknown, or other
  misc_feature (410)..(410): n is a, c, t, g, unknown, or other
  misc_feature (414)..(414): n is a, c, t, g, unknown, or other
  misc_feature (423)..(423): n is a, c, t, g, unknown, or other
  misc_feature (469)..(469): n is a, c, t, g, unknown, or other
  misc_feature (493)..(493): n is a, c, t, g, unknown, or other
  misc_feature (514)..(514): n is a, c, t, g, unknown, or other
  misc_feature (567)..(567): n is a, c, t, g, unknown, or other
  misc_feature (569)..(569): n is a, c, t, g, unknown, or other
  misc_feature (594)..(594): n is a, c, t, g, unknown, or other
  misc_feature (611)..(611): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (638)..(638): n is a, c, t, g, unknown, or other
  misc_feature (675)..(675): n is a, c, t, g, unknown, or other
ngcccctgagtcccggggccccctcgagcantggattggtaaagggtgccacacatccgtttgcctcttctccctcttgccggtcccgaataaagagcagcagcgcaagaggtcggtagagcgagaagaaggcaatggcggccgaaagcttccttttcacctcggagtccgtgaacgaggggcaccccgacaagctgtgcgaccaggtgtcggacgccgtgcttgacgcatgcctcgcgcaggaccccgacagcaaggtggcctgcganacctgcaccaagaccaacatggtcgatggtggtcggcgagatcacgaccaaggcgaccgtggactacgaggaagatggtgggcgacacccgccttttttatcccccccccccgggggataaggaaaggggtctttntcctnaccnttttttatntaaccccccccaccagggggggaaacaaaccccccccgacggcggngggggggggggggggggggggcgnttgcggaaacaaagggcgccngcgagggtcgggggacgtggatgaacacggtgggggggtggtggtgggggggncngccgggaggaggacccaccccccancccacaccccctaaagncccaaggcgggatcccccgcnnnacgncggcgggcttctttccgcggaaagcggattacgtcgnagcgtggcggcgggccgtggtggtcctgcgacggcgaaggccggggcgcggcggcggg

SEQ ID NO: 51745 - protein, 157 aa, Zea mays
  misc_feature: Ceres CLONE 1466792-F
  misc_feature (4)..(100): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
  misc_feature (45)..(45): Xaa is any aa, unknown, or other
  misc_feature (91)..(91): Xaa is any aa, unknown, or other
  misc_feature (94)..(94): Xaa is any aa, unknown, or other
  misc_feature (97)..(97): Xaa is any aa, unknown, or other
  misc_feature (112)..(112): Xaa is any aa, unknown, or other
  misc_feature (120)..(120): Xaa is any aa, unknown, or other
  misc_feature (127)..(127): Xaa is any aa, unknown, or other
  misc_feature (145)..(145): Xaa is any aa, unknown, or other
  misc_feature (154)..(154): Xaa is any aa, unknown, or other
MAAESFLFTSESVNEGHPDKLCDQVSDAVLDACLAQDPDSKVACXTCTKTNMVDGGRRDHDQGDRGLRGRWWATPAFFIPPPRGIRKGVFXLTXFYXTPPTRGGNKPPPTAXGGGGGGGXCGNKGRXRGSGDVDEHGGGVVVGGXAGRRTHPPXHTP

SEQ ID NO: 51746 - DNA, 661 bp, Zea mays
  misc_feature: Ceres CLONE 1466805-F
  misc_feature: Encodes the peptide sequence at SEQ ID NO. 51747
  misc_feature (443)..(443): n is a, c, t, g, unknown, or other
caattgggtaccgggccccccctcgagccactgcagtggtaaagggtctgctcgtggctggaaaacggcgccacttgatgtaatcttggaatgaaaagaggatcttggcttgtggttggaaaaattgtgcgtcttattcgaatctttcttgaaaatagtggtatcttggaggcgcttgatgcggttctgagcggggcgcaggtgctcgccgtcccgctacgcgctggctggcgcaagaagcagctcggcggcggcggaggctccgccgccgccggcgacttctgctggctcacgcaggaggacctcgtgcgctacttcctcaactccatcggcctcttctaccatgtggccgcgcgctccgtgtcctcgctcgggctcgtgcgcaccgacttcctgtcggtgcgccccggcgaggcggccctgtcggccgtgcccctcatccngcgcgccgtcgccacggagacggcggtcgccgtggtcaccgaagacggccacctgctcggcgagatctcccccgccctcctcgcggactgcgacgagacggcggccgcggccatcgccacgctctcggcggcggacctcatggcctacgtcgactacttcgggtccccgtcagagcacatctcgcgcgccatcaaggccgtgctgaaggactagggcc

SEQ ID NO: 51747 - protein, 188 aa, Zea mays
  misc_feature: Ceres CLONE 1466805-F
  misc_feature (118)..(118): Xaa is any aa, unknown, or other
MKRGSWLVVGKIVRLIRIFLENSGILEALDAVLSGAQVLAVPLRAGWRKKQLGGGGGSAAAGDFCWLTQEDLVRYFLNSIGLFYHVAARSVSSLGLVRTDFLSVRPGEAALSAVPLIXRAVATETAVAVVTEDGHLLGEISPALLADCDETAAAAIATLSAADLMAYVDYFGSPSEHISRAIKAVLKD

SEQ ID NO: 51748 - DNA, 670 bp, Zea mays
  misc_feature: Ceres CLONE 1466807-F
  misc_feature: Pfam Name: PLDc Pfam Description: Phospholipase D Active site motif
  misc_feature: SWISSPROT Homolog: EC 3.1.4.4 Phospholipase D
  misc_feature (347)..(347): n is a, c, t, g, unknown, or other
  misc_feature (389)..(389): n is a, c, t, g, unknown, or other
  misc_feature (471)..(471): n is a, c, t, g, unknown, or other
  misc_feature (553)..(553): n is a, c, t, g, unknown, or other
  misc_feature (655)..(655): n is a, c, t, g, unknown, or other
cgattgggtacgggcccccctcgagccctgcagtggtaaaggcggcggcgctcgggctggtgagcggcaaggaccacgtgatcgagcgcagcatccaggacgcgtacatccacgccatccggcgggcgcgggacttcatctacatcgagaaccagtacttcctggggagctcctacgcgtggcggcagaacgacggcgtgacggtggaggacatcaacgcgctgcacctcatccccaaggagctgtcgctcaagatcgtgagcaagatcgaggccggcgagcggttcgtcgtgtacgtggtggtgccgctgtggccggagggcgtgcccgaaagcggctccgtgcangccatcctggattggcagcgccgcaccatggagatgatgtantaggacgtgacgctggccatccgcgccagggggctccgggccgaccccagggactacctcaccttcttctgcctcggcaccngcgaggcgccgagccccggcgagtacgtgccgccggagcacccggacccccacaccgactacgagagggcgcagcaggccangcgcttcatgatctacgtccacgccagaccatgatagtggacgatgagtacatcatcgtgggctcggcgaaacatcaccagcgctccatggacgggcgcgcnacacggagatcgcga

SEQ ID NO: 51749 - DNA, 690 bp, Zea mays
  misc_feature: Ceres CLONE 1466808-F
  misc_feature: Translation starting site: 317
  misc_feature: SWISSPROT Homolog: EC 2.1.2.1 Glycine hydroxymethyltransferase
  misc_feature (357)..(357): n is a, c, t, g, unknown, or other
  misc_feature (367)..(367): n is a, c, t, g, unknown, or other
  misc_feature (379)..(379): n is a, c, t, g, unknown, or other
  misc_feature (417)..(417): n is a, c, t, g, unknown, or other
cgattgggtaccgggccccccctcgagccactgcaggggtaaaggcaagggagatgaggcaccaaacccggcactaccaggagtaaggaaggacaacacgcccaaccatgatcatggagaacgagctccgaaagatactccaccgacgatatgacccgccagcgcgatctcctggatcaaggcggtctactacgtggtgtccgttccgggaaccgaggagagatccggaatcacctggactaaacagttgaacgcgaccgttggaagaggtcgaccccgagattgctgacatcatcgagcacgagaagggccgccaatggaagggtctggagctcatcccgtcggagaatttcaagncggggtcagngatgcagggagngggtttcggcatgaccaactagtacagggaggggtatntgccccaagatactacgggggaaatgagtttattgatatggcagaagccttgtgtcagaaacgtgctttggaggctttccgattggacccggccaaatgggtagtgaattgccctcctcctatccggcttgcccgttaacttccctgaatacactgtccctcttgaacgccccctcgaaacggaccccgccctttggattcttccccaccggtgggactcccctccccatgggaaaatatagacttgcccccaacttattatattccgtatcg

SEQ ID NO: 51750 - DNA, 614 bp, Zea mays
  misc_feature: Ceres CLONE 1466811-F
  misc_feature: Encodes the peptide sequence at SEQ ID NO. 51751
cgattgggtacggggcccccctcgagccactgcagtggtaaagggcgggcccggaggtgcgtgcgggccggactcccgcgtggagaccatctcccggctggcgcagtggcgcatcgataccttcggcccctgctccctacgccgggtcggacccctttaagctcggcatctgggaactggtacctgtcggtggaaaaaaaacgctccatctttgtggggctccttccgggaagcccggccgggggggccaaggaacaacccccttttcgggggtttctgggtcccggtttcctgggggcggggccccccggaaattccttggttttcccggggggaaaaaattttttggggggcaccggggaatttttttttggggaaccataagagggccccccgggggggtttaaaaaaggggggggtttttccccccgggggaaccccccaaaaaggggtggaaaatctctctggggggggcacaaaaaaaatggtggggaaaaaaaattagctaaaaaacccccgggggggggggggtccaaaaaggggggggaaccccccctccccggggggggggttcttcccaccccaccccggggggttttaaaaaaaaacaaacg

SEQ ID NO: 51751 - protein, 52 aa, Zea mays
  misc_feature: Ceres CLONE 1466811-F
DWVRGPPRATAVVKGGPGGACGPDSRVETISRLAQWRIDTFGPCSLRRVGPL

SEQ ID NO: 51752 - DNA, 637 bp, Zea mays
  misc_feature: Ceres CLONE 1466819-F
  misc_feature: Encodes the peptide sequence at SEQ ID NO. 51753
cgattgggtaccgggccccccctcgagccactgcagtggtaaagggcagtaggaagccggacaaagctacgcaaggagggagaaagcgtgtaaaccatggcgtcctccgcgttcctcaacgctctcgtcctccgatcgccatcaccgtcgctctcgtcctcgtctaaccgccgcagcaccggcgccttcgcgttcccgaacccaccgcgcttcccatgcctgcgttctgcgcgtcgactcgtccttgcgagggcggcggcagcgccggcgccgggcgatggccccgaggacgagtgggggccggagcccgagggcggttccgctgtcacgggggccgcggtggcggaggcgccggaggcgagagaggtcgcggagctcaaggcgcagctaaaggacgcgctgtacggcacggagcggggcctgcgggcgtccagcgagtcacgagccaaagtgctggagctcatcacgcagctcgagacgcgcaccccacgccggctcctacggagcgcttacgctctttacggggagtggatcctcgcgtaccatcattttcccactattccacttatggggtttggaatctgcctcacttgtggaggtggaggaatattcccaacctttgattctgaaaacttct

SEQ ID NO: 51753 - protein, 180 aa, Zea mays
  misc_feature: Ceres CLONE 1466819-F
MASSAFLNALVLRSPSPSLSSSSNRRSTGAFAFPNPPRFPCLRSARRLVLARAAAAPAPGDGPEDEWGPEPEGGSAVTGAAVAEAPEAREVAELKAQLKDALYGTERGLRASSESRAKVLELITQLETRTPRRLLRSAYALYGEWILAYHHFPTIPLMGFGICLTCGGGGIFPTFDSENF

SEQ ID NO: 51754 - DNA, 670 bp, Zea mays
  misc_feature: Ceres CLONE 1466830-F
  misc_feature: Encodes the peptide sequence at SEQ ID NO. 51755
gctcttttctagtggatcccccgggctgcaggaattcgcacgagaccattacctagaacatcctaatcgaaaattttcctctcccctcctcttccacggtcgcgcctgctactcccatccgccgccgcgtcttgggcaattaccacgtcgttgcagaagaactggcgccagtgccttcgggacgggaagcgcgtcgccgccggggatgcttgggaccgggaagcgtcaagcagcataccgcgcccgttattctgtcccgaatgggtaagaaaaagctcgagcgtgccctcaaccggaagccgaagtaggctgcgatgattaaggcgctggagaacaacttggtagatgtctacacggtctcatctcaagagccttccgatgctgcatatggcaagtccccagtaaagttcaccagtgacgactctctcggaatatagataactagattaacgggtatacgcatgaagaaagccaaatatgcttcacctcctgccaaggagaaagttgatgccatggtagcgtgacggacaatactgcatacccccctttgtatgttctctcagagtttgcaccgtggaccgacctctctgatcactggaccgtgtttctgtctcatgcatcttctgtccgagtgctaaatagaggctacttaggacttgctgtctacgtt

SEQ ID NO: 51755 - protein, 40 aa, Zea mays
  misc_feature: Ceres CLONE 1466830-F
MIKALENNLVDVYTVSSQEPSDAAYGKSPVKFTSDDSLGI

SEQ ID NO: 51756 - DNA, 682 bp, Zea mays
  misc_feature: Ceres CLONE 1466832-F
  misc_feature: Encodes the peptide sequence at SEQ ID NO. 51757
ctcacccgcggtggcggccgctctagaactagtggatcccccgggctgcaggaattcgcacgagaccattacctagaacatcctaatcgaaaaaaccacacctcttacctaaaataagaaagaaaactagaacctaaaaaccagcgacgccgagcggatctacagccaccttggtcaccggcggcgatggcgagttccaagtccggcatccctatcaaggcagaacaagattcggatggctcggcacaaagcacagctgatatgacggcttttgtgcaaaaccttcttatgcagatgcaaaccaggttccaagctatgtcggagaacatcatttcaaagatagatgaaatgggtgcgagaattgatgaattggaacagagcctcaatgacctcaaggctgagataggcggtgaaggcatgtcgacgccatctaagatgaaggaagagtcaagaccttcagacagctccgcatgagtgcagcagaagcagcatgactcgtttcagaagccggtgctgtgtcttggggcgttcatcactaacaaatacgtacttgtttttaaggcctcatttgaacaaaaaattggaacccggggccactggggttttggcggaggggtttgcaataattggtacccggcttccttctggggaaaccttacccggggttattgccccaaaaatg

SEQ ID NO: 51757 - protein, 95 aa, Zea mays
  misc_feature: Ceres CLONE 1466832-F
  misc_feature (23)..(76): Pfam Name: HSBP1 Pfam Description: Heat shock factor binding protein 1
MASSKSGIPIKAEQDSDGSAQSTADMTAFVQNLLMQMQTRFQAMSENIISKIDEMGARIDELEQSLNDLKAEIGGEGMSTPSKMKEESRPSDSSA

SEQ ID NO: 51758 - DNA, 664 bp, Zea mays
  misc_feature: Ceres CLONE 1466836-F
  misc_feature: Translation starting site: 246
  misc_feature: SWISSPROT Homolog: EC 5.2.1.8 Peptidylprolyl isomerase
gggccccccctcgagcactgcagtggtaaagggtgccggttcttgttcttcttcccacccagccgcgctccctcttcctcttccccttctctctcggcgacgactgggtggccgtagctgcctccatacgcctggtgccctggtcttcttcgggccattcgccggccgcgagcaccaccaagtacgcccacctcatgaagggagagcttcccaggtagagaaacagtttctccgtactctagcagatggcaaggataaagcctaagcaattgctaatccaaagcaaaacaaagaaggctccatctcgaatcagctactctactatcatcacatggaacttgattgtcatattggttgtgctatctctctatgcgaggtagagccattggcatcaaaggtctacccaaaacttccaaatggagcttcatgaagctgagcttgctgtgagaccggaggatcaaaaatgataagtagaccaagatatgcggaaatgaacacccgcaaagcccaattactatagaaatataccaagatgcttctgctgacgttgtggataaatttatcaacttggggcaagagaaatcatttcaagggattgccttttcggcataacataaaaatttttgaaattcaggaaggggattttgaattccaagggactttc

SEQ ID NO: 51759 - DNA, 671 bp, Zea mays
  misc_feature: Ceres CLONE 1466840-F
  misc_feature: Encodes the peptide sequence at SEQ ID NO. 51760
tcgagccctgcagtggtaaaggaggcttcaggaccttctcctgcgacgccagcaccgccccgagccgcggcccgaatctagggttcccctctcccgccgtcgacagccggatcgcacatagtgcacctccacgatgctgccgtgcgcgaggtcggtgcttcgaaggagggggctggcatcttccgtcccgcggaggtgcggcggggagggcgagtgctccacttgcgcgggggagctggtcgccaatgccaggtgttcgagcacgctggctgcgctcggcggcggcgggcgcgtgctcgagcatggcggccggtgggcatatccgcagaccggcgtgattggcgcggggcggatgacgcgcacgcagacgaggtgtttcttcgggtgcggtgacggggaggaggggggccgtgctctccaaggtctatgaggagaggcgcgtgattgggtactcaccacaccagatgtttgcttgttgtcccgtcggtgcacctttaccaggactttgtgccatggtggcgccggcccaggattattagggggccattgaaaaaggctcctttgaaggccaagcctcgagaatgggaattcaagtttccttggtgaaaagtttttgtcccccccgggggggagatatggaacaaacccccgggtttttttcaaggacctac

SEQ ID NO: 51760 - protein, 98 aa, Zea mays
  misc_feature: Ceres CLONE 1466840-F
MLPCARSVLRRRGLASSVPRRCGGEGECSTCAGELVANARCSSTLAALGGGGRVLEHGGRWAYPQTGVIGAGRMTRTQTRCFFGCGDGEEGGRALQGL

SEQ ID NO: 51761 - DNA, 664 bp, Zea mays
  misc_feature: Ceres CLONE 1466841-F
  misc_feature: Encodes the peptide sequence at SEQ ID NO. 51762
  misc_feature (435)..(435): n is a, c, t, g, unknown, or other
cgattgggtacgggccccccctcgagccactgcagtggtaaagggggatatgtcacgactcaccacgacggaaacagtagtgctgccagtagagagctctcagaactcgggaaaaaatgtcagaggccgccgtgcgtgtgatcggcctatggccgagcccgttcgtgatccgcgtcctgatcgccctgaagctgaagggcgtcgagttcgagttcgtggaggaggtggtgggcaggaagagcgagctgctgctgaggtcgaacccggtgcacaagaagatccccgtcctgctccaccacggcaagcccatctccgagtctctgatcgtcgtccagtacatcgacgaggtctggtcctccggcgcgccggccttcctccccgtcgacgctcacgcccgcgccgtccagcggttctgggcgcagtacgtcgacgacnagctgccttgggcgatccgcatactgaagggaacggacgacgggggcatggagcaggcggcggggcagctgtccgcggccctgcacctcctagaggaagctttcgcgcagctcagccaggggaagcgctacttcgggcggggacagcgttcggtaacctggacatcgctcctggtgtcccatgtccggctgggtgaaagccggttaaaaaaaatcgccggggtccaccc

SEQ ID NO: 51762 - protein, 182 aa, Zea mays
  misc_feature: Ceres CLONE 1466841-F
  misc_feature (4)..(77): Pfam Name: GST_N Pfam Description: Glutathione S-transferase, N-terminal domain
  misc_feature: SWISSPROT Homolog: EC 2.5.1.18 Glutathione transferase
  misc_feature (107)..(107): Xaa is any aa, unknown, or other
MSEAAVRVIGLWPSPFVIRVLIALKLKGVEFEFVEEVVGRKSELLLRSNPVHKKIPVLLHHGKPISESLIVVQYIDEVWSSGAPAFLPVDAHARAVQRFWAQYVDDXLPWAIRILKGTDDGGMEQAAGQLSAALHLLEEAFAQLSQGKRYFGRGQRSVTWTSLLVSHVRLGESRLKKIAGVH

SEQ ID NO: 51763 - DNA, 631 bp, Zea mays
  misc_feature: Ceres CLONE 1466844-F
  misc_feature: Translation starting site: 96
  misc_feature (430)..(430): n is a, c, t, g, unknown, or other
  misc_feature (431)..(431): n is a, c, t, g, unknown, or other
tcgagccctgcagtggtaaagggcggaggcctcgctctggttggaaggtttggagaaactccccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccaagaaggatgaataccaaggtgtgtggaggcatgccaagagtgatggtcatgaggactatggcctccttgttagtgagaaggcaaggaatacgccataatcaaggagcttgatgagccagttaccttgaaagatgggacagtggtcctgcagtttgaagtgagacttcagaatgcccttgaatgcggaggtgcctacattaagtacatccgnnccaaccccccccgatgggaatgccaaggagtttgataatgagactccattaccctatttgttttggtccgataatgggggataaccaacaggttcatttcttctttaccccaaaatcctaagaatggaaagtttgttaagatcatcccaattcccacctctggcccaatgaaaagtttctcttgtctaccggtttcttgg

SEQ ID NO: 51764 - DNA, 541 bp, Zea mays
  misc_feature: Ceres CLONE 1466853-F
  misc_feature: Encodes the peptide sequence at SEQ ID NO. 51765
  misc_feature (175)..(175): n is a, c, t, g, unknown, or other
cgattgggtaccgggccccccctcgagccctgcagtggtaaaggtcaagaacggcaagacggtcgcgaccatcgtgggtgccaggaaggagagctcctggccagatcgagaacatgccgcgcctgcgcctgcgtctgcgtctgcctaaaggagatcagtcgtcgccgtcaataangggcagcacgtatggctgtaattgttgtcgttatcagttctggcttttgtcttttgggggccaattgggaaactaaaaaaaatgttttgttttctatcccgggcccggggagggaaatttttaacccggggaacctttgtgggggtttaaaaaaaaaaaaaaaaacccaaactttgggatttttgggccccgggggataccttatttttaaaaggcccccccccccgggggaaacccccctttttttctccctcttgggggggggtttttttccgcgttgggggaaactaggggggaaaaatttttttccctgtggggaaatattttttatttcccccccccattttcccccaaaaaaaaaaagag

SEQ ID NO: 51765 - protein, 48 aa, Zea mays
  misc_feature: Ceres CLONE 1466853-F
DWVPGPPSSPAVVKVKNGKTVATIVGARKESSWPDREHAAPAPASASA

SEQ ID NO: 51766 - DNA, 672 bp, Zea mays
  misc_feature: Ceres CLONE 1466857-F
  misc_feature: Encodes the peptide sequence at SEQ ID NO. 51767
cgattgggtaccgggccccccctcgagccactgcagtggtaaaggatgctctacgacgtcgacgtcggcaaggccgccgccgtcgaggatgggtcctccagcaagaagagcaagcgcaaggagcgcctcccccacaccgaccagttccgcttcctggaccacgcggcgatcaacgaggacccggcggcgggggcgagcggcagcaagtggcggctggcgacgctgacggacgtggaggaggtgaagacggtggcgcggatgctgccgatctgggcgaccacgatcatgttctggacggtgtacgcgcagatgaccaccttctcggtgtcgcaggccaccaccatggaccgccgcgtcgggggctcgttccagatccccgcgggctccctcaccgtcttcttcgtcggttccatcctgctcaccgtgcccgtctacgaccgcctcgaggtgcccgtcgcgcgccgcgtcagcggcaacccgcacggcctcaccccgctgcagcggatcgccgtcggcctcgcgctctccgacgtcgccatggagggggccgcgcctccggagggccgccgcctccgcgtcgcgcgcgagtcctcccgagcccgccctccggaaggcgccgtgcccatggggggggttctggggtcattcccgcaattccttcctcgggggggg

SEQ ID NO: 51767 - protein, 209 aa, Zea mays
  misc_feature: Ceres CLONE 1466857-F
MLYDVDVGKAAAVEDGSSSKKSKRKERLPHTDQFRFLDHAAINEDPAAGASGSKWRLATLTDVEEVKTVARMLPIWATTIMFWTVYAQMTTFSVSQATTMDRRVGGSFQIPAGSLTVFFVGSILLTVPVYDRLEVPVARRVSGNPHGLTPLQRIAVGLALSDVAMEGAAPPEGRRLRVARESSRARPPEGAVPMGGVLGSFPQFLPRGG

SEQ ID NO: 51768 - DNA, 785 bp, Zea mays
  misc_feature: Ceres CLONE 1466859-F
  misc_feature: Encodes the peptide sequence at SEQ ID NO. 51769
  misc_feature (1)..(1): n is a, c, t, g, unknown, or other
  misc_feature (46)..(46): n is a, c, t, g, unknown, or other
nttttctcctcccccttcgggtttgtccttttatcctttttgtttnacaaaactggagctccccgcggtggcggccgctctttaactagtggatcccccgggctgcaggatttcgcacgagaccattacctagaacatcctaatcgaaaaaagacgatctgcgaaacttacctagtgcgtttgcgagagaaaccgagaaagagaagctacagagtctctgaccgaccgctatggcatcgaggcataacacgcgtgaggcgcgcgccgaggccgacgcgcggcgcgccgatggaggagctggctcgggcgcgggacgagcacctcgagaaggcggaggtgaacgcccgctcggccgtggacgatatggcgcgctcccgcgccgaccgcggtgccaccggcggcggcggaatcctggagagcgtgcaagagggctccaggtccttggactgcgccgtgagccgcaccttcggtgggttcaaggacgccaccgtggtctaaacctcgtacacggcgtaccccgcggacgacatgatcggcgagtacaaggactacacggtgctacaggcccgggaggccaacgaacgcgtcttcggtatcacggattagaccgcgggaggccacccggtacaggcttggggggagtatttagacggtgcccctgggagaaaggtggagggatatccagggacgcctgtgccctctcaaagaccaggccactaccctgcaagggcgaacctttgattcacctgtcgggggaattcccaatggtactcctccgggcccgt

SEQ ID NO: 51769 - protein, 69 aa, Zea mays
  misc_feature: Ceres CLONE 1466859-F
MEELARARDEHLEKAEVNARSAVDDMARSRADRGATGGGGILESVQEGSRSLDCAVSRTFGGFKDATVV

SEQ ID NO: 51770 - DNA, 598 bp, Zea mays
  misc_feature: Ceres CLONE 1466860-F
  misc_feature: Encodes the peptide sequence at SEQ ID NO. 51771
  misc_feature (324)..(324): n is a, c, t, g, unknown, or other
  misc_feature (336)..(336): n is a, c, t, g, unknown, or other
  misc_feature (476)..(476): n is a, c, t, g, unknown, or other
ccccgcggtggcggccgctctagaactagtggatcccccgggctgcaggaattcgcacgagaccattacctagaacatcctaatcgaaaaatccagcatacgatctgacgctcatcccacatcagtagtcgaccaagcacaagcagcagagccggccggaatatgtggacgatcaggaaggtggcgacgccgcaggtggccgtcctcctgctgctcctcatcgtcgttgcgcaggaggcggcgccgttggcggaggcgcgcgtgtgccggcgccggagcgcgggcttcaagggggtctgcatgtccgaacacaactgcgcgcangtgtgcttgcangagggctacggcggcggcaactgcgacggcatcatgcgccagtgcaagtgcatcaggaagtgctagctagctaggctctaggatctagcaagctagctatatcggccttttaattaattttataggatcgacgtcgtggnccggtcgctaaatatggactactattcgtctaccctacattgcatattgccccacttggtcccctaccccccgccaaacttgttggaccccccaattaaaatgcccgggcttcggtccttta

SEQ ID NO: 51771 - protein, 79 aa, Zea mays
  misc_feature: Ceres CLONE 1466860-F
  misc_feature (33)..(79): Pfam Name: Gamma-thionin Pfam Description: Gamma-thionin family
  misc_feature (54)..(54): Xaa is any aa, unknown, or other
  misc_feature (58)..(58): Xaa is any aa, unknown, or other
MWTIRKVATPQVAVLLLLLIVVAQEAAPLAEARVCRRRSAGFKGVCMSEHNCAXVCLXEGYGGGNCDGIMRQCKCIRKC

SEQ ID NO: 51772 - DNA, 659 bp, Zea mays
  misc_feature: Ceres CLONE 1466864-F
  misc_feature: Encodes the peptide sequence at SEQ ID NO. 51773
caattgggtacgggccccccctcgagccctgcagggtaaagggtgctcacacagtcactccgtttagctcatatccttatcggcgactcggcgtcggaggctcggagcccacgaccacgaccgcttccacgccctcgaccccgaacccccagtcccggacgcgaccgctgaaccctagcatactccggccatctgccgccggccccggcgatcccccgccatggcctcccccgagggcacaacgtgggtcttcgactgtccccttatggacgagctcgcggtcgccgccgacttcgcggcagcccccgcgggaggatttttctgggcagcgccgccgtcgctgcatccgcaggcgccggtgcagactgtcgctgccgcgtcggctcccaacccatgtatggaaatcagtagctctgtggactgtgatcaggagaaagaacatcccactgataaacgtccaaggtcagaatgtactacagaatcgagcacaatagcctcctgggagaatattagaatggacaaactgaacgagagattcttggagttgggtgccatattggagccagtgaaactcctactgtggacaacacagctatattgagtgatgctattcgatgtacaggtgaattgcgtagtgatgcacatgagctcatagatgc

SEQ ID NO: 51773 - protein, 126 aa, Zea mays
  misc_feature: Ceres CLONE 1466864-F
MASPEGTTWVFDCPLMDELAVAADFAAAPAGGFFWAAPPSLHPQAPVQTVAAASAPNPCMEISSSVDCDQEKEHPTDKRPRSECTTESSTIASWENIRMDKLNERFLELGAILEPVKLLLWTTQLY

SEQ ID NO: 51774 - DNA, 651 bp, Zea mays
  misc_feature: Ceres CLONE 1466866-F
cgattgggtaccgggccccccctcgagccctgcagtggtaaagggtgcgcacttcctccctacttctctctccctctgctcgctctccccagccgaagcgcccttcttccctggtctcccatggcgtcggtcgctcctccctgagctcgcccctgcgcgctctgctcccttccccacggcgcgccctctccctctcgtttctctgctggccgccgctcctgctcgttcttctggcagccacgcgaagccagcttctcatacatccgcgcctactgcctgctcggcgcccatctccctgctgccactctcccttgacgcccgcctgctcccttcgccgcgcgctcctcagctcgacgcccggtgctcctccatggcgctcggcttcttcctcctaaagtcccttcgtcgccatgtcacctttgctatttccatttcttccttctccgtactttctgttttgactttgagctgggtcggtttctactccggttgatcttttctgctgctgttgagcttctgtgctcttgcagatccccttggtgcatttagctttcatgccatgcgggagtgggcctgagttgtggcaggttgttgggtttgtaatttgttatttctgcaatccgttccagttttgtgttgatcttgttccgc

SEQ ID NO: 51775 - DNA, 667 bp, Zea mays
  misc_feature: Ceres CLONE 1466871-F
  misc_feature: Encodes the peptide sequence at SEQ ID NO. 51776
gctcttaactagtggatcccccgggctgcaggaattcgcacgagaccattacctagaacatcctaatcgaaaattcgtcctcctcgatcgtcccaacaaccgcaatggcgcagcagaggcttctcgctctcctcctggtggcggccctcctcgcgctctccttctcgcaagggcaggtggaagcgcggaaggtgcaggtgcggcgcgcgcccctcggcggcggcggccgcctgcttccggaggcgatgatggcgtacacgacgacggactacgggccccccacggccaacaccaacacccacggcggcatggtcccgtcgccggacgacccctcctcgccgccgacgcactgaccggccagtcgatctcaccggcaacaactgtgttgttctttgggattggagctttggaagagaagattggaggagaggatcggaagaagctggtcttgttcttctcccttattgggcgcgcgtgttgtgttgtgcgctgctgtgtctgtgtagaccagctgtagctgctgctgtgcttagctgattgaagttggaactgtagtgtgtccacagtattatgcatgttttgtttgttgagacgtcacaaccccatctctatcgttgaatcttgtctgaatctagccagctctatgtagcgatacatgaatgtacgt

SEQ ID NO: 51776 - protein, 82 aa, Zea mays; identical to SEQ ID NO: 44249
  misc_feature: Ceres CLONE 1466871-F

SEQ ID NO: 51777 - DNA, 667 bp, Zea mays
  misc_feature: Ceres CLONE 1466879-F
  misc_feature: Encodes the peptide sequence at SEQ ID NO. 51778
cgattgggtccgggccccccctcgagccctgtagtggtaaagggtggtccaagatcgcgtcgtgcctgccgggccggacggacaacgagatcaagaacgtctggaacacgcacttgaagaagcgggtgtcgccggccggggaggagcgcggcgccgccgggtccaagaagaagaagataaagaagacgacgaaggcagccgctggcggtggcgcggaggcgccgctgccgctcccgtcgccgtcgccgtcctcgtccacgacgacgaccaacttctccagcggcgactccggcgagcagcagagcaacaacatgagcaaggaagcggacgacgagctggacctggagaacttcgagatgatgccgatgctcgacgtcgacgaccccagcttcggctttggcacgctggtggacaccgcgccagcgccgtacggctcggccgtgtccgtgtccgtgtccgcggcaacgtctccgtgcgcctcgtccacgtccccgccgccggcgagcgccccgcccggcgtggacgacctgctcgtgctgcccgagatcgacatcggccatgagctgtggagcatcatcgacggcgatgctgctgaggcaccggcgccgtgctgcctgatgaatccggtagaagcgacgaacggcgacgacgcggccatgcaggggat

SEQ ID NO: 51778 - protein, 221 aa, Zea mays
  misc_feature: Ceres CLONE 1466879-F
IGSGPPLEPCSGKGWSKIASCLPGRTDNEIKNVWNTHLKKRVSPAGEERGAAGSKKKKIKKTTKAAAGGGAEAPLPLPSPSPSSSTTTTNFSSGDSGEQQSNNMSKEADDELDLENFEMMPMLDVDDPSFGFGTLVDTAPAPYGSAVSVSVSAATSPCASSTSPPPASAPPGVDDLLVLPEIDIGHELWSIIDGDAAEAPAPCCLMNPVEATNGDDAAMQG

SEQ ID NO: 51779 - DNA, 660 bp, Zea mays
  misc_feature: Ceres CLONE 1466881-F
  misc_feature: Encodes the peptide sequence at SEQ ID NO. 51780
  misc_feature (511)..(511): n is a, c, t, g, unknown, or other
  misc_feature (527)..(527): n is a, c, t, g, unknown, or other
  misc_feature (541)..(541): n is a, c, t, g, unknown, or other
  misc_feature (557)..(557): n is a, c, t, g, unknown, or other
  misc_feature (597)..(597): n is a, c, t, g, unknown, or other
acccgcggtggcggccgctctataactagtggatcccccgggctgcaggaattcgcacgagaccattacctagaacatcctaatcgaaaactagacgcaccccttcctcgtttcgccgcctccgccgacaccgactgcctccctcagctgccgtcgccatgggcagaaggcctgctagatgctatcgccagatcaagaacaagccataccctaagtccaggtactgccgtggtgtccctgacccgaagatcaggatatacgatgtcgggatgaagaggaagggtgttgatgagttcccctactgtgtgcaccttgtctcttgggagaaggagaatgtctccagtgaggcgcttgaggctgcccgcattgcctgcaacaagtacatgaccaagtctgcaggaaaggatgccttccaccttagggtccgggttcacccgttccatgtcctccgtatcaacaagatgctttcgtgtgctggggctgataggctccagactggaatgaggggtgnctttggcaagcctcanggcacctgtgctanggtggacattggtcangtccctcctttcgtgcgatgcaagggacacatgctgcccnatgcagcggagctctgcgtcgcgctaaagtcaagttccctgcccgccaaagatcattgaaagc

SEQ ID NO: 51780 - protein, 165 aa, Zea mays
  misc_feature: Ceres CLONE 1466881-F
  misc_feature (5)..(166): Pfam Name: Ribosomal_L16 Pfam Description: Ribosomal protein L16
  misc_feature (118)..(118): Xaa is any aa, unknown, or other
  misc_feature (123)..(123): Xaa is any aa, unknown, or other
  misc_feature (128)..(128): Xaa is any aa, unknown, or other
  misc_feature (133)..(133): Xaa is any aa, unknown, or other
  misc_feature (147)..(147): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGXFGKPXGTCAXVDIGXVPPFVRCKGHMLPXAAELCVALKSSSLPAKDH

SEQ ID NO: 51781 - DNA, 753 bp, Zea mays
  misc_feature: Ceres CLONE 1466883-F
  misc_feature: Encodes the peptide sequence at SEQ ID NO. 51782
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
cacttttctccactccgcacatcacccggggggtntnnnnnnccnnnnnctcatagctggagctccccgcggtggcggccgctctttactagtggatcccccgggctgcaggaattcgcacgagaccattacctagaacatcctaatcgaaaaacatccgctccccgccttccgcttccctaccccccgcatcacctaccaacgccggcgccatgggggccttcgcgaaggaggagcaccagttcctagccgagctcggcctcgcgcagcgcaacccaggcgcgttcgcatgcggcgcgaggggcggctcaggtcccaccggcacctccacgagcccgaccaacaatcaggtcatcgcacaggtcggggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgagggtcaggaaatcattgacatgtgggattatgctgggggactaaggcgccaacgaaatggatcccttataccggcggaacgaccaaaccatatgatgatgggaggtgtggaatccccttgggagttggggggggtaagacgggcaggtaagttcccctgggggggggcgtggggggggagggcttgggtgg

SEQ ID NO: 51782 - protein, 180 aa, Zea mays
  misc_feature: Ceres CLONE 1466883-F
  misc_feature: SWISSPROT Homolog: EC 1.2.1.3 Aldehyde dehydrogenase (NAD(+))
MGAFAKEEHQFLAELGLAQRNPGAFACGARGGSGPTGTSTSPTNNQVIAQVGEASVHDYEEGMRACFDAAKTWMAIPAPKRGEIVRQIGDALRAKLHHLGRLVSLEMGKILPEGIGEGQEIIDMWDYAGGLRRQRNGSLIPAERPNHMMMGGVESPWELGGVRRAGKFPWGGAWGGRAWV

SEQ ID NO: 51783 - DNA, 631 bp, Zea mays
  misc_feature: Ceres CLONE 1466889-F
  misc_feature: Encodes the peptide sequence at SEQ ID NO. 51784
cgggccccccctcgagccctgcagtggtaaagggtgtatcgtcatccaccacgatcgataaagctaattaagctgctactgctacgctagcctcgatcgatcaagcaagcagctcacagacccaccggcccacccacccacccacatggcggcgtcccgttccgctctgatcacgctgctcgtccttgtgagctccgtcgcggcggcctcggcgaccacgttcaccgtctgcgacagtagcgagctggaatcctagcttccactacgacaactgggccagtgccaagaccttcacggatggagatcaactagtgttcaacttcgccaccgggaaccacgacgtgatggaggtggacaacagcggatacgacggctgctccaccaccaacgccgccaagacaatcgaaaacgggccggccaccgtctacctcagctccggcacccactactacatctgcagcttcaccggtcactgcagcgccgggatgaagctcgatgtcaccgtcggctccggctccggctccgggtcgccctacccacggtgcgggtcgtgcagcacacccaaattcaacatgctgatcgcccccacccccgatactccggccagagcgtctgtgtccctcacagccgg

SEQ ID NO: 51784 - protein, 95 aa, Zea mays
  misc_feature: Ceres CLONE 1466889-F
  misc_feature (1)..(48): Pfam Name: Cu_bind_like Pfam Description: Plastocyanin-like domain
MEVDNSGYDGCSTTNAAKTIENGPATVYLSSGTHYYICSFTGHCSAGMKLDVTVGSGSGSGSPYPRCGSCSTPKFNMLIAPTPDTPARASVSLTA

SEQ ID NO: 51785 - DNA, 668 bp, Zea mays
  misc_feature: Ceres CLONE 1466891-F
  misc_feature: Encodes the peptide sequence at SEQ ID NO. 51786
cgattgggtaccgggccccccctcgagcactgctgtggtaaagggtgtggtggtggcgtcatcgtgtctcctcgatcccctctcgttcctccctcgtcgcctcatcaattcaagatccaatctttgctgctgccactcggcgatccgatcgttctcgagcaaggtcggtggccatggcacgctgccgccatcacctcctcctcctttccgtcttacttgccttggctgctgctgctgcgcggcaggcgcagagtcatggaaaagcctccgccgtcttcatcgatgcctcgtcgcaccgctaccttcgggaccagcaagccgaccaccaggacgcttcaatgtcgttaaatgaagtttctgcggttgtttctgtcttgcttggtttcgcaccgtcaacatccctaccaggtattcccccctcgaagttgaacacagttcttcttcctaatccatttgataaaccgcgtgctgttttcctcgtgcaaattgatgggtttaattgttcctagcttcttatctgaaggcaccaacatcttccagaaccaagattgaaggtgccaaacatcgcctgaatacagggctttacagaataaaggatgactttaatttgtccattcatctccagatgaaatcctctaagattctcctcctcgaatcaagaattattc

SEQ ID NO: 51786 - protein, 111 aa, Zea mays
  misc_feature: Ceres CLONE 1466891-F
MARCRHHLLLLSVLLALAAAAARQAQSHGKASAVFIDASSHRYLRDQQADHQDASMSLNEVSAVVSVLLGFAPSTSLPGIPPSKLNTVLLPNPFDKPRAVFLVQIDGFNCS

SEQ ID NO: 51787 - DNA, 648 bp, Zea mays
  misc_feature: Ceres CLONE 1466895-F
  misc_feature: Translation starting site: 480
  misc_feature: SWISSPROT Homolog: EC 1.11.1.7 Peroxidase
tcgagccctgcagtggtaaagggtggccgccgccctcgccggcggcgcgcgggcgcagctcaaggaggggttctacgactactcctgcccacaggcggagaagatcgtcaaggactacgtgaaggcgcacatcccccacgcgcccgacgtcgcctccaccctgctccgcacccacttccacgactgcttcgtcaggggctgcgacgcgtcagtgctgctcaacgcgacgggcggcagcgaggcggagaaggacgcggcgcccaacctgacgctgcgcggcttcggcttcatcgaccgcatcaaggcgctgctcgagaaggagtgccccggcgtggtgtcctgcgccgacatcgtcgcgctcgccgcccgcgactccgtcggtgttatcggtttttcccccccccatcgtgccgacggggaggcgcgacggcaccgtgtccatccagcaggaggcgctggaccagatccccgcgcccaccatgaacttcacccaactcctccagtccttccagaacaagagccttcaacctcgcctacctcgtctggctctcagggggttcacacgaatcggaatctccccaatggacttcccttcagccgagcgcctgttactacttccacggggccggcggaggagccccgaacaac

SEQ ID NO: 51788 - DNA, 615 bp, Zea mays
  misc_feature: Ceres CLONE 1466896-F
  misc_feature: Pfam Name: DUF239 Pfam Description: Arabidopsis proteins of unknown function
cgattgggtccgggcccccctcgagccctgcagtggtaaagggtaggtgacgggggaccagttctacggcgccaggccagcctgacgtgtggtccgccaggtggcgtcggcggcggagttcagcctctcccagatctgggtcatctccggctccttcggcaacgacctcaacaccgtcgaggccggatggcagcaaaccgcttgggctccggcccgaggtggtgtggtgtagaactggtgctcattaattagattccatcactgtgaccccgattgggaatgtgagcccctgactgtacggagatagcagccccagggttctcccattattgaacgaccgaccccttccccggaaaacggggtggttaaaacctggaactggtccgggtttcttccaaaacaaacaaccggatcgccctttgaaggctgcttttttccccaacccccggggctggttgaaaattccagggggggttaaaacccccgcccgggggggaaacattttttttcccacccaaggggcccttgacaaaaacaggccccctggcccccgggtaaaaaaattgttaccgcgcggggggggaaaaaatttgtttttttttttggtgggaaata

SEQ ID NO: 51789 - DNA, 727 bp, Zea mays
  misc_feature: Ceres CLONE 1466897-F
  misc_feature: SWISSPROT Homolog: EC 3.2.1.1 Alpha-amylase
  misc_feature (398)..(398): n is a, c, t, g, unknown, or other
cgattgggtaccgggccccccctcgagccctgcagtggtaaaggtgcttgctccttctcctgggactggcgtccggccaggtcctgttccaggcgttcaactgggagtcgtggaagcagagcggcggatggtataacctcctgatggggaaggtcgacgacatcgcctccgccggcgtcacgcacgtctggctcccgccgccgtcgcactccgtctccacccaaggttacatgcctggccgtctgtacgacctggacgcgtccaagtacgggacggcagcggagctcaagtcccctgatcgccgcgttccacggcaagggcgtgcaggtgggtggcggaaatcgtcttcaaccacccggtgcgcccgacttacaagggacgcccgccggcattctaantgcatcttccaaggggcggcaacgcccggacggccccccttggaactgggggcccccccacatgaatcttggcccgcgacggaacaccaatattactcgggacgggcacgggcccaaacctccgaacacggggggcccgactttcggccgcgggggccccgaacatccgacccaaccttcaacgaacccgcgttcccagcggggaagctccaccgaactgggcttgctcctgggctcaaagtcctcccagaccttggggttttcaacgcccttggggcccttcaactttccgccagagggcctacttccccccgaaggtcccccaaggg

SEQ ID NO: 51790 - DNA, 630 bp, Zea mays
  misc_feature: Ceres CLONE 1466899-F
tcgagcactgcagtggtaaagggcatcctcttgaaatccaagctttattctactctgctttacgatgctcacgagaaatgcttgtcgtgaatgatggatcgaaaaacctcatccgtgccattaataacaggctcagtgcattgtcctttcacatcagagaatattactgggttgacatgaagaagataaatgagatatacagatacaagacagaagaatactcacatgatgccactaacaaattcaacatttaccctgagcaaatcccttcctggcttgttgactggattcctgagaaaggaggttaccttatagggaatctgcagccagctcacatggattttaggttcttctctcttggtaacctttgggctatagcttcgtctctaactactccaaaacaagctgagggaatccttagccttatcgaagaaaagtgggatgatcttatagcaaacatgcccctcaagatatgctaccctgcaatggaagatgatgaatggcgcattattactggcagtgatcctaagaataccccatggtcatatcataaatggtggatcttggcccaccctattgtggcagttcacactggcgtgcataaaaatgggtagaccagaattggcccgg

SEQ ID NO: 51791 - DNA, 626 bp, Zea mays
  misc_feature: Ceres CLONE 1466901-F
  misc_feature: Encodes the peptide sequence at SEQ ID NO. 51792
tcgagccctgtcctggtaaaggttgtcttggcaggctgcgacggatcacggaggcgaaggaggagcagaagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggtaaggtcacgactgacaagagctagcctgctgggttcatggatgtcatttccatccccaccacaatggagaactacaggctgctttatgacaccaagggccgcttccgtcttcacccaatcagggatgaggatgccaagttcaagctctgccaggtgaggtctgttcagtttggcccgaagggcatcccctacctgaaacctacgacggacgcaccatcggctaccccgacccgctcatcaaggccaaccaccccctcaaaatcgatctggagaccaacaagatcatg

SEQ ID NO: 51792 - protein, 81 aa, Zea mays
  misc_feature: Ceres CLONE 1466901-F
  misc_feature (3)..(40): Pfam Name: RS4NT Pfam Description: RS4NT (NUC023) domain
MARGLKKHLKRLNAPKHWMLDKLGGAFAPKPSSGPHKSRECLPLILIIRNRLKYALNYREVISILMQRHVLVDGKVTTDKS

SEQ ID NO: 51793 - DNA, 680 bp, Zea mays
  misc_feature: Ceres CLONE 1466912-F
  misc_feature: Translation starting site: 168
ctccccgcggtggcggccgctctagaactagtggatcccccgggctgcaggaattcgcacgagaccattacctagaacatcctaatcgaaaaagcgtgctgccttgcaagctgctaactagaataggaatccgacgtcgcccccgcccccccctgtgaaaattcgtgatgcggagaacagctaccgccgccctcgtcctcgtccccctcctcgctgcggcggtacagacctccgccctgcctttcatcgtcctgcacgggattggggaccagtgcgtcaaccatggcgttgccaagttcactaaacttctcgccgattggtccggctccgacggctactgcctagagattggcagaggaacatgggactcttgggtcatgcctcttcaacaacaggctgatataatctgcaacaaggtcaccaccccaaccgatttgcgctgtttgatgagttgttcaaaactacactctgccacttttgattttttttccagggcaaggaaatgaaacaactgagaggtggcttcaacatagttggtctgtctcaggggaacttgattggtcgagcagtggttgagtactgtgatgatggaccgccgattatctgaagagttgtaggtttcttccaaaacttaacaatgaaattccagataaaagaaatgccacctacaaggtacgatt

SEQ ID NO: 51794 - DNA, 644 bp, Zea mays
  misc_feature: Ceres CLONE 1466915-F
  misc_feature: Encodes the peptide sequence at SEQ ID NO. 51795
  misc_feature (114)..(114): n is a, c, t, g, unknown, or other
  misc_feature (124)..(124): n is a, c, t, g, unknown, or other
  misc_feature (493)..(493): n is a, c, t, g, unknown, or other
  misc_feature (533)..(533): n is a, c, t, g, unknown, or other
  misc_feature (536)..(536): n is a, c, t, g, unknown, or other
  misc_feature (554)..(554): n is a, c, t, g, unknown, or other
  misc_feature (563)..(563): n is a, c, t, g, unknown, or other
ggagctccccgcggtggcggccgctctagaactagtggatcccccgggctgcaggaattcgcacgagaccattacctagaacatcctaatcgaaaaacaagctggtcacaaacntcagcacacnaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtaccgcgggaggaaggtgggggccaggacggaggtgcgggacgtggagggcgacggcgaggtgcaggagctcggccggttctccgtcgccgagtacaaccggcagctccgagaaggtggcggcggcggcggcaggctcgagttcggcagggtggtggcggcgcancggcaggtggtgtcggggctcaagtactacctccgcgtcntgnccgtggaagagggcggcncggggaacngccgcaagcgcgtgttcgacgccgtcgtcgtcgtcaagccttggctcgactcgcgcaccttgctcacgttcggcgccggcg

SEQ ID NO: 51795 - protein, 147 aa, Zea mays
  misc_feature: Ceres CLONE 1466915-F
  misc_feature (97)..(97): Xaa is any aa, unknown, or other
  misc_feature (111)..(111): Xaa is any aa, unknown, or other
  misc_feature (112)..(112): Xaa is any aa, unknown, or other
  misc_feature (118)..(118): Xaa is any aa, unknown, or other
  misc_feature (121)..(121): Xaa is any aa, unknown, or other
MARALGACVLLAVLLGALAPAAAARAHDDQGSGAGIRQPSGEYRGRKVGARTEVRDVEGDGEVQELGRFSVAEYNRQLREGGGGGGRLEFGRVVAAXRQVVSGLKYYLRVXXVEEGGXGNXRKRVFDAVVVVKPWLDSRTLLTFGAG

SEQ ID NO: 51796 - DNA, 708 bp, Zea mays
  misc_feature: Ceres CLONE 1466919-F
  misc_feature: Encodes the peptide sequence at SEQ ID NO. 51797
ggagctccccgcggtggcggccgctctagaactagtggatcccccgggctgcaggaattcgcacgagaccattacctagaacatcctaatcgaaaaaccagcggtacccagcccacaccggcagatcagctgcgagctagtagacatcgaccggaccgaccaacaggagcagcaagccgggctagctcgctcgctcgctcgcaatggcttccatcatcgtgcaggcggtggtcatcctcctggacgtcatcgccttcggcctgggcgtcgccgccgagcagcgccgcagccgggccaccgtcaccccggacgccgccaaggagtacgactactgcgtctacgactccgacatcgccacgggctacggcgtcggcgcgctgctcctcctcgccgccgcgcaggtcgtgctcatgctcgccagccgctgcttctgctgcggccgcgggctcaagccgggaggctcccgcgcctgcgccctcatcctcttcctcttcacatgggtgaccttcctcatcgcggaggcgtgcctgctggcgggatcagtacgcaacgcgtaccacacccgggacaggggcggattctaccgcgaatccctctcatgcgagacggggcggaagggcgtcttctctgctggggcggcatttatcttcttcatcggcagcctgggggagggagggtacctcacctactccaacccaagacccggag

SEQ ID NO: 51797 - protein, 168 aa, Zea mays
  misc_feature: Ceres CLONE 1466919-F
  misc_feature (44)..(159): Pfam Name: DUF1218 Pfam Description: Protein of unknown function (DUF1218)
MASIIVQAVVILLDVIAFGLGVAAEQRRSRATVTPDAAKEYDYCVYDSDIATGYGVGALLLLAAAQVVLMLASRCFCCGRGLKPGGSRACALILFLFTWVTFLIAEACLLAGSVRNAYHTRDRGGFYRESLSCETGRKGVFSAGAAFIFFIGSLGEGGYLTYSNPRPG

SEQ ID NO: 51798 - DNA, 684 bp, Zea mays
  misc_feature: Ceres CLONE 1466945-F
  misc_feature: Encodes the peptide sequence at SEQ ID NO. 51799
  misc_feature (483)..(483): n is a, c, t, g, unknown, or other
aagctggagctccccgcggtggcggccgctctagaactagtggatcccccgggctgcaggaattcgcacgagaccattacctagaacatcctaatcgaaaaattaattaatggccgccaccaagaaccctccaacccccacctgaccttctcttcctccctcccccgaccgcctgtctgtcctccgcgcatccgttctctatcgaaagggaggaggaggagcgcgcgggagtgggctgggggcccaccgatgctgagctcggcgtcctcggccggggcggccatggggatgggcggcgggtaccaacaccagccgctgccactgccgcagcgcggggcggcggccgcggtcttcaccgccgcgcagtgggcggagctggagcagcaggcgctcatctacaagtacctcatggccggcgtccccgtcccgccggatctcctccgccccgcccccacgccgccgccttctccttcgccagccccngcgcgtcgccctttctaccataccaacaccacaaccggtccctggatttatacgcctactaagggaaaaaactgggacccggaaccctggggggggcccccccaccaaccgcaaaaaatggcggggctcccaggaaggccccccccgactcccattactgggaagccccccatgccccggggccccaacccgttctaaaaa

SEQ ID NO: 51799 - protein, 143 aa, Zea mays
  misc_feature: Ceres CLONE 1466945-F
  misc_feature (33)..(69): Pfam Name: QLQ Pfam Description: QLQ
MLSSASSAGAAMGMGGGYQHQPLPLPQRGAAAAVFTAAQWAELEQQALIYKYLMAGVPVPPDLLRPAPTPPPSPSPAPARRPFYHTNTTTGPWIYTPTKGKNWDPEPWGGPPHQPQKMAGLPGRPPPTPITGKPPMPRGPNPF

SEQ ID NO: 51800 - DNA, 685 bp, Zea mays
  misc_feature: Ceres CLONE 1466950-F
  misc_feature: Encodes the peptide sequence at SEQ ID NO. 51801
tggagctccccgcggtggcggccgctctatatctagtggatcccccgggctgcaggaattcgcacgagaccattacctagaacatcctaatcgaaaaatccaaacctccaccaactctgacgcacgttgattgaacgagaaccagttggataaccatgaccgccacctcgcggacacagcatcccaaggggatgctaaccccggcctccgacggaggcgagcccttcgccaagttcttcgagtgctggatcttggacaagtcccgtgacctgtcagcgctccgcgccgcagccacagcacggcccgacgactctgacctccggcgactagtcgatcgtgtcctcggacactaagagcactactaccgggctaagtcagcagccccctccgcccatgtgctccccatgctagcggcctcctggatctccgccaccgagagactctacctctggagaggcagctggcgacccacttccgcgatccaactgcacgtagccaagtccggactgcaactagaggaacagctccctgcctacctcgacggcggcagcctaggggacggtgacctgggaggcctctccgcggaaaaggtccaggccgccgaccaggtgcatcgccgcagcataccgaaggaacgggaagatccaggaggccgccggcggtcaccaggaatccttgggcacca

SEQ ID NO: 51801 - protein, 93 aa, Zea mays
  misc_feature: Ceres CLONE 1466950-F
MLAASWISATERLYLWRGSWRPTSAIQLHVAKSGLQLEEQLPAYLDGGSLGDGDLGGLSAEKVQAADQVHRRSIPKEREDPGGRRRSPGILGH

SEQ ID NO: 51802 - DNA, 681 bp, Zea mays
  misc_feature: Ceres CLONE 1466957-F
  misc_feature: Encodes the peptide sequence at SEQ ID NO. 51803
ctccccgcggtggcggccgctctagaactagtggatcccccgggctgcaggaattcgcacgagaccattacctaaacatcctaatccaaaaccgttccgtctcattctcatccccgaccccctcacctcaccgtaaaacctagtccccggcggtcaccttgcagcctccgctgccctctgacgggagcacgatgaaacgaaaaactgcatcattccagatcaatcctgcatggttacccccatccaatttgatgaacaactgtggatctggcgattactccgaggttacaaacgcttactgtctggtaccgattggagggacacacaacttctaccgcgtctttgaggctgagcttgcaaatgccatccctgtggtcaagacctctattggtggcactataataatacgccgactttgtgttggaaacaatagaggacttctattgcctcgtactacaaccgaccaataccttcctcatctgatgaattgattgcctgatcaactggaggttcaccgcattgatgagagggtatctgcccttgacaattgcatagcctgcgatgaccatgttgcatttacgcaccctgaccttgacaaggatactgatgagtacattgcttatgtgcttggggatcgagatgtttaggcttactattgctggaaatatccttgatgttgag

SEQ ID NO: 51803 - protein, 99 aa, Zea mays
  misc_feature: Ceres CLONE 1466957-F
MKRKTASFQINPAWLPPSNLMNNCGSGDYSEVTNAYCLVPIGGTHNFYRVFEAELANAIPVVKTSIGGTIIIRRLCVGNNRGLLLPRTTTDQYLPHLMN

SEQ ID NO: 51804 - DNA, 681 bp, Zea mays
  misc_feature: Ceres CLONE 1466961-F
  misc_feature: Encodes the peptide sequence at SEQ ID NO. 51805
tgagctccccgcggtggcggccgctctagaactagtggatcccccgggctgcaggaattcgcacgagaccattacctagaacatcctaatcgaaaaggcgaaattcgcaatattcattcatcagtaaccaaaatttcgagtttttttaaatacactataaccgagagcctgaaaatgggaacaaactagcaactgaagcgtaccaacaaaaaacgcccgattcgcctcgcaaaatcgccgccgccatcgcctactccaccagacgccgatagttccgccttcctttcctgctgcgcgcctgtcgccatggtgaagcggtggcttcccctcgaggccaaccccgacgtcatgaaccagttcatgtggggactgggggtccccgaggacgtggggttctgcgacgtgtacggcctcgatgacgagttgctcgccatggtgccccagccggtgctcgcggtcctacttctctacccccaggaccggagcaaggagtcccaagcttcagctacctcgtcggtggagaccaaggagcccagcaagaacgtatatttcacaaagcaaactgttgggaatgcctgtggcacagttggtattattcatgcactggggaatgctacttccagaatcaagttaggtgaggggtcatattttgatagattttataaacgaactgctgacatg

SEQ ID NO: 51805 - protein, 125 aa, Zea mays
  misc_feature: Ceres CLONE 1466961-F
  misc_feature (4)..(125): Pfam Name: Peptidase_C12 Pfam Description: Ubiquitin carboxyl-terminal hydrolase, family 1
  misc_feature: SWISSPROT Homolog: EC 3.4.19.12 Ubiquitinyl hydrolase 1
MVKRWLPLEANPDVMNQFMWGLGVPEDVGFCDVYGLDDELLAMVPQPVLAVLLLYPQDRSKESQASATSSVETKEPSKNVYFTKQTVGNACGTVGIIHALGNATSRIKLGEGSYFDRFYKRTADM

SEQ ID NO: 51806 - DNA, 696 bp, Zea mays
  misc_feature: Ceres CLONE 1466962-F
  misc_feature: Encodes the peptide sequence at SEQ ID NO. 51807
ccccgcggtggcggccgctctagtactagtggatcccccgggctgcaggaattcgcacgagaccattacctagaacatcctaatcgaaaactgctctagcgtccgcttttcagctctccaccgctatctcgcacgttgctccccaaatcatcccatcctactcccgcggccgtggcgccgaatccataagcgtctagaagggggaggtggtcgcccatgaccgtctgaccggccgtcgccatgggatgctctggatccactcccaagactgacgataatggtgagaatttgaagaaacccaagccttggaagcacacccaagcaataacgccggcacaactcacacagatgcgtgatgaattttgggaaactgctccccactgtggccgacacaaggacatttgggacgcacttagagcaccctgaagactctgacctactccttgagcaaaccatagaggatagtgctggcctcctcgctattcaattccgacatgacacttcgcctccatgaaaaagatgtcgcattcgagcatcccaactacgttctactcgagcccactgacttgatcaaggacggttgaactgatccaatagacccgggagccaatgaaccttatgccgatcacattattataccgactccacgctggcatgattttggaacttcgatcgcattatcatggactcagatcg

SEQ ID NO: 51807 - protein, 61 aa, Zea mays
  misc_feature: Ceres CLONE 1466962-F
MGCSGSTPKTDDNGENLKKPKPWKHTQAITPAQLTQMRDEFWETAPHCGRHKDIWDALRAP

SEQ ID NO: 51808 - DNA, 707 bp, Zea mays
  misc_feature: Ceres CLONE 1466963-F
  misc_feature: Encodes the peptide sequence at SEQ ID NO. 51809
aagctggagctccccgcggtggcggccgctctattctagtggatcccccgggctgcaggaattcgcacgagaccattacctagaacatcctaatcgaaaaattcttttccaacgcgactacccgtctacgcctctcctctgctttcccctctggcccttccgatggactactcgagtggcgcgacggattcggggagggtgcgagcacgttggtgctactgcctctgcttccagccgttggtgacgctgcttctgcggctgctcctgctgctactgcttccccgacgagccccacgacgaccgccgcgccgcagcgtacgcttaggctcctggactctccactcgcagtcgcatggagagtcgcatatatgcatatgaacagtatgagggaactggatttctgtcctcatgtacactaggcaaatggctaccttgctcttcatatagatgttgaagaggatattaccgcttctgagaatcacagctctcttttttggtgcttgtactgttgctactaagccccgacgatgatgtgaatcatagtagcacttcgtgcattctaatctgtgtgctgtggttcacgaaactaaaatagaatgtgtcgagtgtttctgtgtgggcggatgtttgcctcttctgtactcggctgatcttcttctccgcttgaagcaatagttcacagatctcctccctggtatgttcgatca

SEQ ID NO: 51809 - protein, 33 aa, Zea mays
  misc_feature: Ceres CLONE 1466963-F
MESRIYAYEQYEGTGFLSSCTLGKWLPCSSYRC

SEQ ID NO: 51810 - DNA, 768 bp, Zea mays
  misc_feature: Ceres CLONE 1466965-F
  misc_feature: Encodes the peptide sequence at SEQ ID NO. 51811
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (54)..(54): n is a, c, t, g, unknown, or other
  misc_feature (437)..(437): n is a, c, t, g, unknown, or other
ttgtttcccccnntttcncccccccgcctcttgttggaactatntttttnnttncaaagctggagctccccgcggtggcggccgctctatactagtggatcccccgggctgcaggaattcgcacgagaccattacctagaacatcctaatcgaaaaaaaaacagtgccagagtggttgctgtgcaatcagctagtagctaggtagtcgaggttctcctcggctccttccatcattccatcgtctttgctcgaggagtcgaggttcaggttccacggtgcggcgagagctcgcagccatggagagcaagagcccatggtcgctgcggctgctagtttgctgcgcggcaatggtggccgtcgcgcttctctcccaccaaggaggccaggccgcttgtttcgtgcctacgccgggtcctgctccggttccgtcaggttcntccgcgacgaatactaaatgaatcctccgctgcccctcggccagccaagtccagcgcatttcaacccccaatgtacggtggcgtcactccccggtgagccctccagccccccctaagtgccgccggccggtgccccggggccggagctcggcgaagcgcgtaccagaaaccgggactcttctttcttgccgcaactgtctgcgcgaaaggcttgtcgccagccgccttgctccctcttccacaacaaatacctgcccctggttacaccattggaaaaaccaatctcggattgccccaaatcgcccctaagaagggcctcgtctactcgatg

SEQ ID NO: 51811 - protein, 53 aa, Zea mays
  misc_feature: Ceres CLONE 1466965-F
MESKSPWSLRLLVCCAAMVAVALLSHQGGQAACFVPTPGPAPVPSGSSATNTK

SEQ ID NO: 51812 - DNA, 631 bp, Zea mays
  misc_feature: Ceres CLONE 1466978-F
  misc_feature: SWISSPROT Homolog: EC 6.3.1.2 Glutamate--ammonia ligase
  misc_feature (217)..(217): n is a, c, t, g, unknown, or other
  misc_feature (218)..(218): n is a, c, t, g, unknown, or other
  misc_feature (228)..(228): n is a, c, t, g, unknown, or other
  misc_feature (234)..(234): n is a, c, t, g, unknown, or other
  misc_feature (238)..(238): n is a, c, t, g, unknown, or other
  misc_feature (240)..(240): n is a, c, t, g, unknown, or other
  misc_feature (241)..(241): n is a, c, t, g, unknown, or other
  misc_feature (259)..(259): n is a, c, t, g, unknown, or other
  misc_feature (269)..(269): n is a, c, t, g, unknown, or other
  misc_feature (278)..(278): n is a, c, t, g, unknown, or other
  misc_feature (279)..(279): n is a, c, t, g, unknown, or other
  misc_feature (294)..(294): n is a, c, t, g, unknown, or other
  misc_feature (312)..(312): n is a, c, t, g, unknown, or other
  misc_feature (313)..(313): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (415)..(415): n is a, c, t, g, unknown, or other
  misc_feature (416)..(416): n is a, c, t, g, unknown, or other
  misc_feature (425)..(425): n is a, c, t, g, unknown, or other
  misc_feature (426)..(426): n is a, c, t, g, unknown, or other
  misc_feature (429)..(429): n is a, c, t, g, unknown, or other
  misc_feature (430)..(430): n is a, c, t, g, unknown, or other
  misc_feature (449)..(449): n is a, c, t, g, unknown, or other
  misc_feature (458)..(458): n is a, c, t, g, unknown, or other
  misc_feature (459)..(459): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (490)..(490): n is a, c, t, g, unknown, or other
  misc_feature (557)..(557): n is a, c, t, g, unknown, or other
  misc_feature (565)..(565): n is a, c, t, g, unknown, or other
  misc_feature (567)..(567): n is a, c, t, g, unknown, or other
  misc_feature (575)..(575): n is a, c, t, g, unknown, or other
  misc_feature (579)..(579): n is a, c, t, g, unknown, or other
  misc_feature (581)..(581): n is a, c, t, g, unknown, or other
  misc_feature (601)..(601): n is a, c, t, g, unknown, or other
  misc_feature (603)..(603): n is a, c, t, g, unknown, or other
  misc_feature (630)..(630): n is a, c, t, g, unknown, or other
cgattgggtaccgggccccccctcgagccactgcagtggtaaaggcggcttccctggccctcagggtccttactactgtggaatcggcgcggagaaatcgttcgggcgtgacatagtcgacgcccactacaaggcctgcctgtacgcaggcatcaacatcagtggcatcaacggggaggtcatgccggggcagtgggagttccaggtcggaccgtcnncgtcggcatncttctntcgngnngcgaatcagggtggtggnggttggcttncgctacatnntcttgaagaggaatncaaccgagaaatcgccgnngcgtgggtgggtgaaacgtttcgaacccccgaaagccccgaaatcccccgggggtgggaaattggggaaaaaacgggggcccccccggggggnnnnnncccnnttccccctnnttnncctccctcctttttttctntttttctcnntttcccctccctttttctctttcnnnccctntcctttcccctttttcttctcttcctcccccccctccctctcctcctccccccccttctttcctctntttttttncntccccccntttntntccttttctctcctcccctntntctcctctttcctccgccttccccccnc

SEQ ID NO: 51813 - DNA, 641 bp, Zea mays
  misc_feature: Ceres CLONE 1466980-F
  misc_feature: Encodes the peptide sequence at SEQ ID NO. 51814
cgattgggtccgggccccccctcgagccctgtcgtggtaaaggctttccaaatcgctagctctctgttccgcttcctcctcttgtttccctccaatttggctctgttcttcaatacttgatgttgtggagtgtgttctccccatggagcccggagcaggtcccgctgctcccgcgcagggaggttctcctgaggtcctctcctacaacaaggccgccatccccggctccgacccgtctcctccgtctgccgacgactccgaggccctggccttctgctagaaagttgccgatgatcctgctcccgagaagcctgcccctgcgaagcatgggggctccaatgacaggtatctctctcttgcccgggtggaaacagagaagaggaactctttgatcgattcttgggaagagaatgataagaccaatgctgagaacattgctgctaagaaagtatccgctattctttcatgtcgatacaccactaaagctaacgtagaatctgagctgatcaagattgatgaacaactggaaaagaataaggctgaatatgcacagaatatgaagatcaaggttgctatgatacacaaggaagccgaacacaagctcgtgatgatgcatgcaacccgcggtatcgactgtctga

SEQ ID NO: 51814 - protein, 45 aa, Zea mays
  misc_feature: Ceres CLONE 1466980-F
MEPGAGPAAPAQGGSPEVLSYNKAAIPGSDPSPPSADDSEALAFC

SEQ ID NO: 51815 - DNA, 740 bp, Zea mays
  misc_feature: Ceres CLONE 1466984-F
  misc_feature: Encodes the peptide sequence at SEQ ID NO. 51816
  misc_feature (20)..(20): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (52)..(52): n is a, c, t, g, unknown, or other
accttattaactcccaatcnaaacccccccaaaaaaaaaaaaaannannaanacccgaattgggtacgggccccccctcgagccctgtcgtgggaaaggcatatcggtaaaggagaatggggcctggaagttcgaatagtgtgcggattggatcttcaagaaggccagtagcttggccactaatggcagcccggacatctgcttcaggttctcggccttcttcacctaggtcacttgttgatggggaaggttacaacagtgctgatgaacagggcccctgttatgccttgagttatgatgattcggaaagggagcgtatgtttgaccatgacctaaggcgagtgaaagggttggaaatcagaaagatggccgaagatgggaactgtctattcagagctgttgctaatcaagtttatggagacgcagaagcttatgacatggctaggcagatgtgtgttgattatatggaaagggaacgggatcatttctctcatttcataactgacattgaaagttttacattatactgtaagaggaaaaggagtgataaggtttatggcaacaatgttgagatcccaggcatttgcagagatgtacaatcgtcccctttcacatataatcccaccggtacaaaagcccatttaatattttttcaagggaagctaataacacagaaccttttcctcccaatttacaattaaagtttccccacttaatgggcaaatccttttaccccattc

SEQ ID NO: 51816 - protein, 194 aa, Zea mays
  misc_feature: Ceres CLONE 1466984-F
  misc_feature (85)..(186): Pfam Name: OTU Pfam Description: OTU-like cysteine protease
MGPGSSNSVRIGSSRRPVAWPLMAARTSASGSRPSSPRSLVDGEGYNSADEQGPCYALSYDDSERERMFDHDLRRVKGLEIRKMAEDGNCLFRAVANQVYGDAEAYDMARQMCVDYMERERDHFSHFITDIESFTLYCKRKRSDKVYGNNVEIPGICRDVQSSPFTYNPTGTKAHLIFFQGKLITQNLFLPIYN

SEQ ID NO: 51817 - DNA, 668 bp, Zea mays
  misc_feature: Ceres CLONE 1466987-F
  misc_feature: Encodes the peptide sequence at SEQ ID NO. 51818
cgattgggtaccgggccccccctcgagccactgcagtggtaaagggcgcgatccatccatccatctattctccagtccacccattccattccactacccacgcgcagaattcacgcgaacgcacacgcacccacacgacacatccagatgatgcttagggtttccccgtccccggccgccgcggtgtcaacccagctctccggtgcgcccgcgacccctgctcccgtcgtcagggtggcggcgccgcgcggcgtcgcctcgccagccgctggcgccgcgtgcagggccgcgggcaaggggaaggaggtgctcagcggggtcgtgttccaccccttccaggagatcaagggggagctcgccctcgtgccccagtccccagacgagtcgctcgcgcaccacaagttcgtcgatgactgcgatgacaccctcaacgagcagatcaacgaggagtacaacgcctcgtatgcataccactccctcttcgcctacttcgaccgcgacaacgtggctctcacaggatttgccaagttcttcaaggaatccagcgactaagacagggagcacgctgtatagctcatgtagtaccataacatacgtggaggcagggtgaggctcccatcgattgtgacgtctttaatcgagtttgaccatcctgataaatgagatgc

SEQ ID NO: 51818 - protein, 134 aa, Zea mays
  misc_feature: Ceres CLONE 1466987-F
  misc_feature: SWISSPROT Homolog: EC 1.16.3.1 Ferroxidase
MMLRVSPSPAAAVSTQLSGAPATPAPVVRVAAPRGVASPAAGAACRAAGKGKEVLSGVVFHPFQEIKGELALVPQSPDESLAHHKFVDDCDDTLNEQINEEYNASYAYHSLFAYFDRDNVALTGFAKFFKESSD

SEQ ID NO: 51819 - DNA, 678 bp, Zea mays
  misc_feature: Ceres CLONE 1466990-F
  misc_feature: Encodes the peptide sequence at SEQ ID NO. 51820
cgattgggtaccgggccccccctcgagccctgcagtgggaaaggctgtgattgagatttcagaatattctctgtctctctcactctcactctctctcttttttataaaaaaaaaatcaatccagattagggacacttgcttcaaaggctatattcttggaagaattagtgtgattcatggcaggttctcagagcgcccaagagaatggcacgcatctgaactgaaatggaaactgtgctgtcaccaccactgcaggagtggaggatgtgatcgccgactccaaggcgcacaaggtgctggtgaaggggaagaaggcggccgccgaccccatgaaggtggtggagcgcgtgcagaagaagactggccgcaaggtcgagctgatgtcgccgatgccgcccccgccggaggtggaggagaagaaggaagatgaggcggagaagaagaaggacgatgagaagaaggcagagcccgagccgccgaagccggaggagaagaaggagccgccggtgatcgctgtggtgctgaaggtgcacatgcactgcaaggcgtgcgccgaggggatcaagaagaggatcctcaagatgaaaggtgtgcagtccgaaaaaaccgacctccaggcgtcccgaagtgacggggaagggcgtgttcaaagaagccaaagctgggcggaatacgtga

SEQ ID NO: 51820 - protein, 116 aa, Zea mays
  misc_feature: Ceres CLONE 1466990-F
MKVVERVQKKTGRKVELMSPMPPPPEVEEKKEDEAEKKKDDEKKAEPEPPKPEEKKEPPVIAVVLKVHMHCKACAEGIKKRILKMKGVQSEKTDLQASRSDGEGRVQRSQSWAEYV

SEQ ID NO: 51821 - DNA, 651 bp, Zea mays
  misc_feature: Ceres CLONE 1466995-F
  misc_feature: Encodes the peptide sequence at SEQ ID NO. 51822
cgattgggtccgggccccccctcgagccactgcagtggtaaaggagggctcatcaaacgtgactgcccacacttcagtcttgtccggttgtcccatcacagctaaagcaaaaccaccacccatcgagctgatcctgatcatcactcttttcccgacacaaagagggcaccaagaatcccctccatcgacgacgaaggcgatggcgccgctgccgcaggccgtccacctcctcctcgccttcgccctcgcgcttggctgcctggcgggcggcgccaccgcgacggtggtgacgacgtgcagggcggcggcggacagcgacgcgcgcgtggactacgcgttctgcgtcgccgagctgggcatgcaccgcgagagccccgacgccgacacctggggcctcgccaaggtggccgcgctgacgggcgtcaacaacgccgacaacgccgtgtacgacatcaaggccctgctcgccaacaagaggcccgacggcccgacgcgcgcggcgctggagaagtgcgggaggctgtacggctccgtcgggttcgcgttcgccgaggcggacgacgagatcaacaaccgccgctacgccgccgggaaggccaaggtcgcggaagcggtgtccctcgcgcgccagtgcgacgacgccctcgccgt

SEQ ID NO: 51822 - protein, 150 aa, Zea mays
  misc_feature: Ceres CLONE 1466995-F
MAPLPQAVHLLLAFALALGCLAGGATATVVTTCRAAADSDARVDYAFCVAELGMHRESPDADTWGLAKVAALTGVNNADNAVYDIKALLANKRPDGPTRAALEKCGRLYGSVGFAFAEADDEINNRRYAAGKAKVAEAVSLARQCDDALA

SEQ ID NO: 51823 - DNA, 674 bp, Zea mays
  misc_feature: Ceres CLONE 1467004-F
  misc_feature: Encodes the peptide sequence at SEQ ID NO. 51824
cgattgggtaccgggccccccctcgagccactgcagtggtaaaggagtggtgcattagcaggcaaaggcaccctaccagagtaccagtcaacagccaccgtttcgatcttcgccacaccgctcggcgctcgcctccgcctgattcccatctttcccgagctccacacctcacgtctataaataaggcgcccgcggtgcccatcaattcgcgtcaccgcgtcccgagagcgcgattcattccgcgcgacgcaaaaccctagcccatccaccgatccttgtcatggcggccaccaccagccaggcgagcctcctcctgcagaagcagctcagagatctcgccaagcacccggtggatgggttctcggctgggctggtcgacgatagtaacgtattcgagtggcaggtcaccatcatcggcccgcccgataccctatatgatggagggtacttcaatgcaataatgagcttcccagaaaattacccaaacagcccgccatcagtcagatttacctctgaaatgtggcatccaaatgtttattcagatgggctggtgtgtatctctattcttcatccacctggtgaagatccaagtggttatgagctcgcaagtgagcgttggacacctgtgcatacagttgaaagcatagttctgagcattatatcaatgctctcta

SEQ ID NO: 51824 - protein, 131 aa, Zea mays
  misc_feature: Ceres CLONE 1467004-F
  misc_feature (11)..(131): Pfam Name: UQ_con Pfam Description: Ubiquitin-conjugating enzyme
  misc_feature: SWISSPROT Homolog: EC 6.3.2.19 Ubiquitin--protein ligase
MAATTSQASLLLQKQLRDLAKHPVDGFSAGLVDDSNVFEWQVTIIGPPDTLYDGGYFNAIMSFPENYPNSPPSVRFTSEMWHPNVYSDGLVCISILHPPGEDPSGYELASERWTPVHTVESIVLSIISMLS

SEQ ID NO: 51825 - DNA, 655 bp, Zea mays
  misc_feature: Ceres CLONE 1467006-F
  misc_feature: Encodes the peptide sequence at SEQ ID NO. 51826
  misc_feature (1)..(1): n is a, c, t, g, unknown, or other
ncgattgggtaccgggccccccctcgagccactgcagtggtaaaggtatctcgcttcgccaccgccggcgagagctatggtttcgtgcgccaccgtcacttccgcccgtcatgggcgacacctccacgtatcagattctggtgcgtctcctcgacgggcgtaccagatgtctccgcttctccacgcccaccgtttccggcgccgtgctcctcgacaccgtcgcgtccatctctcgcgttcccgccgccgctctccgcctcgacacaggcggcatcgacgtatcgccctcttccgtcctcgcctcagcagctgatggccagttcccctatgcgtcagcgctcctccgccttcgaggaggcaagggtggattcggctccctcctcagaggggctgcctccaaagcgggtcataagaagaccagcaactttgacgcctgccgcgacatcaactgccgccgcctccgccacgtcaacgctgagcgccgcctcgaggaatggaaggccgaagccgccgaccgccagctagaaaagctcgccgagaacttcatcaagattaaggccaatgaagcgccccgcggtggcggaccctcaaccgctgatgtggactaatatctagagcaataccgcaaggatgctgatatctgcgtcaacgtgct

SEQ ID NO: 51826 - protein, 165 aa, Zea mays
  misc_feature: Ceres CLONE 1467006-F
MGDTSTYQILVRLLDGRTRCLRFSTPTVSGAVLLDTVASISRVPAAALRLDTGGIDVSPSSVLASAADGQFPYASALLRLRGGKGGFGSLLRGAASKAGHKKTSNFDACRDINCRRLRHVNAERRLEEWKAEAADRQLEKLAENFIKIKANEAPRGGGPSTADVD

SEQ ID NO: 51827 - DNA, 695 bp, Zea mays
  misc_feature: Ceres CLONE 1467012-F
  misc_feature: Encodes the peptide sequence at SEQ ID NO. 51828
  misc_feature (585)..(585): n is a, c, t, g, unknown, or other
tggagctccccgcggtggcggccgctctagaactagtggatcccccgggctgcaggaattcgcacgagaccattacctagaacatcctaatcgcaaaagaattcctgtcactgctcgaaatcgatccgatctccgctcgcgctgaagcctgatctccaccgggttcgcagcaggggcgcaggacctcgatcacgaggaggcaggggagcagcatccacaaccacaagccatggcggggagggccaacatccccactaacaactccgccctcatcgcaatcatcgccgacgaggacaccgtcactggcttcttgatggccggcgttggcaatgttgatctgcgcaagaaaaccaactacctcctcgtcgacaacaagacgacagttaaacaaatcgaggatgcgttcaaagaatttactacgagggaggatattgctattgtgctcatcagtcagtatattgccaacatgataaggtttctggtggatagctacaacaagcccgtccctgctattctggagatcccatccaaggaccatccatatgatccagcgcacgactctgtgctctctcgagtgaatatctngtctctgcagaatcggtggcgtctgataagcgatgaaggcatccttgcgtaacagtacccttcgatgcatccatttggtttgggaattgaaaaaaaaaggcccctccatt

SEQ ID NO: 51828 - protein, 135 aa, Zea mays
  misc_feature: Ceres CLONE 1467012-F
  misc_feature (15)..(115): Pfam Name: ATP-synt_F Pfam Description: ATP synthase (F/14-kDa) subunit
  misc_feature: SWISSPROT Homolog: EC 3.6.3.14 H(+)-transporting two-sector ATPase
  misc_feature (119)..(119): Xaa is any aa, unknown, or other
MAGRANIPTNNSALIAIIADEDTVTGFLMAGVGNVDLRKKTNYLLVDNKTTVKQIEDAFKEFTTREDIAIVLISQYIANMIRFLVDSYNKPVPAILEIPSKDHPYDPAHDSVLSRVNIXSLQNRWRLISDEGILA

SEQ ID NO: 51829 - DNA, 751 bp, Zea mays
  misc_feature: Ceres CLONE 1467013-F
  misc_feature: Encodes the peptide sequence at SEQ ID NO. 51830
  misc_feature (548)..(548): n is a, c, t, g, unknown, or other
  misc_feature (751)..(751): n is a, c, t, g, unknown, or other
tggagctccccgcggtggcggccgctctagaactagtggatcccccgggctgcaggaattcgcacgagaccattacctagaacatcctaatcgaaaaacgtttctctgcgactcgcacggcccgcgcccaccaccgaccaccccacctggttcggtcggcactcggcaccccgccccgcatacatgccgccgcccagcctcaccgtggcgcgcgacccggccgccgccgccaccatgcggcaccgcaaggtccacccgacgccgggcggaggcgcagggacgacgaaggagatgggcgcggcggaggggtgggcgcggcccgagtggtgctcggcggcgggcgccgcggccgtgctgcggcggcacccggcgcccgcgctcttcgggtgcggcctcctgctcttcatggccgtcgagtacaccatccccatggtcaggccggacgcgccgccgctcgacctgggcttcgtcgccaccaggggcttgcacgccgccgtcgccgcgaggccctggctcaactcgctcctcgccgcgctcaacacgcttcntcatggtccccggctcagcacagactgacgctgacgctgacactgacagccaccccacccgctcgtacgcacgcgcaggtcttcgtcgcgatgcaggcggcgtacatcctgtgggccatcctcgggcgagcagcggccgcgcgccgccgtcccacgtttatgatgttcacttgccggggcgcgctgggctgcgccaaccactn

SEQ ID NO: 51830 - protein, 130 aa, Zea mays
  misc_feature: Ceres CLONE 1467013-F
  misc_feature (122)..(122): Xaa is any aa, unknown, or other
MPPPSLTVARDPAAAATMRHRKVHPTPGGGAGTTKEMGAAEGWARPEWCSAAGAAAVLRRHPAPALFGCGLLLFMAVEYTIPMVRPDAPPLDLGFVATRGLHAAVAARPWLNSLLAALNTLXHGPRLSTD

SEQ ID NO: 51831 - DNA, 849 bp, Zea mays
  misc_feature: Ceres CLONE 1467015-F
  misc_feature: Encodes the peptide sequence at SEQ ID NO. 51832
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (48)..(48): n is a, c, t, g, unknown, or other
tgtttttcccttcctccgcggctgggtcttnntnatnnnngtattttntttaaagtggtgctccccgcggtggcggccgctctataactagtggatcccccgggctgcaggaattcgcacgagaccattacctagaacatcctaatcgaaaaacctccctttccccaactcgatctcgcacctagggtttcgtgtcgtcactttcgtcctccgcgaagatgccgaataacaagggtaagggaggcaagaaccggaagggaggaaagaacaaggctgacgacgacaagcgggagctcgtcttcaaggaagacggggaggagtacgcgcaggtgacccggatgttcagcaacgggtggtgcgaggttatttgcgtttatggggggagccacctctgccattttggggggtagatgggtgaagaaggactggaccgcggattgggggccccccgcgtcctcttgtgtttggggtggggtctcaccaccgacatgggccgtacgttctcgttcagggagtatgtaccgtccgtaggcgcgggccagtgtccaaggcccctagggggggaacctgtcctggaaccccgtgtgccagggcttcaaatggtgagggggtcacaacggtttatccgggcgcccgtaagataggggtcatgtgaggtcccctttgtatttacctcccctttttctacaacatggaaccgagattttagccacggttccttaaataaatgtgcgttcccggtgtggacggggcttccccatgggtaccggaccatggcggcagcgggggcctctgcgtcgcaattggtgcggatgggggggggaccgctgtattgtgatagctcctagg

SEQ ID NO: 51832 - protein, 63 aa, Zea mays
  misc_feature: Ceres CLONE 1467015-F
MPNNKGKGGKNRKGGKNKADDDKRELVFKEDGEEYAQVTRMFSNGWCEVICVYGGSHLCHFGG

SEQ ID NO: 51833 - DNA, 750 bp, Zea mays
  misc_feature: Ceres CLONE 1467018-F
  misc_feature: Encodes the peptide sequence at SEQ ID NO. 51834
  misc_feature (371)..(371): n is a, c, t, g, unknown, or other
  misc_feature (607)..(607): n is a, c, t, g, unknown, or other
ggagctccccgcggtggcggccgctctagaactagtggatcccccgggctgcaggaattcgcacgagaccattacctagaacatactaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcngcggcaactgccagtgcgacccctgcaactgcggcaagcgagctaggtgctccaccctgcaggccggccggaggaagctagctaattataaagcttaataaagtatagcggcgtcgctgtgtgtgtttcgagtcagtcagtcagttgcgtgccatggcatgctctgagtctgagatgatgatgatggctgatggcggcgtcgtgtcctcccctggcctcctggggcgcttctggcnagcagtgtgttgtgttgtgtgggtgccgcacgctagccagctagccatgtgccctgctgggttgggtccccatccatctataatcttatccatacccccccttttgggtggaaaaaacaccaattaaaaaaaaaaaaaatatg

SEQ ID NO: 51834 - protein, 101 aa, Zea mays
  misc_feature: Ceres CLONE 1467018-F
  misc_feature (1)..(80): Pfam Name: Metallothio_2 Pfam Description: Metallothionein
  misc_feature (70)..(70): Xaa is any aa, unknown, or other
MSCCGGNCGCGSGCKCGNGCGGCSKMYPDMAEQVTTTTQALIMGVAPSKGHAEGGFEAAAGAENGGCKCXGNCQCDPCNCGKRARCSTLQAGRRKLANYKA

SEQ ID NO: 51835 - DNA, 682 bp, Zea mays
  misc_feature: Ceres CLONE 1467023-F
  misc_feature: Encodes the peptide sequence at SEQ ID NO. 51836
  misc_feature (579)..(579): n is a, c, t, g, unknown, or other
  misc_feature (580)..(580): n is a, c, t, g, unknown, or other
  misc_feature (591)..(591): n is a, c, t, g, unknown, or other
  misc_feature (592)..(592): n is a, c, t, g, unknown, or other
tggagctccccgcggtggcggccgctctagaactagtggatcccccgggctgcaggaattcgcacgagaccattacctagaacatcctaatcgaaaaagcacaccggtccagtgcccagcctccgtccctctccttcccttacctcgcctcgtctcctctccttgagatctccagggtacgagcgcattcgcgattttggccgcctccgccgccgtccgggaagatggcgggtctgggaaaggcgatgtacgcagtggggttctggatccgggagactggccaggccctcgaccgcctgggctgccgcctgcagggcaagtacttcttccacgagcagatttcaaggcatcgcaccatcatgaatatctttgacaaaacccctcatgtgcataaagacgcatttgttgctccaagtgcatcccttattggtgatgttcaagtcgggtcaggagcttccatttggtatgggtgcgtcttaagaggggatgcaaacatcatacaaattggatctgggaccaatatacaagacaattctcttatacatgtggctaaatctaatctaagtgggaggtcttccnnacaccatgggnntatacgtcacagtaggtcattattgctgggttacagggaagcccgttgaggataaggcttttgttgcatgggggcaccctattaaatggg

SEQ ID NO: 51836 - protein, 138 aa, Zea mays
  misc_feature: Ceres CLONE 1467023-F
  misc_feature: SWISSPROT Homolog: EC 4.2.1.1 Carbonate dehydratase
  misc_feature (119)..(119): Xaa is any aa, unknown, or other
  misc_feature (123)..(123): Xaa is any aa, unknown, or other
MAGLGKAMYAVGFWIRETGQALDRLGCRLQGKYFFHEQISRHRTIMNIFDKTPHVHKDAFVAPSASLIGDVQVGSGASIWYGCVLRGDANIIQIGSGTNIQDNSLIHVAKSNLSGRSSXHHGXIRHSRSLLLGYREAR

SEQ ID NO: 51837 - DNA, 762 bp, Zea mays
  misc_feature: Ceres CLONE 1467024-F
  misc_feature: Pfam Name: MEKHLA Pfam Description: MEKHLA domain
  misc_feature (364)..(364): n is a, c, t, g, unknown, or other
  misc_feature (365)..(365): n is a, c, t, g, unknown, or other
  misc_feature (762)..(762): n is a, c, t, g, unknown, or other
tccccgcggtggcggccgctctataactagtggatcccccgggctgcaggaattcgcacgagaccattacctagaacatcctaatcgaaaaatatgagaaatctgtgggttcctccttccagcttgtgtttgcaccgattgatgagcattttccggatgatgctccattgatttcctctagctttcgtgtcataccacttgatatgaaaacagatggtgtatcctctggtaggacactagatttggcatctagtcttgatgtgggttctgctgcaccccaagcctcaggggatgcatctccagatgactgtaatttgagatatgtgctgacaatcgcctttcaattcccttatgagacgtaccnncaggacagtgttgctactatggcccatcaataccccccccttgttgtttctgctgtgcaaagggtgtcaatggctatatctccctccaaatctggtctaaatgatgggcaaaggatgctttccggcttccctgaagctgccacacttgctagatgggtttgccagagttatcactaccctcctagtgtggaaaccctcttcgctagtggaggtatccaccatcactcgccactgtaacaccatagtgatcgacaatcgggagcttccatgttatgtgttctgatacttgaaacttttattaagactatgtttgaaatattgccccttattagtactggatgaaaatggtcttattatgactatggaagaaaacttttgggatgtcattggtggaccn

SEQ ID NO: 51838 - DNA, 757 bp, Zea mays
  misc_feature: Ceres CLONE 1467028-F
  misc_feature: Encodes the peptide sequence at SEQ ID NO. 51839
  misc_feature (413)..(413): n is a, c, t, g, unknown, or other
ctggagctccccgcggtggcggccgctctagaactagtggatcccccgggctgcaggaattcgcacgagaccattacctagaacatcctaatcgaaaaaaatcctcccacccggtttagccggctccgctgccaccgccgcgactccacctctgtcgccaccatggtcaagtccaaggccatcagggtccacgagctgggcggccccgaggtgctgcggtgggaggaggtggaggtcggggagcccggtgaaggggagatccgcatcaggaccaccgccgtcggcgtcaacttcatcgacatctactttcggaagggggtctacgccgcgcccaccatgcccttcaccccaggaatggaagccgttggcgtcgtcaccgctgttgggcctggcctcactggcaggaacccccncgatgttgttgcatatgccggcaaccccatgggctcctatgctcaggagcagatccttccagcggctgtcgctgttcctgttccaccttccgttgatcataagcaagcagcttctgtgatgctcaagggcatgaccgcccatgttctgcttcgccgggtattcaaggcttccctggagtgcttggcgtcccgcggcttcctggtgtcgtttgggcagtcgtcaggcaaacctgaaccaatcccaacgagcgacctggctccaagtcctttgtcctcactcgtcctagcctcatgcaatacactgcttaccgtgatgagctgctggaatcagccgggcaagtgtt

SEQ ID NO: 51839 - protein, 198 aa, Zea mays
  misc_feature: Ceres CLONE 1467028-F
  misc_feature (30)..(111): Pfam Name: ADH_N Pfam Description: Alcohol dehydrogenase GroES-like domain
  misc_feature: SWISSPROT Homolog: EC 1.6.5.5 NADPH:quinone reductase
  misc_feature (84)..(84): Xaa is any aa, unknown, or other
MVKSKAIRVHELGGPEVLRWEEVEVGEPGEGEIRIRTTAVGVNFIDIYFRKGVYAAPTMPFTPGMEAVGVVTAVGPGLTGRNPXDVVAYAGNPMGSYAQEQILPAAVAVPVPPSVDHKQAASVMLKGMTAHVLLRRVFKASLECLASRGFLVSFGQSSGKPEPIPTSDLAPSPLSSLVLASCNTLLTVMSCWNQPGKC

SEQ ID NO: 51840 - DNA, 759 bp, Zea mays
  misc_feature: Ceres CLONE 1467029-F
  misc_feature: Translation starting site: 186
ggagctcaccgcggtggcggccgctctagaactagtggatcccccgggctgcaggaattcgcacgagaccattacctagaacatcctaatcgaaaacattttctggtcgcctcctccgccactgccatctccctcctctgtcctccgtaccactcgtcttcgtctagccgccgaccgccaccaccatggcacccggcctctacaccgacatcggcaagaagaccagagatctgctgtacaaggactacaacacgcaccaaaagttctgcctcaccacctcctcccccaatggcgtcgcaatcacagccgcaggaacaaggaaaaatgagtccatctttggtgagcttcacacccagattaagaacaagaaattgacagttgatgtcaaagcaaactcagaatcagatcccccacacaacaatcactgttgatgagttcggtactccagggctaaaatcaattatcaatttggttgttccagaccagaggtcagggaagcttgaattagaatacctacatgaatatgctggtgtgaatgcaagcgtcgggcttaattccaatcctatggttaacctttctggtgcctttggaagcaaagcactctcagtcggcgttgatgtctcatttgatacggcgactagcgatttcacaagtacaacgctgccctgagcctcaccagttcagatcttattgcttcccctcatctgaaaaacacggggatacccctggttgcgtcctactaccacctggtaaagaacc

SEQ ID NO: 51841 - DNA, 691 bp, Zea mays
  misc_feature: Ceres CLONE 1467033-F
  misc_feature: Encodes the peptide sequence at SEQ ID NO. 51842
tggagctccccgcggtggcggccgctctagaactagtggatcccccgggctgcaggaattcgcacgagaccattacctagaacatcctaatcgaaaagatccaattccaccctcgttctcaggcactgtcacacagacacagctgacctgccactgccaggaaagtaggtcgaggatgccccgcagcggcttctcggggtccttcaggtcgcccaagatcgacgtcgtcatcgacatgggaaaccccttcctcaaccgcaccgtcgacggcttcctcaagatcggcgccgtcggcgcctgcaaggtggctgccgaggagaccttcgagtgcctccacaggggggatgtttcgaagcacaaggttgagcatgccctgaggaagatgtgcaaggagggcgcatattggggcactgttgctggagtttatgtgggcatggtgtacggcgtggaaagggtccgtggccgcagtgactggaagaacgcgatgatcgggggcgccttgtccggcgccctgatctccggcgccagcaacagcgacagaggcaaggtcgtcaaggacgccatcaccgccggcgcggtcgcacagccgtcgagttcatcaactgcattacctaacccaagcaaggagcaactgcatttgcagggcctttgtccggcaaaaaatgaataaagaactggcatgtcccactca

SEQ ID NO: 51842 - protein, 164 aa, Zea mays
  misc_feature: Ceres CLONE 1467033-F
  misc_feature (18)..(146): Pfam Name: Tim17 Pfam Description: Tim17/Tim22/Tim23 family
MPRSGFSGSFRSPKIDVVIDMGNPFLNRTVDGFLKIGAVGACKVAAEETFECLHRGDVSKHKVEHALRKMCKEGAYWGTVAGVYVGMVYGVERVRGRSDWKNAMIGGALSGALISGASNSDRGKVVKDAITAGAVAQPSSSSTALPNPSKEQLHLQGLCPAKNE

SEQ ID NO: 51843 - DNA, 784 bp, Zea mays
  misc_feature: Ceres CLONE 1467038-F
  misc_feature: Encodes the peptide sequence at SEQ ID NO. 51844
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttttttgttcccctccccccggccggtcccaccccacggggnnnnnnnttctagcgggagctccccgcggtggcggccgctctataactagtggatcccccgggctgcaggaattcgcacgagaccattacctagaacatcctaatcgaaaagcctccgcctcccaaacacccgaatgaaactaacagccaccgatggtgtcgccgtcgcggttgctcccaccgacgcctccttcagccgtccagccccgcggggcgcgggatcgcctcaacttgccgcgcctccggtgcctcgacgaccgccgcagcctccgcctcgcccactgatggcgctggaatgctggagcctgcaggttccccggcggtggccacgccgaagtccagcacgcctagagagctcgtctctgccgagcgcctccgggtttgtattttccacaaatacccagacaaccccccctgcaacccaactgtggggggatctcataagggctcttgcaaatacgtagtccgaaacattaccggatatgatctctgggaagataataaaattttcgaacagtttcctgcgtcccccgcgcacttggctccactgtcccccatcattaagcgacggcctgaatgaaacctctcgttcacccgcgcaagttttttgggaacaggggaaaaaaattagctttggtcggttgggtcgcgtggaagggggttggaacccctacggctttgggcgccaccggaccgacgggcggggggaaaaaccagcgccgggtgggtccccccccccccct

SEQ ID NO: 51844 - protein, 43 aa, Zea mays
  misc_feature: Ceres CLONE 1467038-F
MVSPSRLLPPTPPSAVQPRGARDRLNLPRLRCLDDRRSLRLAH

SEQ ID NO: 51845 - DNA, 775 bp, Zea mays
  misc_feature: Ceres CLONE 1467043-F
  misc_feature (651)..(651): n is a, c, t, g, unknown, or other
  misc_feature (701)..(701): n is a, c, t, g, unknown, or other
tggagctccccgcggtggcggccgctctagaactagtggatcccccgggctgcaggaattcgcacgagaccattacctagaacatcctaatcgaaaaatcttttgctgtcacaaactcaaattataatcacactgatctatactatccacctttacggtctccgctagtgataacttcatcggtaggacatcctcctcggactggcatgggtcatgtcgctctgctcttgcgtgctgctcgacgtcctgctctgtgatgtggcctccgcggcggtggcgcgagttcatcaccactgccgaaggggggcccgccttctctatttcacttgagactaccgggagagaaatgcggcggtcatcatcgaggtgctgaacctgcatggctactgtcagttgcacgacctcttccgcttccccgacgacgagtacaaccggttatctccaacaatgtggcggcgcgcagcagcaggctcgagttcggcaggctggtggttttttcccatctagctggtgtcggtgctcaagtactacctccgcgtcgagctcctgtcagatggaggagcgagccacagcggcaatggcgtgttcgactactgtgtagtcgtctagcccgtgttctactcgcgatgcctgctagcgttcgcgcctgcngtcgacaattaagcgagatccctaccgcccgccgtatacttctaatgcangatctctgcgtatgccattctcgtagaccatggactctcgatgaaaccctgtaagttctagataaaaaacaaaa

SEQ ID NO: 51846 - DNA, 679 bp, Zea mays
  misc_feature: Ceres CLONE 1467044-F
  misc_feature: Encodes the peptide sequence at SEQ ID NO. 51847
  misc_feature (679)..(679): n is a, c, t, g, unknown, or other
tggagctccccgcggtggcggccgctctagaactagtggatcccccgggctgcaggaattcgcacgagaccattacctagaacatcctaatcgaaaaggtgaggaatctaccaattgcttttcgtctcctgtccatcccttgtgcgctaccgctcctctcccttggcgacgacgactggcgccgccgctgccagacttcgctgggcatctcgccggcgacgagctcccaccaggattagagaaggtgatggcgaggagtgacagctgcctggcgcgcgtgggtgccggagttgcgatcggtggcgcggtcggcggagccgtcggtgcttgttatggaacttttgaggcattcagatacaagatccctggattgctaaagatcagacatatcgggcaaactactgttggcagcgctgcaatttttgggcttttccttggggctgggagcttgatccacggcggaaatcctactagtttggttccctccctttttctgaaacccacttttgccgatgtgcttccaaaggaggattcttaatttttgagccccccccctaaaggggcttccgggaaaacttttccaccgccgggcaaattttacaccctaaacccccccgggggttggaaaaaaaccaaccccaattttttccccgggttttggggggggaaggaaaaaacn

SEQ ID NO: 51847 - protein, 96 aa, Zea mays
  misc_feature: Ceres CLONE 1467044-F
MARSDSCLARVGAGVAIGGAVGGAVGACYGTFEAFRYKIPGLLKIRHIGQTTVGSAAIFGLFLGAGSLIHGGNPTSLVPSLFLKPTFADVLPKEDS

SEQ ID NO: 51848 - DNA, 762 bp, Zea mays
  misc_feature: Ceres CLONE 1467047-F
  misc_feature: Encodes the peptide sequence at SEQ ID NO. 51849
aagctggagctccccgcggtggcggccgctctagaactagtggatcccccgggctgcaggaattcgcacgagaccattacctagaacatcctaatcgaaaacagcagctaaacagtgttcttatcatcggtgtgaagccagtggatccgtggcagctgcagtacctgaacgagaacaccaacgagaactaccaggggagcgctacggccacgttcacatcgcaacctgtagcgccaagtggatttgcaaccaggaatgcactagcacctctacctagcaacactctgacgaatggcagctgcaacgacagcagcaaccttggcgcgtctggggccgttgcgtcgcctacaaaatctgtcctgtccaaagtcatggacttgatgttcggcctttaagttgcgttgctcacccaaacgccgccgggtttttgtttttggggttccttctgggaaaactctaggccagaatgaggttcacttatcgatgttacggtaaaaacgttacgtgatcaccgtggttgaaccactgggtgtcaatgcgaccgctatatgatgctgcgagcaagcatcgcgaaattcaaacggttgtattatgcgttgcaaatcatgtctgaaacgacgtcatgaacctgacttgtattttgttggacatgtcacatgtccacgacatttatgaaggatgtgagctagggggcgccagctatgctgactccaaaaaaaaaaaaaaaagcttatcgataccgtcgacctcgagggggggccc

SEQ ID NO: 51849 - protein, 130 aa, Zea mays
  misc_feature: Ceres CLONE 1467047-F
AGAPRGGGRSRTSGSPGLQEFARDHYLEHPNRKQQLNSVLIIGVKPVDPWQLQYLNENTNENYQGSATATFTSQPVAPSGFATRNALAPLPSNTLTNGSCNDSSNLGASGAVASPTKSVLSKVMDLMFGL

SEQ ID NO: 51850 - DNA, 756 bp, Zea mays
  misc_feature: Ceres CLONE 1467048-F
  misc_feature: Encodes the peptide sequence at SEQ ID NO. 51851
  misc_feature (363)..(363): n is a, c, t, g, unknown, or other
ggagctccccgcggtggcggccgctctagaactagtggatcccccgggctgcaggaattcgcacgagaccattacctagaacatcctaatcgaaaaatattcgccaaacgcatcgcatcggcctcggccaccggcgcggctgccctcctcctcttctccgtcgatccggagaggactttctctcgcctgctcgtcccttccgcccccgccggccggccggtcctcttcccggcccactccgttccgatcgaccatggcggctaccgcccccaacggcaatcccactgtcagctccctcgcggcaaccgttccggtccaggcggttctgttcgacatcgacgggaccctgtgcgactcggattncctccaccacgtcgctttccaagagatgcttctcgagatcggccaccacaatggcgtgccgatagacgaggagttcttcatcaagaacatcgctgggaggagtgacgtcgaagctgcccagaacctgttcccggactgggagcttgagaaggggctcaaattcctagaggaacaggaagcaaaataccggagtctggcaaaagagcgcttggtggccgtgaaaggcctctcgcaggtggtcccgtgggtggaagaacacgggtacctgcgcgcgggggggacccacgccccccgggatcaccgcggacctgaaggaccccgcccccgggcctcctcggaatttttttccggccgttattcgttcggatgtgaggggctagccttccctgctcg

SEQ ID NO: 51851 - protein, 167 aa, Zea mays
  misc_feature: Ceres CLONE 1467048-F
  misc_feature (37)..(37): Xaa is any aa, unknown, or other
MAATAPNGNPTVSSLAATVPVQAVLFDIDGTLCDSDXLHHVAFQEMLLEIGHHNGVPIDEEFFIKNIAGRSDVEAAQNLFPDWELEKGLKFLEEQEAKYRSLAKERLVAVKGLSQVVPWVEEHGYLRAGGTHAPRDHRGPEGPRPRASSEFFSGRYSFGCEGLAFPA

SEQ ID NO: 51852 - DNA, 847 bp, Zea mays
  misc_feature: Ceres CLONE 1467049-F
  misc_feature: Encodes the peptide sequence at SEQ ID NO. 51853
  misc_feature (15)..(15): n is a, c, t, g, unknown, or other
  misc_feature (22)..(22): n is a, c, t, g, unknown, or other
  misc_feature (23)..(23): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (428)..(428): n is a, c, t, g, unknown, or other
  misc_feature (429)..(429): n is a, c, t, g, unknown, or other
  misc_feature (797)..(797): n is a, c, t, g, unknown, or other
  misc_feature (798)..(798): n is a, c, t, g, unknown, or other
  misc_feature (827)..(827): n is a, c, t, g, unknown, or other
  misc_feature (829)..(829): n is a, c, t, g, unknown, or other
aaatacctccggctnagtgaannacaaaaacattctaccccccaannnnntaaaaaactgggactccccgcggtggcggccgctctataactagtggatcccccgggctgcaggaattcgcacgagaccattacctagaacatcctaatcgaaaagaaggaaaaggcagccttctcaccgtcggacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtctttgtccaatggggcggcggtgaacaagttcgccgtgatgttcatgggcgcgttatttannaatatagtgggggggcaattagggcgtattgccccccctggaagagctgctttcggcttttctcaatctttgtcatcaaatagcgcgctgcctttctccgtgaccgggcatcaatcccggaccaagagattgtttctttgaagggtttatgaaaggagaaaacagcagaagggcacattctcaactcttacgaaaattggctttggaatgccgcgatccggggtcggcgccttagcgcattctttgcatccaaaatgggtggtttgaaaagcttaaaacatatccataactcctcttcagaatagtggtctatctcccacaagaagaactttcactgaaaggctaaataaaaatattcagccttcggnntctcagagtaggaaaagggcgtatacaantnatcccagagcaagaaaaa

SEQ ID NO: 51853 - protein, 125 aa, Zea mays
  misc_feature: Ceres CLONE 1467049-F
  misc_feature (79)..(79): Xaa is any aa, unknown, or other
MQRHVASGRPSGTDGSDFSYRMVVESRYQRVAEGRSRLARLILVQALHLVAGGLLLLLSLSNGAAVNKFAVMFMGALFXNIVGGQLGRIAPPGRAAFGFSQSLSSNSALPFSVTGHQSRTKRLFL

SEQ ID NO: 51854 - DNA, 761 bp, Zea mays
  misc_feature: Ceres CLONE 1467057-F
  misc_feature: Translation starting site: 156
  misc_feature: Pfam Name: DUF254 Pfam Description: SAND protein
  misc_feature (761)..(761): n is a, c, t, g, unknown, or other
aagctggagctccccgcggtggcggccgctctagaactagtggatcccccgggctgcaggaattcgcacgagaccattacctagaacatcctaatcgaaaaaaaacgactcgttctttcccgggggaggggaggactggagaagcctggccagccatggacccgcccaaccctaaccccaacgatgccccgtcgctcccagccgaatccgcggccagactcgccgccctctccctttgtggcaccagggaccttcccccggacttccacaccgccgagatcctcgacgacgacgagggctacctcacctccgcgtccagaggcgggagcagcacctccgcgtggaaggaggcgcccgagggactccacgacgatgacaaggatggggacgatgtctcccagcccagccccagaagcagcggatacgctggcgagcgcggaagcagccttgatgacgacgccgaccccgaccccgaccccgaccaggattgggcgcgcggcaagaagcatccccacgaggacgatgcttcctcttcgtggaggaagaggaaaaacatttcttcattctgagcaattctggcaagccaatatattccaggtatggggatgagcacaagctagccagattttctgctacgctgcaagcaatcattttctttgtcgacgacggtggccaccatatcaaatttgtgaaacctggcaaacatcagatagttttccttgtgtaagggccaaaatatttagcttggataacctgcacan

SEQ ID NO: 51855 - DNA, 771 bp, Zea mays
  misc_feature: Ceres CLONE 1467059-F
  misc_feature: Encodes the peptide sequence at SEQ ID NO. 51856
  misc_feature (18)..(18): n is a, c, t, g, unknown, or other
  misc_feature (46)..(46): n is a, c, t, g, unknown, or other
  misc_feature (47)..(47): n is a, c, t, g, unknown, or other
tgttttttttcttctttnttaattatttttcattgtctcgattttnntttcttaaagtggagctccccgcggtggcggccgctctataatagtggatcccccgggctgcaggaattcgcacgagaccattacctagaacatcctaatcgaaaaacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgaggaaagtgcacacgctgcgtgccgtcagggccgtacgccaccaacgatgagtgcccctgctacagggacatgaagtcccccaagaaccagctccccaagtgcccctaggccctaccgctctaagggagggaggatgacccaggatttcgctcgcgatcctgcacagtttccagttcttgtattgtttttttttctccgtctaatggtcggaaagaagcaacgggccccttgacggggtcggggggggcgtgggttatccgccctggaagaggggtctaaccccttgaaataacgaaccccaagcccgggtttccccttggtgctttttctctttacaaaaacaacaaaaaa

SEQ ID NO: 51856 - protein, 60 aa, Zea mays
  misc_feature: Ceres CLONE 1467059-F
MKAIPVALLLLVLVAAASSFKHLAEAADGGAVPDGVCDGKCRSRCSLKKAGRCMGLCMMC

SEQ ID NO: 51857 - DNA, 733 bp, Zea mays
  misc_feature: Ceres CLONE 1467060-F
  misc_feature: Encodes the peptide sequence at SEQ ID NO. 51858
  misc_feature (355)..(355): n is a, c, t, g, unknown, or other
  misc_feature (357)..(357): n is a, c, t, g, unknown, or other
  misc_feature (391)..(391): n is a, c, t, g, unknown, or other
gctctagaactagtggatcccccgggctgcaggaattcgcacgagaccattacctagaacatcctatcgaaaaaacccgaccgcgtcgcctctctcctcctttcgcgtcgtctccctcctccactctcctctcctctcgcgtccgcagcttcccttgccggctagggtttgcagatgacgacggcggcgcgccccacctgggcgccggccaagggcggcaacgagcaagggggcacccgcatcttcggcccctcccagaagtactcgtcccgcgacctcgccgcgcatacctcgctcaagctcagaaaagacggtcaacagacccaagaggagttacagaagaggaatctcatgnanaaacttgaggaacgtgagcgcaagcactactccnccacccataagtcctatgctgaagaaagagaccggcggaaaagctcaagccagctactcctagaaggttcaaagagagaggcagaggataagatagttccacgagaaatcgatgcagatgactccgatgtggagcctataagtgatgatgagagcgatgagtatggccacaaccacgaccaccgaaactctaatggcagagcttgagaggatttagaaagagagagcagaggagaaacttagaaaggagcgggcaacaaccaaaggaggaggccaagatgaaagaggctgaactgatgcgggggaacccttttgataataataacaattccggcgttccttg

SEQ ID NO: 51858 - protein, 140 aa, Zea mays
  misc_feature: Ceres CLONE 1467060-F
  misc_feature (1)..(141): Pfam Name: Cwf_Cwc_15 Pfam Description: Cwf15/Cwc15 cell cycle control protein
  misc_feature (61)..(61): Xaa is any aa, unknown, or other
  misc_feature (73)..(73): Xaa is any aa, unknown, or other
MTTAARPTWAPAKGGNEQGGTRIFGPSQKYSSRDLAAHTSLKLRKDGQQTQEELQKRNLMXKLEERERKHYSXTHKSYAEERDRRKSSSQLLLEGSKREAEDKIVPREIDADDSDVEPISDDESDEYGHNHDHRNSNGRA

SEQ ID NO: 51859 - DNA, 693 bp, Zea mays
  misc_feature: Ceres CLONE 1467063-F
  misc_feature: Encodes the peptide sequence at SEQ ID NO. 51860
  misc_feature (313)..(313): n is a, c, t, g, unknown, or other
  misc_feature (395)..(395): n is a, c, t, g, unknown, or other
  misc_feature (510)..(510): n is a, c, t, g, unknown, or other
acgctggagctccccgcggtggcggccgctctagaactagtggatcccccgggctgcaggaattcgcacgagaccattacctagaacatcctaatcgaaaaacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcanccggtgctcgctgaagaaggccgggcggtgcatgggcctgtgcatgatgtgctgcggcaagtgccggggcggcgtgccgtcngggccgtacgccagcaaggacgagtgcccctgctacagggacatgaagtcccccaagaaccagcgccccaagtgcccctaggccctaccgctctaagggagggaggatgaccccnggatttcgctcgcgatcctgcccagctttctagtcttgtactgctagtttagcgcgccccagcggccggatggccccgacggttccttccgtgcctggggggctggggttccccctcggaagggctttaacctaaaaaaaaaaccaatggccctggatctggggggcttgtctataaaaaaaa

SEQ ID NO: 51860 - protein, 96 aa, Zea mays
  misc_feature: Ceres CLONE 1467063-F
  misc_feature (1)..(96): Pfam Name: GASA Pfam Description: Gibberellin regulated protein
  misc_feature (43)..(43): Xaa is any aa, unknown, or other
MKAIPVALLLLVLVAAASSFKHLAEAADGGAVPDGVCDGKCRXRCSLKKAGRCMGLCMMCCGKCRGGVPSGPYASKDECPCYRDMKSPKNQRPKCP

SEQ ID NO: 51861 - DNA, 689 bp, Zea mays
  misc_feature: Ceres CLONE 1467070-F
  misc_feature: Pfam Name: NOI Pfam Description: Nitrate-induced NOI protein
ggagctccccgcggtggcggccgctctagaactagtggatcccccgggctgcaggaattcgcacgagaccattacctagaacatcctaatcgaaaattggtgaatgggatgatgcaaatgcagcatcaggtgaaaagtacactggtatcttcaacagggtaagggacgataggttgtcacctacctcttctgctaggcaaccatctaccgcccgtagggaggagaataaggtgcaacagaaatgttcttgctgcatactttgagaaaatgaggacatgatctcaaagagtttggacagcatcctattgtgcttctgtagtgagcaccctatcgtgtaactcttcttggctagttgtcatgtatgttattgtcggtgtgattatgtatctgtaattggattgttccatttaagctcttcaattacaaggaacatatatatgataccatatagatttgtaaagtatggagtgagcattttccttgtgataataaaaggtttatgaatggggtctagatttccattagtaatgtggatttcagctagacaccaacatgttgcttttcatttttttatttaaaaagaaaccgaaatgggcctcccttgaaattcccaatagctttgatattttccaaaccgaaaatcttttaaattaaaaaaaaaaaaaaaaagcttatcaaaccctccaacc

SEQ ID NO: 51862 - DNA, 707 bp, Zea mays
  misc_feature: Ceres CLONE 1467074-F
  misc_feature: Encodes the peptide sequence at SEQ ID NO. 51863
  misc_feature (582)..(582): n is a, c, t, g, unknown, or other
ggagctccccgcggtggcggccgctctagaactagtggatcccccgggctgcaggaattcgcacgagaccattacctagaacatcctaatcgaaaaaagagccaagaggtggtgagagagaggaccgaggagggaaacagagaagatgacgacgaagcgcgacaccgagtcggacggcgaaggctctaaccccgtcggtggtggcgcgactccgccgcccctagccgccgcccctgtcgtatgcctcctccgctccgccggggacttcggtggcggcgccttcgttggatccatcttcggatatggacaaggcttgatcaccaagaagggttttaagggctcattcagcaatgcagggtcctctgccaagacttttgcaattctctctggcgttcagagtttggttttgtgcttgttgcgaaggctacgtggcaaggatgacattgtcaatgctggtatagctggttgttgtactggcctcgctttgggctttccaggggcgccacaggcattgctccaaagctgtgccaccttcgcagcattctcatgcatcatggaggggctcaataagcagcaggctgncatggctcgcacgctggagggactgccccgatggccgtgcatgaaaaatgtggtgttctggccccccttcccgctcccccttatcttgaaggcccggaaggctaacctcaggcggcttaccgtaa

SEQ ID NO: 51863 - protein, 187 aa, Zea mays
  misc_feature: Ceres CLONE 1467074-F
  misc_feature (26)..(144): Pfam Name: Tim17 Pfam Description: Tim17/Tim22/Tim23 family
  misc_feature (146)..(146): Xaa is any aa, unknown, or other
MTTKRDTESDGEGSNPVGGGATPPPLAAAPVVCLLRSAGDFGGGAFVGSIFGYGQGLITKKGFKGSFSNAGSSAKTFAILSGVQSLVLCLLRRLRGKDDIVNAGIAGCCTGLALGFPGAPQALLQSCATFAAFSCIMEGLNKQQAXMARTLEGLPRWPCMKNVVFWPPFPLPLILKARKANLRRLTV

SEQ ID NO: 51864 - DNA, 804 bp, Zea mays
  misc_feature: Ceres CLONE 1467081-F
  misc_feature: Encodes the peptide sequence at SEQ ID NO. 51865
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
cacgcgacccgccggtccgcgctccgcacccccccccgcgaccccccccccctnnnnnnntaaagctggagctccccgcggtggcggccgctctagaactagtggatcccccgggctgcaggaattcgcacgagaccattacctagaacatcctaatcgaaaaatgtccagcatatcgacgcagagtcgcagtcgcagcacacactgaattctctttagctagctaagagagggtagccacaccaggacaggatgcagacagcgaaggtgaaggcgaaggacatggtgagctcggcgaaggagaaggggaaggaggggtcggcaaagatgcagggcaagacgggcgaggcgacggcggccacgctcggggagaaggagatggccaaggaggcggcccgcgccaagaaggaccaggccaacgccgacaagcgccaggagaaggccgaccaccaagcggacgccgccactggccaccacggcacgcgcgtgcccctcaccggcccgaacggacaccacggcgctggcgcggccgtcaaccccgcgtacccgacctcgcggaacacatagccggtgtcgggcaagtgcatctaagtgactgcatcgagatgagacgaagccaggggtcggggggcgcaatttgcggttttaggggggcctagggacccaaaaaggaacgaaccccggggttggaccctccctgcgtgggacccgggttcccacacgggggaaaaatagaaaaaagggcaaaagcgggtgggcaacaacagttttctctgtgcgcgcgccaaggcggtaccggggaat

SEQ ID NO: 51865 - protein, 104 aa, Zea mays
  misc_feature: Ceres CLONE 1467081-F
  misc_feature (1)..(73): Pfam Name: LEA_1 Pfam Description: Late embryogenesis abundant (LEA) group 1
MQTAKVKAKDMVSSAKEKGKEGSAKMQGKTGEATAATLGEKEMAKEAARAKKDQANADKRQEKADHQADAATGHHGTRVPLTGPNGHHGAGAAVNPAYPTSRNT

SEQ ID NO: 51866 - DNA, 703 bp, Zea mays
  misc_feature: Ceres CLONE 1467082-F
  misc_feature: Encodes the peptide sequence at SEQ ID NO. 51867
  misc_feature (571)..(571): n is a, c, t, g, unknown, or other
  misc_feature (575)..(575): n is a, c, t, g, unknown, or other
  misc_feature (583)..(583): n is a, c, t, g, unknown, or other
  misc_feature (623)..(623): n is a, c, t, g, unknown, or other
tggagctccccgcggtggcggccgctctagaactagtggatcccccgggctgcaggaattcgcacgagaccgttacctagaacatcctaatcgaaaaagactcatcatcagttcaattcaatccaatccaatccaatcccaccccgccccttccaagaactctagtatcaaccaaccgtccaacaaaagcaggagtcgcatccgaccccccgcatcagagacaggcagggagggaaccgagatccgtccgtccgtgtcgatggagtcaacggtggagcggataagctcgtcggtgcagtcctgggtgaaggaccacgagctcgcagccatcggaggcgtgtgggctgcggcggtgggcacttcggtggcgtacagccggaggaaggcgccgcagcggggcacgggcctgcgcctcatccacgccaggatgcacgcgcaggcgctcacgctcgccgtcctcggcggcgccgccctcttccactactacggcgacggcgggcgcaggaagagggccgacgacatcgacctcgacttctactcgcagctgccgccggccacccgacgcccacgnaaanaaaaccancggtggaacttggaaaaagaaaaaagaaaacctgttcccnaacttgccgggggggggctttcaaaaaaaaaattggagggggggcccttagaaagtgggggggggaagggttatatccct

SEQ ID NO: 51867 - protein, 148 aa, Zea mays
  misc_feature: Ceres CLONE 1467082-F
  misc_feature (106)..(106): Xaa is any aa, unknown, or other
  misc_feature (108)..(108): Xaa is any aa, unknown, or other
  misc_feature (122)..(122): Xaa is any aa, unknown, or other
MESTVERISSSVQSWVKDHELAAIGGVWAAAVGTSVAYSRRKAPQRGTGLRLIHARMHAQALTLAVLGGAALFHYYGDGGRRKRADDIDLDFYSQLPPATRRPRKXNXRWNLEKEKRKPVPXLAGGGLSKKKLEGGPLESGGGKGYIP

SEQ ID NO: 51868 - DNA, 752 bp, Zea mays
  misc_feature: Ceres CLONE 1467088-F
  misc_feature: Encodes the peptide sequence at SEQ ID NO. 51869
ggagctccccgcggtggcggccgctctagaactagtggatcccccgggctgcaggaattcgcacgagaccattacctagaacatcctaatcgaaaagagacagacagaagcccagaactcaaatctggaagcctggaggatggaacgggtactagcctgctagggttcgtgtccggcggcggcgactgcagctggaacgccggcgacgcagctcagtggacgctcccatcgaccattcccagactgttcaaccaaagatggctggtggtcgtgtacttgatccattttgtactcgccttgaccctaccatggtagaagcacgggtctgcaccaaagattggataactggagcaagaaaaggttatatagtagtatcttatatttatttacaatttaattagtcattagttgtgatcaatttgtaatattgtgaatttgtgatctttgtgatcaacctgttatattgtgaacttgtgatctttatgatcaatttgttatactgtgaattgtgaacttggggtcaaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcgttacccaactttatcgccttgcagcacatcccccttttcgcagctggcgtaatagcgaagaggcccgcaccgatcgcccttcccacagttgc

SEQ ID NO: 51869 - protein, 47 aa, Zea mays
  misc_feature: Ceres CLONE 1467088-F
MAGGRVLDPFCTRLDPTMVEARVCTKDWITGARKGYIVVSYIYLQFN

SEQ ID NO: 51870 - DNA, 832 bp, Zea mays
  misc_feature: Ceres CLONE 1467092-F
  misc_feature: Encodes the peptide sequence at SEQ ID NO. 51871
  misc_feature (304)..(304): n is a, c, t, g, unknown, or other
  misc_feature (416)..(416): n is a, c, t, g, unknown, or other
  misc_feature (454)..(454): n is a, c, t, g, unknown, or other
  misc_feature (458)..(458): n is a, c, t, g, unknown, or other
  misc_feature (469)..(469): n is a, c, t, g, unknown, or other
  misc_feature (471)..(471): n is a, c, t, g, unknown, or other
  misc_feature (510)..(510): n is a, c, t, g, unknown, or other
acaccttacaaccccaccacaaacacaaaataaaaaaaaaaaaacagaacaccccgcggaggcggccgctcttacctaatggatcccccgggctgcattatttcacacgagaccattacctagaacatcctaatcaaaaaaaaaaacaactcaagcctcgcccggtcgcccctccctccctccctctgccccgggtttccagggaaacccacccccaaatccaaatccagcgaaaccacagaaatcaaggatggagctggaggtgggtgcgccttcgccggcaaggtacctggagggggcagcnatcatgaaagccggagtggagctcccgctggcgtacataatcttcctcagcaagagataaccttcctccgcctccgccggggggccctcttctttctctagtgtgaggaacnaaggggttatctgatttgagtgaagtggaaaaaacaanccgnatctcccccangnttgtcattctgtgtgttttggtatagtcagatccgtccnaagagtttcttgaaaaatgggtctttatacactcgttaaaggtacctggattattatgttaattttgtttgtttgactgtgagaagagccaatagaatagaattaattaggaatgataatgctgtacattataagcgaaagggtggaagatttaagatagagtgaatataaaaacaatcatatccatactcacatttcaagatgcccgtgttaaacaaacagaaaaccataatcactttcaccccgacctaccacaagttatcgcctcaatataaaattacctccactaaacgcttgatgagctcgctaggatatcttacaa

SEQ ID NO: 51871 - protein, 37 aa, Zea mays
  misc_feature: Ceres CLONE 1467092-F
MELEVGAPSPARYLEGAAIMKAGVELPLAYIIFLSKR

SEQ ID NO: 51872 - DNA, 700 bp, Zea mays
  misc_feature: Ceres CLONE 1467094-F
  misc_feature: Encodes the peptide sequence at SEQ ID NO. 51873
tggagctccccgcggtggcggccgctctagaactagtggatcccccgggctgcaggaattcgcacgagaccattacctagaacatcctaatcgaaaacttttttttcccttcggggatggtattcgtcgtcttggcttcatcctctcgcccgccgtctcgactgtagcaagcggggctgctgtccgccgcattcaggagccatgcgtgaggggatgagggagagggacagaggcgggagcccggatgcgtcaggccctccgcccttccgcggcccggcgtacaagacgaagctgtgcgcgctttggaggggcaggggcggctgcccccgccccaactgcggtttcgcccacggcgaggctgagctccgaaggccgccccctcgcgcctccttccagcctcgcccacgacctgggagaagggattacagagatcatgagtttagactcaggcctgatagaagacactcaccccatgggaggtattcccctgaaagagatatcaggcgtcgttcatttcatgataagagaccaagttctgaagataggggatctagtcattcaagatcacctattaggaagagtgagagaaacctagtaaaagccctgatgttggaaaaaccgatccatcccgtaaggggtccaaagcccgatacccaaaccagagaaaaaataaagggctcttacccggttaaaaaaatgt

SEQ ID NO: 51873 - protein, 166 aa, Zea mays
  misc_feature: Ceres CLONE 1467094-F
  misc_feature (27)..(52): Pfam Name: zf-CCCH Pfam Description: Zinc finger C-x8-C-x5-C-x3-H type (and similar)
MREGMRERDRGGSPDASGPPPFRGPAYKTKLCALWRGRGGCPRPNCGFAHGEAELRRPPPRASFQPRPRPGRRDYRDHEFRLRPDRRHSPHGRYSPERDIRRRSFHDKRPSSEDRGSSHSRSPIRKSERNLVKALMLEKPIHPVRGPKPDTQTREKIKGSYPVKKM

SEQ ID NO: 51874 - DNA, 865 bp, Zea mays
  misc_feature: Ceres CLONE 1467096-F
  misc_feature (35)..(35): n is a, c, t, g, unknown, or other
  misc_feature (36)..(36): n is a, c, t, g, unknown, or other
  misc_feature (40)..(40): n is a, c, t, g, unknown, or other
  misc_feature (41)..(41): n is a, c, t, g, unknown, or other
  misc_feature (440)..(440): n is a, c, t, g, unknown, or other
  misc_feature (618)..(618): n is a, c, t, g, unknown, or other
  misc_feature (625)..(625): n is a, c, t, g, unknown, or other
  misc_feature (631)..(631): n is a, c, t, g, unknown, or other
  misc_feature (649)..(649): n is a, c, t, g, unknown, or other
  misc_feature (691)..(691): n is a, c, t, g, unknown, or other
ttgtcccgcgccaagacgacccgcactcgctgtgnngggnnttttttttaaagtggtactccacgcggtggcggccgctctatactagtggatcccccgggctgcaggaattcgcacgagaccattacctagaacatcctaatcgaaaaacagattcgtagtgcactcgtccaatcaatggaggctgggaaggatcagggatccgtccaccgatctgtcttctcaggtccacgggaggccagaccaggtgggcccgtccgtgtccgcgaggagacgggtcggaacccggttcctctgaaccctagtgcgcctcacgcccggaggtgatgggcgccgtggccttcgggctcctctccttgcgcgtgggcttgaagcccttccctcgacaaggctcaggagggctgtagacttcctctcggttattttgagcgtggaaaccnggtaccttcctcgccccggggaattccgccccacaaaaccccgggcggtgggatagtcgctgggggcgacacccccacagaccgtttccaaggaaacccgcgccgtcctggttctgcgcgctaacttaaaggcccccgggggagtcccgtgatttcggtttgggagaaacttttttgngtgtcanccggcntggcttaccccccgcgcnccaatgtgaacctaaatgcaccttgtagagctcttgtgggcntaaccaatatcgttaaaaaagacccaatccccatggtgcaggtttgctaaaacttctacaagaacattagcgttatagattgccccccctacacgctcttctctatgttgatacctaccacaaacacacatctgaagagatcgcaccatgagcgctccccacaacaacagcggg

SEQ ID NO: 51875 - DNA, 761 bp, Zea mays
  misc_feature: Ceres CLONE 1467098-F
  misc_feature: Encodes the peptide sequence at SEQ ID NO. 51876
ggagctccccgcggtggcggccgctctttaatagtggatcccccgggctgcaggaattcgcacgagaccattacctagaacatcctaatcgaaaacattatggtgttataataggtggcattgtgagcaacactctacggccgccagtgcccgactcctgcgaccccgagtggaggtcactgatggagcaatgctggtcaacagaaccatctgagcggccaaacttcacagaggttgcgaataggctgcgctccatggcggcatcccagaaggtacaacaacactaagggaccatcggcacgcagaagttgtaccagggcagcagtcagtcaaacttgcaggttacatccatgggccgccaattcacgccatccgccatatatgcctaggatctgttcataaccccccatttgttcgtatattgtaatcaaaagttacccgccgtgtgtctacaacgtgtcgtcgcaatggacgcagcaggtgcctgcctattcattcattcataccgttttgggcgccgagaggtgcgttcaataagttactagtccagtgtccgttataggggagtccggtagtgtccgtttatgggggagtccgggattattattattattggtccatcctcttctttcccctttcctcgggaaaataattgggttacttggaaactgttgaatccatgggtccattaaaaatgggtaactggttggctcctcggacaaagattggggctttggtggcataattgaagtctggcggac

SEQ ID NO: 51876 - protein, 94 aa, Zea mays
  misc_feature: Ceres CLONE 1467098-F
  misc_feature: SWISSPROT Homolog: EC 2.7.10.2 Non-specific protein-tyrosine kinase
SSPRWRPLFNSGSPGLQEFARDHYLEHPNRKHYGVIIGGIVSNTLRPPVPDSCDPEWRSLMEQCWSTEPSERPNFTEVANRLRSMAASQKVQQH

SEQ ID NO: 51877 - DNA, 691 bp, Zea mays
  misc_feature: Ceres CLONE 1467101-F
  misc_feature: Encodes the peptide sequence at SEQ ID NO. 51878
ctggagctccccgcggtggcggccgctctagaactagtggatcccccgggctgcaggaattcgcacgagaccattacctagaacatcctaatcgaaaactcccccgatcgatcccaatcgaacccaccaagccgataccctaaccctcgcccttctcgatgtcggccgccaccaccggcccagccccttcagtagccactccgatggcgccccctccgtcctacccggcctcctccacggcctcttcctccatctccgcgtccgccgaggaggaggaggacctctatggccgcctcaaatcgctccaacgccacatggagttcgtcgaaatccaggaggagtacgttaaagacgagcagaagaacctgaagcgcgaactccttcgtgcgcaggaggaggttaagcggatccagtctgtaccgctcgtcattggccagtttatggagatggtcgacggcaacaacggcatcgtgggctctaccactggcagcaactactacgtgcggatcctcagcaccatcaaccgcgagttgctcaagccgtcagcgtccgtcgcgttgcatcgtcactccaacgctctagtcaacgtgctgccgccggaggcccactccagcattctcctgttggggatcgcccgaaaagcccaacgtcctttacaccgttgtgaaggatggacactcccaaacagaaa

SEQ ID NO: 51878 - protein, 162 aa, Zea mays
  misc_feature: Ceres CLONE 1467101-F
MAPPPSYPASSTASSSISASAEEEEDLYGRLKSLQRHMEFVEIQEEYVKDEQKNLKRELLRAQEEVKRIQSVPLVIGQFMEMVDGNNGIVGSTTGSNYYVRILSTINRELLKPSASVALHRHSNALVNVLPPEAHSSILLLGIARKAQRPLHRCEGWTLPNR

SEQ ID NO: 51879 - DNA, 733 bp, Zea mays
  misc_feature: Ceres CLONE 1467102-F
  misc_feature: Translation starting site: 216
  misc_feature (494)..(494): n is a, c, t, g, unknown, or other
  misc_feature (577)..(577): n is a, c, t, g, unknown, or other
  misc_feature (733)..(733): n is a, c, t, g, unknown, or other
ggagctccccgcggtggcggccgctctagaactagtggatcccccgggctgcaggaattcgcacgagaccattacccagaacatcctaatcgaaaaatcacaagccagaacagccaagaacagagatacccgagtcgccgaagcaaccactcacaatcccaatctcccgcgtcactcaaaacccgaagtaacaaccgtcgtcggtccgaccaacaatgtcgctgattcgccgtggaaacgcattcgaccccttctccctcgacctctgggaccccttcgagggcttcttccccttcggctccggcggcgtccgcagcctcgttccctcgttgccgcgcaccagctcggagaccgcggcatttgccggcgcgcggatcgactggaaggagacccccgaagcgcacgtgttcaaggcggacgtgccggggctgaggaaaggagaggtcaaggtggaggtcgagggacggcacgtcctgcagatcagcggcgagcgncacaaggagcacgaggagaagacggacggtggcaccgggtgaagcgcagcagcggcaagttccttcgcaagttcagactggcngaccacgccaaggcagacagatcagggcgtcatggagacggggtgctcaccgtccccgtgcccaggaaggaggcaagaaggccacgtcaaaaacgtcagataccggctaagaggaaaccaccgtaccctgtgaagtttgaacccaacttgttcagn

SEQ ID NO: 51880 - DNA, 795 bp, Zea mays
  misc_feature: Ceres CLONE 1467103-F
  misc_feature: Encodes the peptide sequence at SEQ ID NO. 51881
  misc_feature (13)..(13): n is a, c, t, g, unknown, or other
  misc_feature (42)..(42): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ggtcgtgcccttncatcccatttctatcaatcttaatttttnccccnnnnnnaaaagctgggactccccgcggtggcggccgctctagaatagtggatcccccgggctgcaggaattcgcacgagaccattacctagaacatcctaatcgaaaaacaaggagcactcattgcctccccatctcgtgtagtctctccccctcctccgcgctccatccgtctctcatcaccattccgccgccgccccacctctccctcctctcgccgccgcctccgaacccgccacggcgcgggggaaatccaaccggacggatctggatcgacctactccgacaccgctttccgaagatagatagatagataacaaggttgtgctgtgcttgctgtctgttgggaagtggaggaagctcaagttgatatccgcctcgagctcgaaggaaccggtgggaagggtcccccgatcaccagcctgggcagaactgccaataatgcggtattggatatcgagagccttccccaacccgcctgataaatgcttgctctgggagtcccaaaataaattagggccttgtcccgtaaggggttctaacccaatacaaagagaagggcggtctctgtctgcccatcctggaacaaagagggattttggcggaaaaaaactttttcactctaaaagaggtggccgcgcgccaaataggggtggacgcccccccctgggtgtaaaaaaaagaaggcgacctgggtgccccttccaaccttttgttacccacctcgttgtccgtaggcgtgggggtggt

SEQ ID NO: 51881 - protein, 103 aa, Zea mays
  misc_feature: Ceres CLONE 1467103-F
MRYWISRAFPNPPDKCLLWESQNKLGPCPVRGSNPIQREGRSLSAHPGTKRDFGGKKLFHSKRGGRAPNRGGRPPLGVKKRRRPGCPFQPFVTHLVVRRRGGG

SEQ ID NO: 51882 - DNA, 824 bp, Zea mays
  misc_feature: Ceres CLONE 1467104-F
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (824)..(824): n is a, c, t, g, unknown, or other
gggttttgttctttctttttccaccgtctcatctnnnntntttttnnnnnnnccaagctggagctccccgcggtggcggccgctctagaatagtggatcccccgggctgcaggaattcgcacgagaccattacctagaacatcctaatcgaaaaatccctcccgcgagatctctcaccggagtcaccgccccccagatccgcctcccctcgccggcgcgctcgcgtgttttccgctcgtccgccgccatgtcgcacaaccacggagacacgatcccgctccacccctcgtcggcgcagtccgacatggacgagatcgagagcctcatccacgccgcgccatctccggacaccgttctccccgcgcggccaccgtctccgacgcgggcctccatttcccgtatcctcctctccggcgttggggccggcacccctccccacaaagacgcctctccccgccgcctccatttcggatctccgatatttgtgttccccccccctaaaggtccggttcccgttcccattcggccccttaacgggtttggaaacttccacccaataaggcttcacgggagcccggtatggggacaccgggaagagcgaaagaatagacacgccccttgtcatcttattcgccacagctttttttgcgtctcctctcaatccccttcccgcctagggaacccccggaaaaggtccgtctcgagggaaaggggaacccggggggggggcaccctttttaaccatgcaactgaactatacgtggggcgcttacacgcttctcgccggagagacacccttcccgcgttaaaaagaagctcagaan

SEQ ID NO: 51883 - DNA, 762 bp, Zea mays
  misc_feature: Ceres CLONE 1467110-F
  misc_feature: Encodes the peptide sequence at SEQ ID NO. 51884
  misc_feature (762)..(762): n is a, c, t, g, unknown, or other
tccccgcggtggcggccgctctagaactagtggatcccccgggctgcaggaattcgcacgagaccattacctagaacatcctaatcgaaaaattcattaccggaagagaaaaaaataactcggaaaagaaggagacgccgaaaattcgaaaggggaggggaaagcaaagctgatggcggaggaccaggggaaagcaaagcaaatggcggaggccccgagcaagatcgaatccatgaggaagtgggtcgtcgagcacaagctccgagccgtaggttgcctctggctaggtgggatcagcagttcgatcgcctacaactggtcgcggcccaatatgaagcctagcgtcaagatcatccacgcaaggttgcatgctcaagctctaaccctggctgcattagttggccccgcatgcgtggagtactatgatcagaagtatggttcttctgggccaaaggtggacaaatacacaagccaatacctggcccattcgcataaagattaaaggtcgccatgttggttcctgcatgccggattaattttgggctcatctcgggttgctcatgacccgcccatggatgctggatgtttattctttttttggcttcaaaattacaaaatggaggtgtacttgccaggcaaatgttaatgaaggtataatgcagatattgccgtcgtaatttgggctcatggtgcatttatccaacctcactttgttgactggcagtgactcagcgccccctgaattttttatattttttgaan

SEQ ID NO: 51884 - protein, 109 aa, Zea mays
  misc_feature: Ceres CLONE 1467110-F
  misc_feature (14)..(81): Pfam Name: HIG_1_N Pfam Description: Hypoxia induced protein conserved region
MAEDQGKAKQMAEAPSKIESMRKWVVEHKLRAVGCLWLGGISSSIAYNWSRPNMKPSVKIIHARLHAQALTLAALVGPACVEYYDQKYGSSGPKVDKYTSQYLAHSHKD

SEQ ID NO: 51885 - DNA, 769 bp, Zea mays
  misc_feature: Ceres CLONE 1467111-F
  misc_feature: Encodes the peptide sequence at SEQ ID NO. 51886
  misc_feature (407)..(407): n is a, c, t, g, unknown, or other
ggagctccccgcggtggcggccgctctagaactagtggatcccccgggctgcaggaattcgcacgagaccattacctagaacatccaatcgaaaaaaatcttccgcacccatctctcgccgcctcgcctgcaccggagactggccctagtgcccgcgcgcctgcgaggtatcgaacacccaaagatggcaatggcaaccttcacatcatccccagttctctgcagcttcaggaccatcgaacagaagaaggcccctctgctgaacaacagcacaaaacggccgcttcacttgtgcttcccaaggagcgtgcccacctcgccgaaattgagagagaggataaaactgcgcgtctcctctgtctacaaggtgaaactcctcggcccccaaaggcaagagaatttgattnaccccccctaaaacaaaaacatcctggaacctgccgaaggaggcgggggtcgacctgccctaatcctgcccagccggggggggttcacctgcccccggtagctcctggaagggtccctctaccaagcaaaacaaccttttctcgaacaaagaaaagagggggtccggcaagctccttccccgtagtagcttcaccaaacctcaaatccggtgccctactaccacttgcggagaaaaaatttaaatataacaccttacctggctccccgcgattggtcagacctctatcttccacactatttaactcataggtcttacgtcttcgctgccctctcgtcactctaactcataaactagcacttg

SEQ ID NO: 51886 - protein, 77 aa, Zea mays
  misc_feature: Ceres CLONE 1467111-F
  misc_feature (75)..(75): Xaa is any aa, unknown, or other
MAMATFTSSPVLCSFRTIEQKKAPLLNNSTKRPLHLCFPRSVPTSPKLRERIKLRVSSVYKVKLLGPQRQENLIXPP

SEQ ID NO: 51887 - DNA, 715 bp, Zea mays
  misc_feature: Ceres CLONE 1467116-F
  misc_feature: Encodes the peptide sequence at SEQ ID NO. 51888
tggagctccccgcggtggcggccgctctagaactagtggatcccccgggctgcaggaattcgcacgagaccattacctagaacatcctaatcgaaaattttccctcttccccccactacccaaacccaacaggcggcgcagcagcatcgccaccaccgtccaaagatggtgaagttcctcaagcccggcaaggccgttatcctcctccagggccggttcgccggccggaaggcagtgatcgtgcgcgttttcgaggagggcacccgtgatcgtccctacgggcactgcctcgtcgcgggcctcgccaagtaccccaagaaggtgatccgcaaggactccgccaagaagacggccaagaagtcccgcgtcaagtgcttcatcaagctcgtcaacttcacgcacctcatgcccacccgctacaccctcgacgtcgacttcaaggacgtcgcatcggggcgggcccgacgcgctcttcaacccggaaaaagaaagttcaaaccctgcaaagcccgccaaaggccccccctcaaggaaaggttccagaaccggcaaaaaaagggggtttttttaccaaaaccccccttctaaaacgtcggggggccccccaaaagggccaaaattaaatgggaaatttcttggaacccgaaacccctttaaggggacccccggtttttgcatttccccaaaaaggcttttcggcgtttggaaagagaat

SEQ ID NO: 51888 - protein, 140 aa, Zea mays
  misc_feature: Ceres CLONE 1467116-F
  misc_feature (52)..(140): Pfam Name: Ribosomal_L27e Pfam Description: Ribosomal L27e protein family
  misc_feature (7)..(40): Pfam Name: KOW Pfam Description: KOW motif
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGRARRALQPGKRKFKPCKARQRPPLKERFQNRQKKGVFLPKPPF

SEQ ID NO: 51889 - DNA, 718 bp, Zea mays
  misc_feature: Ceres CLONE 1467122-F
  misc_feature: Encodes the peptide sequence at SEQ ID NO. 51890
aagctggagctccccgcggtggcggccgctctagaactagtggatcccccgggctgcaggaattcgcacgagaccattacctagaacatcctagtcattaaccgtcactacaaggaacaaaaacgggaatgtgggggaaaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttcaaggacggcaagactctccccacccgcaaaggtatatcactccaattagatcagtggaagatactgaaggactacatcaaagccataaatgaggcaatcgacgaaaatacatgatgggagccgccaagcagtcacgtgacgggcgagcttttgcttctctctcgttgaggcctgatgtacggaaataattttttgttgcccatatgctgcccgtgttgccttttgacaattttaacaacgtgactgttgaaagtggccccatggcccgaaaggtttggtttcctgccccgtggctatggtaaatttaaaccgcggaacggttgacccccctttcccccctttttttttgttacccacaaacgactttgtttggatttcgaaaacttaaaatt

SEQ ID NO: 51890 - protein, 103 aa, Zea mays
  misc_feature: Ceres CLONE 1467122-F
  misc_feature (1)..(99): Pfam Name: PC4 Pfam Description: Transcriptional Coactivator p15 (PC4)
MWGKGKKRFGGGGSGEPAAKRQAARDDGPSESAEDGTVVAEISKNKKVSVRSWKGRVFVDLREFYFKDGKTLPTRKGISLQLDQWKILKDYIKAINEAIDENT

SEQ ID NO: 51891 - DNA, 674 bp, Zea mays
  misc_feature: Ceres CLONE 1467133-F
  misc_feature: Encodes the peptide sequence at SEQ ID NO. 51892
tggagctccccgcggtggcggccgctctagaactagtggatcccccgggctgcaggaattcgcacgagaccattacctagaacatcctaatcgaaaaagtagcatccatttgattgttctatcctcttctctgttctcacccccttgcaagcaacaatcgttcaccgatcgatccagtgcgtcctgcatggaaactgccgccgtcgccgcctccagtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgttgagaggcacgccaacgcggtctcggcggcggcggtcgacaaggccaagcgcgtctgcgccgaccacccgcacgtcaaggtggagacgacggtggagagcggggacccgcgggacgtcatctgcgacgcagccaaacagatggcccgcgacctgctcgtcatgggcagccatggttacggcttcatccaaagggctgtcttgggcaacgtcaacaaacccttggggcgaaaaaaatggaaaaggcccggccccctttttttag

SEQ ID NO: 51892 - protein, 162 aa, Zea mays
  misc_feature: Ceres CLONE 1467133-F
  misc_feature (12)..(152): Pfam Name: Usp Pfam Description: Universal stress protein family
METAAVAASSAGRRIMVAVDEGEESLHALNWCLANVVSPAGGDTLVLVHARRPRPVYAAMDSAGYMMTSDVLASVERHANAVSAAAVDKAKRVCADHPHVKVETTVESGDPRDVICDAAKQMARDLLVMGSHGYGFIQRAVLGNVNKPLGRKKWKRPGPLFL

SEQ ID NO: 51893 - DNA, 716 bp, Zea mays
  misc_feature: Ceres CLONE 1467136-F
  misc_feature: Encodes the peptide sequence at SEQ ID NO. 51894
aagctggagctccccgcggtggcggccgctctagaactagtggatcccccgggctgcaggaattcgcacgagaccattacctagaacatcctaatcgaaaaagccacggatcgagacgtcccaatcgagctaatctcacaccgccagtgccagtgccagcggcagctgctaatccgtgccgtgttccagcagcgatgggagtggagtcggagtgcgacaggataaagggcccctggagccccgaggaggacgaggcgctgcggcgtctcgtggagcgccacggcgcgcggaactggacggcgatcgggcgcggcatcccggggcggtcggggaagtcgtgccggctgcggtggtgcaaccagctgtcgccgcaggtggagcgccgccccttcacgcccgaggaggacgccgcgatcctggccgcgcacgcccggctgggcaaccggtgggccgccatcgcgcggcttctcccggggcgcaccgacaacgccgttaagaaccactggaactcctcgctcaaccggaagctcgccacccgcaacggcgacctccaacggaaatgaatgctaaccgggcctggaaaccccccaagccctggccccggggagcccgaaggggtttgaacccaaaggaacctcacccacgggttgcgggcgcccccaaggggtttccgtccccgtcccggggggcccgaaggttttaaaaccccttaaggc

SEQ ID NO: 51894 - protein, 122 aa, Zea mays
  misc_feature: Ceres CLONE 1467136-F
  misc_feature (11)..(57): Pfam Name: Myb_DNA-binding Pfam Description: Myb-like DNA-binding domain
  misc_feature (63)..(108): Pfam Name: Myb_DNA-binding Pfam Description: Myb-like DNA-binding domain
  misc_feature: The sequence is a functional homolog of SEQ ID NO 114 in the 10/412,699 US patent application
  misc_feature: The sequence is a functional homolog of SEQ ID NO 275 in the 11/479,226 US patent application
  misc_feature: The sequence is a functional homolog of SEQ ID NO 84 in the 10/286,264 US patent application
MGVESECDRIKGPWSPEEDEALRRLVERHGARNWTAIGRGIPGRSGKSCRLRWCNQLSPQVERRPFTPEEDAAILAAHARLGNRWAAIARLLPGRTDNAVKNHWNSSLNRKLATRNGDLQRK

SEQ ID NO: 51895 - DNA, 758 bp, Zea mays
  misc_feature: Ceres CLONE 1467140-F
  misc_feature: Encodes the peptide sequence at SEQ ID NO. 51896
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (48)..(48): n is a, c, t, g, unknown, or other
  misc_feature (523)..(523): n is a, c, t, g, unknown, or other
  misc_feature (679)..(679): n is a, c, t, g, unknown, or other
ttttttttgccccgcccggttttaaaatattaccccncccgtnntttntttaaaactggagctccccgcggtggcggccgctctagaactagtggatcccccgggctgcaggaattcgcacgagaccattacctagaacatcctaatcgaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaataccttgttcagggagactggtgctgggaagcacgtgccccgtgctgtttttgttgaccttgaacccactgccatcgatgaggtgaggactggcacctaccgtcagnctcttccgccctgagcaactcctctgtgggaatggaggatgcagcccaacaacttttgcccgggggtccctaactacctttgcgttatggagaattggtgaaccccaatgccctttgtattccatttttggaaaattcttgcacgaaaaaaatggncgtgggcccccaaggggactcccccccggtcccaaccctactgttgtgctggaagaacaacggtgttctcctcgccttt

SEQ ID NO: 51896 - protein, 89 aa, Zea mays
  misc_feature: Ceres CLONE 1467140-F
  misc_feature (86)..(86): Xaa is any aa, unknown, or other
MRECISIHIGQAGIQVGNACWELYCLEHGIQADGQMPGDKTIGGGDDAFNTLFRETGAGKHVPRAVFVDLEPTAIDEVRTGTYRQXLPP

SEQ ID NO: 51897 - DNA, 691 bp, Zea mays
  misc_feature: Ceres CLONE 1467142-F
  misc_feature: Encodes the peptide sequence at SEQ ID NO. 51898
tggagctccccgcggtggcggccgctctataactagtggatcccccgggctgcaggaattcgcacgagaccattacctagaacatcctaatcgaaaactccctcgacacgcacgcagttctcttgcttcttcagtcgcatcgcatatgtaagcagcacaagcacagcagcagcagcagcagcagcaggcaagaagaatccaaagcggaagggtctctccccccatctctgttccaccaggtgcggcgggcggcgatgggggcgcggaggcggctgcaggcagacgcgccgccggggcatcgccacaggcagggcgcgccggcgccggactggagcgccgggtacctcaacgggtggctgtcgcagccgacgcccgtcttcggcctccgcctctgggtgctcatcggcatcgccgtcggcgccgccatcgtgctcgtgctcctcctcatcttcgtctgcctctcccgccgccgccgccgccgccgcctcgccgccaacccctactaccccgccgacaccaagctgctcaagaagcacctgcagcagcaggccacgcccacgcccacgcccaccaaggacatccaggagatcgtccgccgccagcaggagcccgcggtgcagctcgccaaggccgtgccgcagccgcagccgcagccgcaaactcttccgccgccgccgtctccgcagcacag

SEQ ID NO: 51898 - protein, 145 aa, Zea mays
  misc_feature: Ceres CLONE 1467142-F
MGARRRLQADAPPGHRHRQGAPAPDWSAGYLNGWLSQPTPVFGLRLWVLIGIAVGAAIVLVLLLIFVCLSRRRRRRRLAANPYYPADTKLLKKHLQQQATPTPTPTKDIQEIVRRQQEPAVQLAKAVPQPQPQPQTLPPPPSPQH

SEQ ID NO: 51899 - DNA, 781 bp, Zea mays
  misc_feature: Ceres CLONE 1467148-F
atagctggagctccccgcggtggcggccgctctagaactagtggatcccccgggctgcaggaattcgcacgagaccattacctagaacatcctaatcgaaaaccaattcccatcccacccccgcacccaccgtggcccgagtagccgtggccgccgcggcaggccggcagcgccctcccggcggtgagcgcagcccggcgcgcgcgtcgcggccaccgccgcgctcgaagcgcccagatctagggcctagcggcccccctcctccatggcgcggcgactgccgttgtggacagcgctgctcctccccttcctcctcaccggagttggtaccgccgccgccgcatccccgccccacgatgagtgcccggtgtctacaaccggggaatccgttcttgttactccaagacccctcctcggttttttgaatcttgccaaccctggccggcctccccgtaaggggaatgagcttccattcttaccaacctgcgttcaacccttctttctcttcaaacattcgataaactacccccgcggggttctttttcctatgtcccccgcggtttgccttttttttttctccgtattggccctctcatatccctacccaaccccgcccctcttcttttcccccccctcacttgtgcgttcttcccctcttggaaggcaatcttgtctccggcgggtccccactgatcaccctcacactatctcctcttttctcttgtagttgcatcattcactctgttcccctcctcacgattttacaacgacggcggaaccg

SEQ ID NO: 51900 - DNA, 711 bp, Zea mays
  misc_feature: Ceres CLONE 1467151-F
  misc_feature: Encodes the peptide sequence at SEQ ID NO. 51901
  misc_feature (711)..(711): n is a, c, t, g, unknown, or other
aagctggagctccccgcggtggcggccgctctagaactagtggatcccccgggctgcaggaattcgcacgagaccattacctagaacatcctaatcgaaaagccatcagatcgggagactcactcactcgggagtcgggtcctcctcgactcagctcctccacaaacaaagccaaagccaccaccatcccaacccaaacacatcggccgaccacgggcgccgccatgtccaccgctgacgcggcgagcccggccctggcgccggacggggacgcgccggcgggcgaaggcctggccctggcccagttcgccgcgggctgcttctggagcgtggagctggtgtatcagcgcctcccaggcgtggcgcgcacggaggtggggtactcgcagggccaccgccacgcccccacctaccgcgacgtctgcggcaacggcacgggccacgccgaggtggtccgcgtgcactacgaccccaacgcctgcccctacggcgtcctcctcgacgtcttctgggccaagcacaaccccaccacgctcaacagacagggcaacgacgtcgggacacagtaccggtcgggcatctactactacacggcaaagcaggagacgctggcgcgcgagtcgctggcggcgaagcagaaggagtggcaggacgcgatcgtcaccgaggtcctgccggcgcggcggttctaccccgccgaggagtaccacn

SEQ ID NO: 51901 - protein, 162 aa, Zea mays
  misc_feature: Ceres CLONE 1467151-F
  misc_feature (24)..(162): Pfam Name: PMSR Pfam Description: Peptide methionine sulfoxide reductase
  misc_feature: SWISSPROT Homolog: EC 1.8.4.11 Peptide-methionine-(S)-S-oxide reductase
MSTADAASPALAPDGDAPAGEGLALAQFAAGCFWSVELVYQRLPGVARTEVGYSQGHRHAPTYRDVCGNGTGHAEVVRVHYDPNACPYGVLLDVFWAKHNPTTLNRQGNDVGTQYRSGIYYYTAKQETLARESLAAKQKEWQDAIVTEVLPARRFYPAEEYH

SEQ ID NO: 51902 - DNA, 755 bp, Zea mays
  misc_feature: Ceres CLONE 1467157-F
tggagctccccgcggtggcggccgctctagaactagtggatcccccgggctgcaggaattcgcacgagaccattacctagaacatcctaatcgaaaaatttagtcctctgcgttttttggcgttggttcttcttgcacaactcttctgctggattccagctctgttttactttctcctgtcctgctggtcagtcaaatatatcctcctggtcctgggtagcttttgggttccggcgccttgccgttctcagtttgtgttcttggtcatctgatctgggtggtattaatctggagacccagtcactcggtcgggacgagatcaataaaaaggaagaaagaagcagcgcggcaagccggcggcgtcgcgaagcttaagatcagagacaccgttggttgggcgttgcttcaaatataatcttcaagaatcaagaccaagctcagattccatcagtcggtacgtacgtcgggacagcctcacttcgctcgctgctgcgcgttagatgccggttgctgcgtcgctaatggcgatagagttggagaaggaccaactcgcctgggcggagcagcagcggcagcagaataggaggcagaccatggtcgtctgcagaaagagcgccccagcggtggccaaagggaaccagcgtcagaacgcttcgccgccgtcccccaagccctcgccccgcgggcgggctcagcgggaaagggttccttggttcttgcgtgcctccccgtgttcccttattctgctgccgctg

SEQ ID NO: 51903 - DNA, 770 bp, Zea mays
  misc_feature: Ceres CLONE 1467159-F
  misc_feature: Translation starting site: 165
  misc_feature: SWISSPROT Homolog: EC 5.2.1.8 Peptidylprolyl isomerase
  misc_feature (412)..(412): n is a, c, t, g, unknown, or other
tatgctggagctccccgcggtggcggccgctctataactagtggatcccccgggctgcaggaattcgcacgagaccattacctagaacatcctaatcgaaaaatctatctttgtggtcgtggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagattaatgaagcttataaaaacttgcaggaggggatggctcaataatggggacaaanttcccccccgctgagtttgctaaggtagcacacgagtattctgaatgcccattatggaagaaaggtggagatcttggttggttcccgcgtggcaggaatgcttgtcccttccagggaggttgcttttaaaacccccggaaggaactggttacgcccctttttcaggccccgctccgggtatccttttactcgttcgccaacgaagggagaattgtttttggaaatttcgagttggggataacttcctctttctggtggtatagaacacaccggtatactactttccctgtctttattacctgttggtctctttttcctttcggtcgtggtgtatttacactcctgcctcactagcaac

SEQ ID NO: 51904 - DNA, 758 bp, Zea mays
  misc_feature: Ceres CLONE 1467161-F
  misc_feature: Encodes the peptide sequence at SEQ ID NO. 51905
  misc_feature (500)..(500): n is a, c, t, g, unknown, or other
ggagctccccgcggtggcggccgctctagaactagtggatcccccgggctgcaggaattcgcacgagaccattacctagaacatcctaatcgaaaagttccccagcctgatccaccacgctagccacggccgacccgacgtcgccgtcgccgaggacgcaccacgcagtggctgcgggttagggctgcccgggcacggcggcgggcccagcgtggtgctcacggccgatcccaagcctaggctccgctggacggccgacctccacgaccgcttcgtcgatgccgtcgcccagctcggcgggcctgataaagcaacaccgaaagctatcatgaggacaatgggagtgaagggcctcaccctttttcacttgaaaagccatcttcagaaatacagattgggaagacagtctggaaaagagtaacggagccatcaaaagatgcttcctaccctaatggaagctcaaagtggaacaacttgtgcctcctaaaggttctatcccngatgggaaaaaaagctcagaaatttaaaaagccctccaagccccaatgggaatggcaccaaaattgcccaaacagggggaggccacaaacttttgccaatcccaagggggggaaacccaaattccctccccccaacctaaaaagggggttcaaaaaatttctgaaacaccgggggggtttcgttttttgaaacaaacctcccgttttccccctctggggggggctgttttcccccgggaaatcctaggatttcctttc

SEQ ID NO: 51905 - protein, 30 aa, Zea mays
  misc_feature: Ceres CLONE 1467161-F
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: The sequence is a functional homolog of SEQ ID NO 190 in the 10/225,066 US patent application
  misc_feature: The sequence is a functional homolog of SEQ ID NO 2866 in the 10/374,780 US patent application
  misc_feature: The sequence is a functional homolog of SEQ ID NO 1857 in the 10/374,780 US patent application
  misc_feature: The sequence is a functional homolog of SEQ ID NO 384 in the 10/374,780 US patent application
  misc_feature: The sequence is a functional homolog of SEQ ID NO 426 in the 10/225,066 US patent application
  misc_feature: The sequence is a functional homolog of SEQ ID NO 2862 in the 10/374,780 US patent application
  misc_feature: The sequence is a functional homolog of SEQ ID NO 990 in the 10/225,066 US patent application
  misc_feature: The sequence is a functional homolog of SEQ ID NO 2636 in the 10/374,780 US patent application
  misc_feature: The sequence is a functional homolog of SEQ ID NO 320 in the 10/225,066 US patent application
  misc_feature: The sequence is a functional homolog of SEQ ID NO 254 in the 10/666,642 US patent application
MRTMGVKGLTLFHLKSHLQKYRLGRQSGKE

SEQ ID NO: 51906 - DNA, 657 bp, Zea mays
  misc_feature: Ceres CLONE 1467162-F
  misc_feature (257)..(257): n is a, c, t, g, unknown, or other
aaagctggagctccccgcggtggcggccgctctagaactagtggatcccccgggctgcaggaattcgcacgagaccattacctagaacatcctaatcgaaaaacgacttctgaaacgggagatgctagtgctgagctgctgaagacggttgtgctctcaggcaccaaaacattcggatctgaaatcctaaacggaagtgagacgcccaatcggtgatccaccgcttccccgtcggtccatgtccgctggaagcgagngccgtacgccttctcgccccgtcggcggtcccgggccccttctcccgcgctccggctcgctcccacacggccgcgaagatagcactgggaggagctcgtcctccgtggcgcaaacaaaagccaaaaccaccgttcggcccgcggtggacaaacaaaacccgccctcccgaaccaaatccccctggacctggggggcaccaaaaaggttgggttgggggtccccccccttccccaaaattcccccccccccaatgtttttttgccaccctattaaactaaaaaagggggccccttttccgccaggggtccccaaaccccaaagtttgtaatttggaacaatctccccccctaaattttggggtggggaacacaaaggggtttttttttaacaaaaaaaaaa

SEQ ID NO: 51907 - DNA, 758 bp, Zea mays
  misc_feature: Ceres CLONE 1467174-F
  misc_feature: Encodes the peptide sequence at SEQ ID NO. 51908
  misc_feature (541)..(541): n is a, c, t, g, unknown, or other
  misc_feature (758)..(758): n is a, c, t, g, unknown, or other
atagctggagctccccgcggtggcggccgctctagaactagtggatcccccgggctgcaggaattcgcacgagaccattacctagaacatcctaatcgaaaaccttacagatcaagaagcatttcaaggacatcggtgttcccgctgatctaaaatacattgatccaacatatatggttcgggcctgccgggcaaatgcatctgatgctattctctgcaccgtacttgggcaaaatgctgtccatggagcatttgctgggttcagtggcatcacgtcaggtgtttgcaacacacattatgtctaccttcccatcacagaggtcattacaacaccaaagcacgtcaaccccaacagcagaatgtggcaccgctgcctcacatccactggccagctagacttccattgactacttcattaacacctgagagcaaggcgccaggagaatatttagggcctgtttggtttgatgcctaacttgccacactttgcctaacttttgtgcctaaaggttagttattcaattcgaacgactaaccttangcaaagtgatgcacatttagctacaaaccaaacagccccttaatcccacaagggactgctaacaggaaacttgaataaatctggcttacccaaattttgtgaagctggaggagctcataacaaaaatgccagaacccccccctggtcatccagaacgtgtaagcatgcctaccctttccaatggtttgcaaccccagtgaaattaaagttaaaagtn

SEQ ID NO: 51908 - protein, 77 aa, Zea mays; identical to SEQ ID NO: 46654
  misc_feature: Ceres CLONE 1467174-F

SEQ ID NO: 51909 - DNA, 768 bp, Zea mays
  misc_feature: Ceres CLONE 1467175-F
  misc_feature: Encodes the peptide sequence at SEQ ID NO. 51910
  misc_feature (344)..(344): n is a, c, t, g, unknown, or other
gctcttaactagtggatcccccgggctgcaggaattcgcacgagaccatacctagaacatcctaatcgaaaagaacaacaaaacatttatataaccgcgcttggatcactagctagctctcgctcgtcgcaacaagcgaagagcttggtcgttttggttatggcggtgatgaagagcaggacggtcatcgtcgccgccgttctgttggcggttgtcattctgtcctcgctgtgtccatgctaccaacccggcggctgcatcgggaagccgcccaagacgccggcgccgaagaggccctgcttctcgccctactccgaggaccactgtgaccgccagatgttttnctacctctgcatgtcacacggttacggtgacggaccccccccgtgcccacagggaggggcgcaaaatgtgctgctgcctccattgagtcagaaaaactaccataacaaccgggaactgttgggcgcctggtgatgttattgggatcttcccttctcttggctgtatggctggttccgggccacctccccaaataagaaaaaactggtgttgtctcttttcgcgcgcctgtgttgcccccgtcatagcctcttatcgccggacgtggtttctcgtgcttaagagcctcgggccttttcttctgtgtttttctctacctgaatcactgtcgctaagtgctttcgctaatacacgagccgcggtgcgggctcctccccgttgtttcctatcgtgtcagttatcacttctcgactctgcagtctactc

SEQ ID NO: 51910 - protein, 105 aa, Zea mays
  misc_feature: Ceres CLONE 1467175-F
  misc_feature (62)..(62): Xaa is any aa, unknown, or other
MAVMKSRTVIVAAVLLAVVILSSLCPCYQPGGCIGKPPKTPAPKRPCFSPYSEDHCDRQMFXYLCMSHGYGDGPPPCPQGGAQNVLLPPLSQKNYHNNRELLGAW

SEQ ID NO: 51911 - DNA, 797 bp, Zea mays
  misc_feature: Ceres CLONE 1467177-F
  misc_feature: Encodes the peptide sequence at SEQ ID NO. 51912
  misc_feature (281)..(281): n is a, c, t, g, unknown, or other
  misc_feature (350)..(350): n is a, c, t, g, unknown, or other
  misc_feature (413)..(413): n is a, c, t, g, unknown, or other
  misc_feature (448)..(448): n is a, c, t, g, unknown, or other
  misc_feature (472)..(472): n is a, c, t, g, unknown, or other
  misc_feature (473)..(473): n is a, c, t, g, unknown, or other
  misc_feature (477)..(477): n is a, c, t, g, unknown, or other
  misc_feature (493)..(493): n is a, c, t, g, unknown, or other
  misc_feature (507)..(507): n is a, c, t, g, unknown, or other
  misc_feature (539)..(539): n is a, c, t, g, unknown, or other
  misc_feature (592)..(592): n is a, c, t, g, unknown, or other
  misc_feature (599)..(599): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (700)..(700): n is a, c, t, g, unknown, or other
  misc_feature (742)..(742): n is a, c, t, g, unknown, or other
  misc_feature (760)..(760): n is a, c, t, g, unknown, or other
  misc_feature (761)..(761): n is a, c, t, g, unknown, or other
tcttaactagtggatcccccgggctgcaggaattcgcacgagaccattacctagaacatcctaatcgaaaaaaaaaagcccaaaccccaggcgtcgctctgtatttttctctcctcactcaacgcggcgatgccccctagatcggatcacgccgccggcagcggcgccgcggcggcggccacgcaggcccacttcgactccatcgatccactcttcgatgtgggccgcgcgctacccttctccttcctcctgccgccgcgcaccccattggaggttggcgncaaaccaggcatttccctctcccatgaccgtcgacctccctcctcctggtcggagggtgtgcgggtgtnaaacctgagtgtgaaaacaaactcgtccgcttgggtgtgggggccccccccgcctccccacanaattcctggagttgggctgctatccacttacagcntctcctctctttactcactccccnncacncccctcatatcacatnttaacacacctccnccccctaccctccagagtgggtcttatggganggtcgggcctctctctccccctcactactgtatcccccccacaccccccccanccccccnccccccacactcaatattccaaatataccnnnccccgctctgtggtatattgggtactcgggtcgcggggagggagacggcactctctccttctctgtatnattaggcgtggctatggcagtaggacagatgaagagtgaagnaatcctccgcctcgcacnntcgttttctctgatatgtcggtcactgggagcaagg

SEQ ID NO: 51912 - protein, 28 aa, Zea mays
  misc_feature: Ceres CLONE 1467177-F
  misc_feature (10)..(10): Xaa is any aa, unknown, or other
  misc_feature (16)..(16): Xaa is any aa, unknown, or other
MAVGQMKSEXILRLAXSFSLICRSLGAR

SEQ ID NO: 51913 - DNA, 737 bp, Zea mays
  misc_feature: Ceres CLONE 1467178-F
  misc_feature: Encodes the peptide sequence at SEQ ID NO. 51914
ccccgcggtggcggccgctctataactagtggatcccccgggctgcaggaattcgcacgagaccattacctagaacatcctaatcgaaaaaggataacctgcagtcgcccccaaatttccccgaaccaaatcactcccaccgtgtccacagcaaccagcacacatttccctttggcggatcgaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattccatatgcaggacgaggatgcaggccggccatacaggacccccccctaaccggcgtccagggctgcaggagacgtcaatccctcgaccggggctgcgaggaggggagtttccattcagtttgtgtcggtattgttttagtctgaatctgatggagcagtttggaatgctgaactattgtgcctgatccaaatgaataaggtgtaatgactcgtcttttcaattactgaaactgaacatgtttgaatttacctggtcacttgaatggtaaataacagcgttgtcaaaaaaaaaaaaaaaaagcttatcgatcccgtccacctcgagggggggcccggtacccattccccctatagtgaggcctaatccccgc

SEQ ID NO: 51914 - protein, 71 aa, Zea mays
  misc_feature: Ceres CLONE 1467178-F
MGGGMEVHKNRWIEEWNAGRENLEFNFRWTRRSLAVVGLFGLAVPILVYKGIVREFHMQDEDAGRPYRTPP

SEQ ID NO: 51915 - DNA, 804 bp, Zea mays
  misc_feature: Ceres CLONE 1467180-F
  misc_feature (51)..(51): n is a, c, t, g, unknown, or other
  misc_feature (375)..(375): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (382)..(382): n is a, c, t, g, unknown, or other
  misc_feature (390)..(390): n is a, c, t, g, unknown, or other
  misc_feature (391)..(391): n is a, c, t, g, unknown, or other
  misc_feature (396)..(396): n is a, c, t, g, unknown, or other
  misc_feature (599)..(599): n is a, c, t, g, unknown, or other
  misc_feature (600)..(600): n is a, c, t, g, unknown, or other
  misc_feature (610)..(610): n is a, c, t, g, unknown, or other
  misc_feature (667)..(667): n is a, c, t, g, unknown, or other
  misc_feature (794)..(794): n is a, c, t, g, unknown, or other
aagctggagctccccgcggtggcggccgctctataactagtggatcccccngggctgcaggaattcgcacgagaccattacctaaaactccctattcaaaaaaacaaacaaaacatttatataaccgcgtttggatcactagctagctctcgctcttcacagcaaggaaagagcttggtcgttttggccatggcggtgatcaggagcaggacggtcatcctcccctccggtctgttggaggttgtgattctgtagctcgctgcgaccatgctacgaagccggcggctgcatagagaagccgcccaagacgcctgcgcctaaaaggctctgcttctcgccctactcccaggaccactgggaccgccggagatgaancnnnatntgaatggnnaacanaaacaatgacgattgggccccccccaccaaaggaaggcgcgcagaatgtcctgccgccccccttacttacaataataacaataccccccctggacttgttgtgggccctcctgcctgtaaaatggatcatccattctcagtcgtattcccggtggtgggtggaatctccggaaatcaaaaaaacccccccccctccctgcttnnagcccacacnatcaccggctaagtgacactatgcacacaatacctgaccccccccacaatacacacnacggctacgacacccgtttcccctttacccgtctccccccccctccccactcccacaaacccccaaccgccttggggctccgctcatctctaaagcacgttcaataccctcactccatgtggcaatnatgcgcttgc

SEQ ID NO: 51916 - DNA, 764 bp, Zea mays
  misc_feature: Ceres CLONE 1467188-F
  misc_feature: Encodes the peptide sequence at SEQ ID NO. 51917
aaagctggagctccccgcggtggcggccgctctagaactagtggatcccccgggctgcaggaattcgcacgagaccattacctagaacatcctaatcgaaaaccccgtctcaccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgacacgggcgcggcagcggggggcgcggcgtccgtcctggccgtggttggtttggcgtctcctcaaccccggcgccggggccccttggcaaaggccccccccccacccgggggcatacctgttgggttgggtcaggcgaaaccctgtttcaaccttttcccctaaataagaaaaaaaaaaccccctgggccggggtaattggccccccccccccccgggggggggtgggaacttgggcattgtatattttttttgcccaaacgcatttgtcacaaaaacccttggggggggggggtgttttaaaaaaaaaaaaaagatttcctccccccaaaaaaaaaaaaaaaatttttttctccccccccccgggggggggcgggcccccccccccccactatgggggggatataccccccccccgcggcgcctttttatacgcggggggggagaaaccccg

SEQ ID NO: 51917 - protein, 89 aa, Zea mays
  misc_feature: Ceres CLONE 1467188-F
MASRVAVLLVAVAAVLFAAASAQEMDLGVPPAPAPDTGAAAGGAASVLAVVGLASPQPRRRGPLAKAPPPPGGIPVGLGQAKPCFNLFP

SEQ ID NO: 51918 - DNA, 772 bp, Zea mays
  misc_feature: Ceres CLONE 1467189-F
  misc_feature: Encodes the peptide sequence at SEQ ID NO. 51919
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
aaagctggagctccaccgcggtggcggccgctctagaactagtggatcccccgggctgcaggaattcgcacgagaccattacctagaacatcctaatcgaaaattgttccaaatggagaaaacttccaatagatgccctgttgccctccaaatggacctgctttgacaataaatgggattcagaaaggtcttcttgcgaacctgcacaggaaataagtttggaggagcttgcagaactcattcctataaaacctggaaaaaagcccagattgaagatagaatctgatgctattgatgcttcagatgggctggacacgcttgcaaaccttgcaattcttggtgaaggtgaagcgctcccttcgtagccaacaacaaaacatcgccgccaccgtcccggctgctcatgcatcgtctgcatccaaccaccaagtgggaagggtccaaagcacaagcagacatgcacctgtaacgtttggatgacggttccccgccgttttaggacactcatgcttcgaccccaaaaaaaggtaacaagaaatcctcctcgcaagaaagagacggcccaatccagtgaaaaggtcacacaaccaggccgtgtccgggtccgccaggaaccaatggcagtgcaaccagatccccccaaaaagcaaagtgaaatgcttaagcccccaaaaaactggctcctccatcccaaggtgacctcttcccctccgtaagaaacctatttaactgaaaaattcaacccnnnacgggaccacccagccccccccca

SEQ ID NO: 51919 - protein, 79 aa, Zea mays
  misc_feature: Ceres CLONE 1467189-F
MTVPRRFRTLMLRPQKKVTRNPPRKKETAQSSEKVTQPGRVRVRQEPMAVQPDPPKKQSEMLKPPKNWLLHPKVTSSPP

SEQ ID NO: 51920 - DNA, 777 bp, Zea mays
  misc_feature: Ceres CLONE 1467191-F
  misc_feature (233)..(233): n is a, c, t, g, unknown, or other
  misc_feature (234)..(234): n is a, c, t, g, unknown, or other
  misc_feature (315)..(315): n is a, c, t, g, unknown, or other
  misc_feature (316)..(316): n is a, c, t, g, unknown, or other
  misc_feature (392)..(392): n is a, c, t, g, unknown, or other
tctaaactagtggatcccccgggctgcaggaattgcacgagaccattacctagaacatcctaatcgaaaaaccaagaacaaaccattgttggacgcgttcccctcctgcacgcaacctcatctcgtcctccagatcctggatggccgtcctccttgataccttggcctcgcgagtgctctcggtgagctactttgttttgatttagcaggaaatccgtttgtttctggttatnncggcttcaatctgattgttggattccgacgcctaccgcgcttggaagaccctaggatgggaagaaaaaaacaaaccccccnngcaacccggttttttttcccctccgggggggggcccccaccccccccccccccaaaaaaactttccctatctcccncaaataggagagattgggggtaagttttacgtctctctcccccttcctcttgtgcccgcgcttttctccctcgcgtcgttcgccctctctttctttgtcgggcttttcgcttcttccctgccgggattcctccccgcctctcctcaccattgctttttgccccccactttactccaccgcttccttcctttattggcacacccccttttctctttgttctttcgcttggtgttcgggggtggtcttgccgtgttctgtatattgatgttttgtttctatgttactctactcagtcggttctcccgagtcgttacgagcggtgggtcgcgcgctctacgcttctatgctgcccatttcaccgctgttgtatttctgcgaacgctac

SEQ ID NO: 51921 - DNA, 861 bp, Zea mays
  misc_feature: Ceres CLONE 1467193-F
  misc_feature (420)..(420): n is a, c, t, g, unknown, or other
  misc_feature (426)..(426): n is a, c, t, g, unknown, or other
aagctggagctcaccgcggtggcggccgctctagaactagtggatcccccgggctgcaggaattcgcacgagaccattacctagaacatcctaatcgaaaaccttctatcctctccggcacgagccgtccagttcagttcacctcggtccgggaccgctactactccgacggcggggcgtccgagcccagtcgacgctgagccaatggagactccagcgacattctccctccgccccagagtgctccccgcgccttcttgtggcaggctccccccggctcgggcctgttccgcgcctgccatggggattatcctttggcgatgacttttcgtgccatctctgggcgcgctaatggctctccgtggttttttttgtttgggatttttacgtggggggggtaattataaaactaataaaaanccccgncctttcccccaggggagtcgtctctctcgcgtcctaactgctaatgattctgtccgccgcgattccttctggctgctatgcgcctgattccgcctcattatctgctctggtcttgtccggctggtccctgtcggtcgctcgtgtttcgctctctggcaaccccgctcggtgctcaccctctttctctctgtatcagtcttcccccctagcctctcgttccgtaggccgctcgtcttgcgattccatatcgctggaactgccaggcctcaactagtggagaggtgcgctctctcttcactgcctttcttcgtctacgcttcgggcttgcagtgttttcctattctttctgctctttcatctcttgttgagcatctcgatcgggttgtgtgctgccctctccctgcgtccatactgtgcgcctcggtgcgtctccgg

SEQ ID NO: 51922 - DNA, 735 bp, Zea mays
  misc_feature: Ceres CLONE 1467199-F
  misc_feature: Encodes the peptide sequence at SEQ ID NO. 51923
aagctggagctccccgcggtggcggccgctctagaactagtggatcccccgggctgcaggaattcgcacgagaccattacctagaacatcctaatcgaaaacgaaaacccgtttttcttcctgtggtcgctcgttgagtgcggaaattccacgaacgtgagctcaacatggagccggcgacccctccggcacccgccgccggcgtcacggctaccgtcgacctctcctcagtcgcagccgacctcggtggggcgcacctcctgccctgcggcatcaggcagaacggcggcgcccccgtatccgactacttcaagcctagggccacaggtgtggaggtggagggggtgaagatggaagaggccttctttcgtgggaggaaactgcagggcactaccctagctctcccggacggctaccgaggttatgtattggagaagagttgcggacagaattcagatgctgaagtcagcaattttacatcgcgagctgaattccagagcataacctactggaatcacgatacagcgccatcagcagaggattccctcccgaggtgcttccattggctaaccgtcgctaatgcgatgcatagagcagtgactgctgaagacctggctaacatggcagcaatgcagaatcagggcaagtagattcgttctataacgtagccgtgcaatttcgatttggtgaccatctcgacaagggatcttcctgtaacagcaacatgttatttga

SEQ ID NO: 51923 - protein, 160 aa, Zea mays
  misc_feature: Ceres CLONE 1467199-F
  misc_feature (28)..(140): Pfam Name: RNase_H1_sml Pfam Description: Ribonuclease H1 small subunit
MEPATPPAPAAGVTATVDLSSVAADLGGAHLLPCGIRQNGGAPVSDYFKPRATGVEVEGVKMEEAFFRGRKLQGTTLALPDGYRGYVLEKSCGQNSDAEVSNFTSRAEFQSITYWNHDTAPSAEDSLPRCFHWLTVANAMHRAVTAEDLANMAAMQNQGK

SEQ ID NO: 51924 - DNA, 757 bp, Zea mays
  misc_feature: Ceres CLONE 1467200-F
  misc_feature: Encodes the peptide sequence at SEQ ID NO. 51925
  misc_feature (374)..(374): n is a, c, t, g, unknown, or other
  misc_feature (395)..(395): n is a, c, t, g, unknown, or other
  misc_feature (465)..(465): n is a, c, t, g, unknown, or other
  misc_feature (482)..(482): n is a, c, t, g, unknown, or other
  misc_feature (511)..(511): n is a, c, t, g, unknown, or other
  misc_feature (538)..(538): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
ctggagctccccgcggtggcggccgctctagaactagtggatcccccgggctgcaggaattcgcacgagaccattacctagaacatcctaatcgaaaacaagcgtggtgactatgtgcctggattgaaggtggacggaatggatgttcttgctgtgaagcaggcatgcaaatttgcgaaggagcatgccattgcaaatggcccaattgttcttgaaatggacacgtataggtaccacggccactctatgtccgatccaggaagcacttaccgcaccagggatgagatctcgggtgtaagacaggagcgtgatccaattgaaagggttaggaagttgctcttggctcatgacctagcaacccctgctgagctcanggacatggagaaagaaattangaaagaagtcgacgctgccattgctaaagccaagaaaagtcctatgcctgatgcttctgagctctttacnaatgtctacgttaaggnttttcggcgtgagtcattttgcgcaaacngaaagaggtgagagctacactccatangtcacaacctgagaatgagatgagtactcctctaacccttgaaaattcgaggaaaaataacctccttgaacaacccttgggtgttgcggccatttttgttgcaaaccacctgtttaaaaatgtattgccgggaaaaaaaannnnnnnnnnnnnnnnnnnnnnannnnnannngggaaaaaaaaaaaaagttttccacccccccccccgggggggccccg

SEQ ID NO: 51925 - protein, 127 aa, Zea mays
  misc_feature: Ceres CLONE 1467200-F
  misc_feature: SWISSPROT Homolog: EC 1.2.4.1 Pyruvate dehydrogenase (acetyl-transferring)
  misc_feature (79)..(79): Xaa is any aa, unknown, or other
  misc_feature (86)..(86): Xaa is any aa, unknown, or other
  misc_feature (115)..(115): Xaa is any aa, unknown, or other
  misc_feature (125)..(125): Xaa is any aa, unknown, or other
MDVLAVKQACKFAKEHAIANGPIVLEMDTYRYHGHSMSDPGSTYRTRDEISGVRQERDPIERVRKLLLAHDLATPAELXDMEKEIXKEVDAAIAKAKKSPMPDASELFTNVYVKXFRRESFCANXKR

SEQ ID NO: 51926 - DNA, 781 bp, Zea mays
  misc_feature: Ceres CLONE 1467203-F
  misc_feature: Translation starting site: 164
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (499)..(499): n is a, c, t, g, unknown, or other
ggagctccccgcggtggcggccgctctagaactagtggatcccccgggctgcaggaattcgcacgagaccattacctagaacatcctaatcgaaaaatctacgttctactcccactcgcggtcgcggtagccggcggcggcggcggaggaaagcaggcaggccatggcgtcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtccctcaggagctggagctgctcagcgatggggccaacgtgtacaagctcatcggaacggtgctgggtcagcaggacctcgcggaggccaggnnncacgtcagaagcgcatcgagtacatctccgcgaagctgaagcggatggatcgggcgctcaaagacttggaggaaaagcaaaccngcagaaaggatcgaattttcagttcccccaaagatgcccggttgacaaacttagggttaaaccactgttttgttgggtggaaataacccaaggccttgtttatttttccccaattcccccccggttttttttttggggggagggaaaacagggttttaatttttccccctcccccaaaaaaaaaaaaaaaaaacccgtcccaagaaaaaaagggttttttttgggccccaaaaaaaaagggccccctcaaaaaggtggaaaaagtttttcaacctttttttt

SEQ ID NO: 51927 - DNA, 748 bp, Zea mays
  misc_feature: Ceres CLONE 1467206-F
  misc_feature: Encodes the peptide sequence at SEQ ID NO. 51928
  misc_feature (387)..(387): n is a, c, t, g, unknown, or other
  misc_feature (388)..(388): n is a, c, t, g, unknown, or other
  misc_feature (419)..(419): n is a, c, t, g, unknown, or other
  misc_feature (503)..(503): n is a, c, t, g, unknown, or other
  misc_feature (748)..(748): n is a, c, t, g, unknown, or other
aagctggagctccccgcggtggcggccgctctagaactagtggatcccccgggctgcaggaattcgcacgagaccattacctagaacatcctaatcgaaaaaaacacgtgacacctccgcccaccctcgccccctccctaccggcaccgcccagatggcctgctcccacatcgtcgccgccgcgggggtctcctcccccgccgcagcggcggctcgttccccggcgcattctcccgctgccgccttcgcgcgcctccggtcgacgcctcgtttcgcgagcgctggcttgtcggttaagggaaacggaccggcgttcccgttggtcgccgccgcggggccggccgcggcggcaccggtggtcgacctggacggccgccgggggcggannaacagcccatcatcctcatgcgaccaccacnacagcttcacatacaacctctgccagtatatgggggagcttggattgaacttccaagtataccgcaatgatgaactggacctanaagatgtgaaaaggaagaacccagggggaatacttatttctcccggacctggtgaaacccaggattcgggaatatcattgcagactggtccttgaataaggcccccccctccccaatttttgggattcgcgggggtctgcaaggcattggaaaagcatttggaggaaaagattatccggctccctcctggaatgaaggcagggaaaagctcccccctttataaccatcgggaattagaaaagccn

SEQ ID NO: 51928 - protein, 147 aa, Zea mays
  misc_feature: Ceres CLONE 1467206-F
  misc_feature: SWISSPROT Homolog: EC 4.1.3.27 Anthranilate synthase
  misc_feature (78)..(78): Xaa is any aa, unknown, or other
  misc_feature (89)..(89): Xaa is any aa, unknown, or other
  misc_feature (117)..(117): Xaa is any aa, unknown, or other
MACSHIVAAAGVSSPAAAAARSPAHSPAAAFARLRSTPRFASAGLSVKGNGPAFPLVAAAGPAAAAPVVDLDGRRGRXNSPSSSCDHHXSFTYNLCQYMGELGLNFQVYRNDELDLXDVKRKNPGGILISPGPGETQDSGISLQTGP

SEQ ID NO: 51929 - DNA, 736 bp, Zea mays
  misc_feature: Ceres CLONE 1467208-F
  misc_feature: Encodes the peptide sequence at SEQ ID NO. 51930
  misc_feature (736)..(736): n is a, c, t, g, unknown, or other
tccccgcggtggcggccgctctagaactagtggatcccccgggctgcaggaattcgcacgagaccattacctagtacatcctaatcgaaaacctctgcttctggcgaccaaattctgccgtctccaccgccgccgcagccagcgtcaccggagggatctgccgtctcccttgctccacgcgatgaacaccgacatcaccgcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccgtcaatggtcacgggcggcctcatcggggtcatgggagggctcatgtacgcctaacagaactccgccgggcgcctaatgggattctttcccaacgacgccgaggttgcgcgctacaagcacaagcttcattgaggatccagctccatttccgtctctcttttcgcaaccgtttcgcctgtccttttcctgattccgggttaccttcagaacttatctggggcctctatggccttggttaaataaaaggggtaggtgtgcgccggtaaaagaatccatgaatacatcccctccccttttgtttggttggggaaattcccccccctttggggaattttaaaaccggaaggtttccggcccaaaaaaaaaaaaaaaccn

SEQ ID NO: 51930 - protein, 77 aa, Zea mays
  misc_feature: Ceres CLONE 1467208-F
MNTDITASTKPEYPVVDRNPAFTKVVGNFSALDYMRLSTISAVSVTVGYLSGIKPGIRGPSMVTGGLIGVMGGLMYA

SEQ ID NO: 51931 - DNA, 747 bp, Zea mays
  misc_feature: Ceres CLONE 1467213-F
  misc_feature: Encodes the peptide sequence at SEQ ID NO. 51932
  misc_feature (364)..(364): n is a, c, t, g, unknown, or other
  misc_feature (365)..(365): n is a, c, t, g, unknown, or other
  misc_feature (367)..(367): n is a, c, t, g, unknown, or other
  misc_feature (368)..(368): n is a, c, t, g, unknown, or other
  misc_feature (401)..(401): n is a, c, t, g, unknown, or other
  misc_feature (405)..(405): n is a, c, t, g, unknown, or other
  misc_feature (409)..(409): n is a, c, t, g, unknown, or other
  misc_feature (427)..(427): n is a, c, t, g, unknown, or other
  misc_feature (533)..(533): n is a, c, t, g, unknown, or other
ccccgcggtggcggccgctctagaactagtggatcccccgggctgcaggaattcgcacgagaccattacctagaacatcctaatcgaaaaactgcgactgtgagcttccttcgttcagttcatccgtgttcttgtttgccacgtcgacagagagaggatgtcttgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccttccaaggggcactccaagggcgggttcgaggcggccgccggagctgataacggtgggtgcaaatgnnannggaactgccagtgcgagctgtgtgttgcgccancccnaccnaggtgctccaccctgcangccggccggaggaagctagctaattatcataacctaaataaagtataacgacgcccctgtgtgtgtttccaggcagccgctcagttagatgcgcgccttggctggngtgctctgaccccgaaacgataatcatgcctgatggcggcgtcgggtcctgaaatccctcccctgccccctcggacgcttctggggggcccaccagggtgcttgtgtttgaattggtgtgggtgcaagcactggaaacagcgctaagccatgctcccctggttggtgttttgctccccatcccatctatttatatattcttcagatcctaaccc

SEQ ID NO: 51932 - protein, 105 aa, Zea mays
  misc_feature: Ceres CLONE 1467213-F
  misc_feature (1)..(80): Pfam Name: Metallothio_2 Pfam Description: Metallothionein
  misc_feature (69)..(69): Xaa is any aa, unknown, or other
  misc_feature (70)..(70): Xaa is any aa, unknown, or other
  misc_feature (71)..(71): Xaa is any aa, unknown, or other
  misc_feature (82)..(82): Xaa is any aa, unknown, or other
  misc_feature (83)..(83): Xaa is any aa, unknown, or other
  misc_feature (90)..(90): Xaa is any aa, unknown, or other
MSCCGGNCGCGSGCKCGNGCGGCSKMYPDMAEQVTTTTQALIMGVAPSKGHSKGGFEAAAGADNGGCKXXXNCQCELCVAPXXPRCSTLXAGRRKLANYHNLNKV

SEQ ID NO: 51933 - DNA, 705 bp, Zea mays
  misc_feature: Ceres CLONE 1467215-F
  misc_feature: Encodes the peptide sequence at SEQ ID NO. 51934
  misc_feature (332)..(332): n is a, c, t, g, unknown, or other
  misc_feature (339)..(339): n is a, c, t, g, unknown, or other
  misc_feature (705)..(705): n is a, c, t, g, unknown, or other
aagtggatcccccgggctgcaggaattcgcacgagaccattacctaaaacatcctaatcgaaaagatactccctcagattcttaccaaaacacaggagcccgtcggccgtcgcaaaaaaacaaaacaagaccaccgcaccatggaatcgctgacgcttcgcgcttcgacggccgcctcgccgctgcagcgacgccggctgctccccgggcggcagcgcgcgacgtacgtccgcgccacggcctccgccggcgagccggacctctccgtgcgcgtgaacgggctgcagatgcccaacccgttcgtgatcggggcggggccaccgggtattaantacaccntcatgaagcgcgccttcgacgagggtggtgctcccccccccccaaaaccgcgtcattggatgctgaaaaagttatcaaccttacccctcgttatgcaaagcttcgggcacaaccaaatggggctgccatgcggcgcatcattggctggcagaacattgaacccctcaatgacacgcctcctggagaccatgctgaatgaattcaagccattgaagaaagactatccttgaccgaaacttatcggttccattttgggaggagaacaaccaaacctgcatggaatgagcttaattgaacgtgttgaaaaagatctgggaggggaagcccccaaaaattaaatttctcagtgcccgcgtggtatggccn

SEQ ID NO: 51934 - protein, 142 aa, Zea mays
  misc_feature: Ceres CLONE 1467215-F
  misc_feature (64)..(64): Xaa is any aa, unknown, or other
  misc_feature (67)..(67): Xaa is any aa, unknown, or other
MESLTLRASTAASPLQRRRLLPGRQRATYVRATASAGEPDLSVRVNGLQMPNPFVIGAGPPGIXYTXMKRAFDEGGAPPPPKPRHWMLKKLSTLPLVMQSFGHNQMGLPCGASLAGRTLNPSMTRLLETMLNEFKPLKKDYP

SEQ ID NO: 51935 - DNA, 783 bp, Zea mays
  misc_feature: Ceres CLONE 1467220-F
  misc_feature: Encodes the peptide sequence at SEQ ID NO. 51936
  misc_feature (397)..(397): n is a, c, t, g, unknown, or other
ctggagctccccgcggtggcggccgctctagaactagtggatcccccgggctgcaggaattcgcacgagaccattacctagaacatcctaatcgaaaagggagggatcatggtggcgccggacgtgaaggcggagacgatgaagctgatggatcagcggggtgccctagaggcggagatggacgccatcatcgcccgcctcactgcggcaggcggaccgggcatcaccggaggcctcgtcgacgccgagggtttcccaaggtccgacatcgacatcccgaacgtcctcgcccagcgccggaggcttgctgaattgcgaaatgacccacaggggatgtacaacaaaatgggtaaaaatcttgagggtttacactcagcaaagttatcagggaatgaancatcaacctcaaggagatctgatacaacagatcccttcaacttttggatcatcccaaagggacccttggaaaaaggactgtggacgggcctccctttttgcctgagtgaagaaacccctaaaggccccccgggcccgggggagggttgccattggaaataaattttaaaatttgggaatgggaaaatgggggaacttttgggaaaaggccttgttaaaaattttctcggaaggagcgggggttttttttttctcctccggggggggggggggtgtattaatcccccccccgggggggggggaaaaaatttggggggcctctctcaaagagaaagaaaacccccttccccaagaagggggtgtttttttttttttttcaaagaagaa

SEQ ID NO: 51936 - protein, 149 aa, Zea mays
  misc_feature: Ceres CLONE 1467220-F
  misc_feature (97)..(97): Xaa is any aa, unknown, or other
MVAPDVKAETMKLMDQRGALEAEMDAIIARLTAAGGPGITGGLVDAEGFPRSDIDIPNVLAQRRRLAELRNDPQGMYNKMGKNLEGLHSAKLSGNEXSTSRRSDTTDPFNFWIIPKGPLEKGLWTGLPFCLSEETPKGPPGPGEGCHWK

SEQ ID NO: 51937 - DNA, 715 bp, Zea mays
  misc_feature: Ceres CLONE 1467224-F
  misc_feature: Encodes the peptide sequence at SEQ ID NO. 51938
  misc_feature (588)..(588): n is a, c, t, g, unknown, or other
  misc_feature (623)..(623): n is a, c, t, g, unknown, or other
  misc_feature (639)..(639): n is a, c, t, g, unknown, or other
tggagctccccgcggtggcggccgctctagaactagtggatcccccgggctgcaggaattcgcacgagaccattacctagaacatcctaatcgaaaaaagtcaacccgctctcgtctcccgggccctcgcctctctctgccgtctgcactgccgcctgccgcgcgcaaggacgcccatggctcgccacggccaagcgctgctcgccgcgctcctcgtgtccgcggtcggcgcagccagcgcgcagccgagctacgatgacggcggccagggccaggtcagcacggccatgatcgcgctcctggtcgccgtcatcgcggtgttcgtgttcatcgcctcattcaccgtctacctccgccactgcaccggctccgcggccacgtcggacgactacgaccgcgccagagccgtgcccaatttcgacgccttcatctcgcggtcgcggaggcagcggcggccgcgcgggctggacgccgaggtggtcgaggctttccccaccatgaagtacgccgaggccaaggcgctccgggtgggcaagggcggcgcgctcgagtgcgcagtgtgcctcagcgagttcaaagacgaggagncgctcaggctcttgcccaagtgcagccacgccttnccacccggaatgcatncggcgagtggctcgccagccacgtgaactgcccccgtctgccgctgcaacctcgaccctaaacaaggataccagca

SEQ ID NO: 51938 - protein, 162 aa, Zea mays
  misc_feature: Ceres CLONE 1467224-F
  misc_feature (138)..(138): Xaa is any aa, unknown, or other
  misc_feature (149)..(149): Xaa is any aa, unknown, or other
  misc_feature (155)..(155): Xaa is any aa, unknown, or other
MARHGQALLAALLVSAVGAASAQPSYDDGGQGQVSTAMIALLVAVIAVFVFIASFTVYLRHCTGSAATSDDYDRARAVPNFDAFISRSRRQRRPRGLDAEVVEAFPTMKYAEAKALRVGKGGALECAVCLSEFKDEEXLRLLPKCSHAXPPGMHXASGSPAT

SEQ ID NO: 51939 - DNA, 641 bp, Zea mays
  misc_feature: Ceres CLONE 1467226-F
  misc_feature: Encodes the peptide sequence at SEQ ID NO. 51940
  misc_feature (1)..(1): n is a, c, t, g, unknown, or other
  misc_feature (26)..(26): n is a, c, t, g, unknown, or other
  misc_feature (27)..(27): n is a, c, t, g, unknown, or other
  misc_feature (219)..(219): n is a, c, t, g, unknown, or other
  misc_feature (234)..(234): n is a, c, t, g, unknown, or other
  misc_feature (236)..(236): n is a, c, t, g, unknown, or other
  misc_feature (546)..(546): n is a, c, t, g, unknown, or other
naactggagctccccgcggtgggcgnngccgctctagaactagtggatcccccgggctgcaggaattcgcacgagaccatacctagaacatcctaatcgaaaaatactggcatgctgcagcacctgcagccctgaccggcgacgattgggcggccgtcgctgcctcctttactcaggtgtccagctcttcttcgtgccttttgccggcgggagcaccancggacgggatgagcnanccggggggaccggagaccgttccctaaatccgggggaactgggccctccccttttttccccccccaaggaacctccggggcccggggatttgggttgggcccggcccctcccgggggtttgtaaatttttttttcccccgggccgcgcccccggggaaaacccccccgggggggcctaaaaaaaccctttcccccctccctggtttgcggaaaatttttttgttttattcacccccttgggggcggtcttttttgtggagaaaaacccctttttttttttccaaagggggcgggggggtgttttgggggncccccccccccccccccccaaaaaaaaaaaaaaagggggggggggggtggtttaaaaaaaaaaaaaacaccccccccccccccccccctccttgc

SEQ ID NO: 51940 - protein, 30 aa, Zea mays
  misc_feature: Ceres CLONE 1467226-F
  misc_feature (8)..(8): Xaa is any aa, unknown, or other
LELPAVGXAALELVDPPGCRNSHETIPRTS

SEQ ID NO: 51941 - DNA, 741 bp, Zea mays
  misc_feature: Ceres CLONE 1467227-F
  misc_feature: Encodes the peptide sequence at SEQ ID NO. 51942
  misc_feature (741)..(741): n is a, c, t, g, unknown, or other
ggagctccccgcggtggcggccgctctagaactagtggatcccccgggctgcaggaattcgcacgagaccattacctagaacatcctaatcgaaaaatcacactcgatcgcagtttgcagaaagctagaagacacaagaacatggcgtccaagcgactcctcgtgctagtagctctcctgctcgccgccgttttccttgccgtctcaggagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggcggctgccggtgctgctcgcgcgccgacgaggtcccggagcccatgtaccgcccggagcccaccgaggtccacaactgaagccgagccacacatcgatctacaaagatgcatggacgacgactcttatcttagctaattaataagcactacatccatgcatgtccacaatagggccctagccctactatactatacgtcgtcagcagaaagtctggttttgatttcaataataagatgcacctatatgtgtgtgttacatgtacgccgttgtcttaaaaaaaaaaaaaaagctatcgatacgtcgactcgaggggggccggtacccan

SEQ ID NO: 51942 - protein, 116 aa, Zea mays; identical to SEQ ID NO: 40624
  misc_feature: Ceres CLONE 1467227-F
  misc_feature (1)..(93): Pfam Name: GRP Pfam Description: Glycine rich protein family

SEQ ID NO: 51943 - DNA, 776 bp, Zea mays
  misc_feature: Ceres CLONE 1467228-F
  misc_feature: Encodes the peptide sequence at SEQ ID NO. 51944
  misc_feature (408)..(408): n is a, c, t, g, unknown, or other
ggagctccccgcggtggcggccgctctataactagtggatcccccgggctgcaggaattcgcacgagaccattacctagaacatcctaatcgaaaatccccccgtttcaatcaaaatggaaaaaagtttcctcccttcccctctcttctgaatccggcatcaccatgcagaacaccgtcgcgaacccttccactgcggccgccgccgctgcggcagggaacggcggcgtccaagcatcgggggctggaggggagcggccggaggacgcgtcgaagcagaacctggcgcaggtgacgagctccatccagaagacgctgggcctgctccaccagctcaacctcaccgtctcctccttcaactctgccccccagctccccctcctccagcgcctgaatgcgctttgtgccnaacctcgacacgatgcaaaaactcgccgaggggtgcaaaatccacggggcctatggaggccgtcaatttgatcgaccatgggaaaaaacccccacgatttccctagggaaggggtctcaagcttgggttccgccaaaacccaatcccccaggggaaaaaaggaaccttttcaggggcccacggaaacctccttcttggagaagttggaaaaattttttcccggagagacgtaaaaacttacgggggagaacgggggtttttttttgttgctgagagaaaagggtttggtcctcaccccccggaatcttttgccctttggggaattccccagggggaaggggaccttttggaggaagggggccacaacg

SEQ ID NO: 51944 - protein, 104 aa, Zea mays
  misc_feature: Ceres CLONE 1467228-F
  misc_feature (82)..(82): Xaa is any aa, unknown, or other
MQNTVANPSTAAAAAAAGNGGVQASGAGGERPEDASKQNLAQVTSSIQKTLGLLHQLNLTVSSFNSAPQLPLLQRLNALCAXPRHDAKTRRGVQNPRGLWRPSI

SEQ ID NO: 51945 - DNA, 672 bp, Zea mays
  misc_feature: Ceres CLONE 1467229-F
  misc_feature (422)..(422): n is a, c, t, g, unknown, or other
gctggagctccccgcggtggcggccgctctagaactagtggatcccccgggctgcaggaattcgcacgagaccattacctagaacatcctaatcgaaaaagattagagagcagagacggtatatgatattaaattcattctccgtctaagattagtcctctgtttcctcgagattagtagatcgatacacagggagggacaggggaaagaaaattccgacaatcattgtcttattcgatctgggagagacagaacataaacagagagatggctatgtctcaggtggtgaacacgtacccgctttccactacagcttcggaactaaagaaccgaagctcgaaaaggacacttccgtcgccgaccgtctcgctcgtatgaaaaatcaatgggtgtttttgcagctatatgaaagagggcatgangactagcgttgatgcgattctgctggtacaagaaacacaccatcctcacatacttcttctgcaaattgtaaacacattctggcagcttccaggttggacgcctggaagcctggaaaaaaccaaaattgaaaggctttgaaaaaaaaagttgaacctagtaaagctttgggaggcaattttctggcgggccctttggacccggaacggggaaagggaagaaaaaattggttttcgcaacccttggggggcc

SEQ ID NO: 51946 - DNA, 748 bp, Zea mays
  misc_feature: Ceres CLONE 1467235-F
  misc_feature: Encodes the peptide sequence at SEQ ID NO. 51947
  misc_feature (721)..(721): n is a, c, t, g, unknown, or other
tggagctccccgcggtggcggccgctctagaactagtggatcccccgggctgcaggaattcgcacgagaccattacctagaacatcctaatcgaaaaaacacagcaccaccaaccaagcaacctcactcgctacaaacaggaaacaacaagcgaaagttttctctcgagggaggaggagaagaccaacaccgggaggagatggcagcagcagcagcagcgacgaaggcgtcgtcgtggatggtggccatgagcgtgggcgccgtggaagcgctcaaggaccagggaggcctctgccgctggaactacgcgctgcggtccgtccaccggaccgccaaggctaacgtgcgcagcagcagaagcttcgccgcgcagcgggacacggagctggtcccggcggcggagaaggggcggcaggaggacaaggccgccgcggaggagggcttgaggaccgtcatgtacctcagctgctggggacccaattaactagcctttcgtatcttagctggtctttggccttcttcagcgaccgcgaggtcgcgagctgattattgtaaatatacaacgatgatcggatgatgatgatgatgaaaaagtctgccaaaaaaaaaaaaaaaagcttatcgataccgtcgacctcgagggggggcccggtaccaatcgccctatagtgagtcgtatacgcgcgctcactggccgtccgtttacaacgtcgtgactganaaaaccctggcgttacccaactaatcg

SEQ ID NO: 51947 - protein, 94 aa, Zea mays
  misc_feature: Ceres CLONE 1467235-F
MAAAAAATKASSWMVAMSVGAVEALKDQGGLCRWNYALRSVHRTAKANVRSSRSFAAQRDTELVPAAEKGRQEDKAAAEEGLRTVMYLSCWGPN

SEQ ID NO: 51948 - DNA, 749 bp, Zea mays
  misc_feature: Ceres CLONE 1467242-F
  misc_feature: Translation starting site: 202
  misc_feature (279)..(279): n is a, c, t, g, unknown, or other
  misc_feature (304)..(304): n is a, c, t, g, unknown, or other
  misc_feature (315)..(315): n is a, c, t, g, unknown, or other
  misc_feature (341)..(341): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (390)..(390): n is a, c, t, g, unknown, or other
  misc_feature (391)..(391): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (403)..(403): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (445)..(445): n is a, c, t, g, unknown, or other
  misc_feature (446)..(446): n is a, c, t, g, unknown, or other
  misc_feature (449)..(449): n is a, c, t, g, unknown, or other
  misc_feature (512)..(512): n is a, c, t, g, unknown, or other
  misc_feature (548)..(548): n is a, c, t, g, unknown, or other
  misc_feature (573)..(573): n is a, c, t, g, unknown, or other
  misc_feature (594)..(594): n is a, c, t, g, unknown, or other
  misc_feature (595)..(595): n is a, c, t, g, unknown, or other
  misc_feature (644)..(644): n is a, c, t, g, unknown, or other
  misc_feature (646)..(646): n is a, c, t, g, unknown, or other
  misc_feature (647)..(647): n is a, c, t, g, unknown, or other
  misc_feature (686)..(686): n is a, c, t, g, unknown, or other
  misc_feature (692)..(692): n is a, c, t, g, unknown, or other
  misc_feature (712)..(712): n is a, c, t, g, unknown, or other
  misc_feature (713)..(713): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
tggagctccccgcggtggcggccgctctagaactagtggatcccccgggctgcaggaattcgcacgagaccattacctagaacatcctaatcgaaaagtcttctccgttcagcctccgccctccgctctgcctctgcgtcttccaccctttgccatttgcttgcaatgtctaatacctgagtgagagagcttcctcagtccatggaggtgtcgtcgaggctccaaagcctcctcagacccttcctactctggcgctcccgcgccgcagggatgaccctncaaaccctagctctttgctccccgncgcctcctccncgcatcccatcttctttcctcctccnaacgcgccgtctaccttctcctttnnnnnnnncgnnnnnnnntnnnntnntgngnnnggggncccannnnnnnnnggnnngggggggcccgggggcacaagagnnccnccaacaaacaacagaaaaaacaaatatatatcgcccaccacaattgtgtttgataagatcgantagccggaccctaaaccagaacatccaaaaggcggnagcggaaaaagaaagataagaaatnttaaaaacagcgagacaaatnnttaaaaaacaaaataagagttaatagcaaagacgaaaaaggcgagaagntnnatgagacagtacacacagaaaagagtttgagcaggaagngtgagngagtaacaggcaagaagggnntnnnnctctcgagcgtgaagagctggtggggcgtag

SEQ ID NO: 51949 - DNA, 958 bp, Zea mays
  misc_feature: Ceres CLONE 1467244
  misc_feature: Encodes the peptide sequence at SEQ ID NO. 51950
attccgctcactcaccttttgcagaaaacccaccgacttctccaaagcatcccatttccgcccctcctcgctgccctccttcccaatctccgcaccgccaccgcgagcggcggtacgcgcgcgccagatcgcccgccccctcgccgccgcaccggcgcaggtccgccgcgcccccggccgccgccattgcgcgcggacgagcgaccccgccccgccccgccccctgaaggacgcgaggcgccgcacccaccccgcgcgcggggggagggcgccgccgcggcgcgtacggcgatggtgatgatcagcaggcagctcctgctcacctacctctacctgctcatctacatctgcctctcgtcgggggtcatcctcttcaacaaatgggtgctatctcctaagtacttcaaattcccctttcccattactctcacaatgattcacatgtcattttctggagtcgtggcgttcttcctagtccgtgttttcaaggttgttgcacctgtcaagatgactttccaaatatatgccacatctgtaattcccattagtgccttctttgcgtcaagtctttggttcggaaatacagcatacttatacatttcagtggccttcattcaaatgctcaaggctttgatgcctgtggcgacatttataatggccgttctatgtggtactgacaaattaagacgggaccttttcttgaacatggtgctggtcagtgttggtgttgtagtttcatcatatggggagattcattttaatgtaataggaacattataccaagtaactggcattgttgcggaagccctcaggctggtcctgacacaggtcctcctccaaaaaaagggattaaccctgaatcctattacaagtctgtattacatagcgccttgcaggtaccagatacttcatctaaaattctgaatagttgcttgcttaaacaaaaaaaaaaaaaaaa

SEQ ID NO: 51950 - protein, 210 aa, Zea mays
  misc_feature: Ceres CLONE 1467244
MVMISRQLLLTYLYLLIYICLSSGVILFNKWVLSPKYFKFPFPITLTMIHMSFSGVVAFFLVRVFKVVAPVKMTFQIYATSVIPISAFFASSLWFGNTAYLYISVAFIQMLKALMPVATFIMAVLCGTDKLRRDLFLNMVLVSVGVVVSSYGEIHFNVIGTLYQVTGIVAEALRLVLTQVLLQKKGLTLNPITSLYYIAPCRYQILHLKF

SEQ ID NO: 51951 - DNA, 747 bp, Zea mays
  misc_feature: Ceres CLONE 1467246-F
  misc_feature: Encodes the peptide sequence at SEQ ID NO. 51952
  misc_feature (516)..(516): n is a, c, t, g, unknown, or other
  misc_feature (689)..(689): n is a, c, t, g, unknown, or other
  misc_feature (727)..(727): n is a, c, t, g, unknown, or other
ggagctccccgcggtggcggccgctctagaactagtggatcccccgggctgcaggaattcgcacgagaccattacctagaacatcctaatcgaaaaaagctaacatttagttgcaaaggagcgctaggaagaagaagcaacgagccatggcctccggtggcccgaaacccaaactggcctacatcatcttgtacgtgagggacgtggagaaggccgcctccttctacgacgccgccttcggctacaccgtccgccgcctcgaccagtcccgcaagtgggcggagctggagagcggggcgacgaccatcgcgttcacgccgctgcaccagcgggagacggacgagctgtcgggggcggtgcagctgccggactcgtcggccgccgggaggggctccgtagaggtctgcttcgcctacgcggacgtcgacgcggcgtacaagcgcgccgtggacaacggggccgtggccgtgagcgcgccggaagacaagccctggggccagaagtccggcttcgtgncggacatggacggcaacatcgtgcgcatcgcgagctacgtgcgagagtagtcgcattccgctgcatcaccatcggtcgatcgatcagccttttccatgcatgtctcgtatactacacgtctacacgtgtaccaaaaaataaatataatcgttgtgcaggtcatgtttgtcttnggagaggtaggaccggtgaagaatgaaatggaccgtgnaagcatgatacaaaagcgcc

SEQ ID NO: 51952 - protein, 139 aa, Zea mays
  misc_feature: Ceres CLONE 1467246-F
  misc_feature (9)..(133): Pfam Name: Glyoxalase Pfam Description: Glyoxalase/Bleomycin resistance protein/Dioxygenase superfamily
  misc_feature (124)..(124): Xaa is any aa, unknown, or other
MASGGPKPKLAYIILYVRDVEKAASFYDAAFGYTVRRLDQSRKWAELESGATTIAFTPLHQRETDELSGAVQLPDSSAAGRGSVEVCFAYADVDAAYKRAVDNGAVAVSAPEDKPWGQKSGFVXDMDGNIVRIASYVRE

SEQ ID NO: 51953 - DNA, 714 bp, Zea mays
  misc_feature: Ceres CLONE 1467251-F
  misc_feature: Encodes the peptide sequence at SEQ ID NO. 51954
  misc_feature (482)..(482): n is a, c, t, g, unknown, or other
  misc_feature (491)..(491): n is a, c, t, g, unknown, or other
  misc_feature (590)..(590): n is a, c, t, g, unknown, or other
  misc_feature (601)..(601): n is a, c, t, g, unknown, or other
aagctggagctccccgcggtggcggccgctctagaactagtggatcccccgggctgcaggaattcgcacgagaccattacctagaacatcctaatcgaaaagatttgggaaagaaagcaaaagaaacgaaactagagggtagaacacgacggtgtccggcgtccgtaaaaaaggaggagaggaggccagggaggcgggggcagcaagaatggcgtgctccaccggtctctgcttcttggcgtcgattcctcctctctcagcctcttgttcttctggctcctcctgcttcctcatgatcaagcgtgtgtcctctgctccgtccttgtccagatggacgatccaatacaagcaattgggacatacaatatatcggagaagccacgttctggcctttgctagtgcagatgcaccacaaggcaaaagaagctcaggtgagaatgttgtgatggttgatccactggaagctaagcgcctagctgctnaacaaatgncagaaattagggccaaagaaaagctgaagaggcgccgtcaagcagaagcgatcaacggggcattggcagtgataggactcacggctggattgctagtgnaggctcaaacnggaaaggacatcttagggcagctagcttgatatctgacggctatttctagttatttgggcataaccctggacatgggtgggaattttattttcccggtccccgggcaggaaag

SEQ ID NO: 51954 - protein, 140 aa, Zea mays
  misc_feature: Ceres CLONE 1467251-F
  misc_feature (92)..(92): Xaa is any aa, unknown, or other
  misc_feature (95)..(95): Xaa is any aa, unknown, or other
  misc_feature (128)..(128): Xaa is any aa, unknown, or other
MACSTGLCFLASIPPLSASCSSGSSCFLMIKRVSSAPSLSRWTIQYKQLGHTIYRRSHVLAFASADAPQGKRSSGENVVMVDPLEAKRLAAXQMXEIRAKEKLKRRRQAEAINGALAVIGLTAGLLVXAQTGKDILGQLA

SEQ ID NO: 51955 - DNA, 733 bp, Zea mays
  misc_feature: Ceres CLONE 1467252-F
  misc_feature: Encodes the peptide sequence at SEQ ID NO. 51956
  misc_feature (646)..(646): n is a, c, t, g, unknown, or other
  misc_feature (691)..(691): n is a, c, t, g, unknown, or other
  misc_feature (692)..(692): n is a, c, t, g, unknown, or other
tggagctccccgcggtggcggccgctctagaactagtggatcccccgggctgcaggaattcgacgagaccattacctagaacatcctaatcaaaaaaccccaagcagcaagcacccgagcggccagctccagccccaccagagaaatacggcgtaaacgccgccggggaccaacccaggcgaccggggtgcctagctcgccgttcttttcgccttctcctcgcaatttcttaggatcaacgccctactacacgacgggggttttccccttcggccgccactccgtcctttcgcagcctgccgccggcgccatgctgtacatcgtgggcctcggcctgggcgacgagcgcgacatcactgtgcgggggctcgatgccgtacgcagctgctccaagatatacatggaggcatacacatccctcctttccctcggcctcgacccggccgcgctcgccaacctggagaagctgtacgggaaggagataacggtcgccgatcgggagatggtggaggagcgtgtcgaccaggtgctaagcgaggctgccgacactgacgtcgccttccttggttgtggcgacccgttcggggcaactcacatactgatctggttgttcgtgccagaaaatgggagtagaagtgaaggtgantccacatgcatctgtcatgaatgcaatttggagttgtgggctacnnacttaccgctatggagaactatctcaataccattcttcaca

SEQ ID NO: 51956 - protein, 141 aa, Zea mays
  misc_feature: Ceres CLONE 1467252-F
  misc_feature: SWISSPROT Homolog: EC 2.1.1.98 Diphthine synthase
  misc_feature (112)..(112): Xaa is any aa, unknown, or other
  misc_feature (128)..(128): Xaa is any aa, unknown, or other
MLYIVGLGLGDERDITVRGLDAVRSCSKIYMEAYTSLLSLGLDPAALANLEKLYGKEITVADREMVEERVDQVLSEAADTDVAFLGCGDPFGATHILIWLFVPENGSRSEGXSTCICHECNLELWATXLPLWRTISIPFFT

SEQ ID NO: 51957 - DNA, 780 bp, Zea mays
  misc_feature: Ceres CLONE 1467257-F
  misc_feature: Encodes the peptide sequence at SEQ ID NO. 51958
  misc_feature (703)..(703): n is a, c, t, g, unknown, or other
aagctggagctccccgcggtggcggccgctctagaactagtggatcccccgggctgcaggaattcgcacgagaccattacctagaacatcctaatagaaaaattgacccgccgcctctacgcccctccagtctcctctgtcatggccggcggcaaactattcggtcgagcgctgagctacgttgtcaaccagttcctcgtcgagggcctcgccaacaaccgtgcagtccagaggtttgctgtgaagaccaacaagactcttgagagcctatcgtctaaagccaaggaaatgagggaggagttatcggaacaattcaaggatgctcgtggccagaaagatcacttcaagcagtgaagccgatccccaaagttgattcaacgacacgaatctagctatgagttttttctagttctcgtccgggtcctatttatgaatggcatttgaagggatttcttgttgtcgttcaatggacggatccgttgtataaagtttatctgcacttaaattagtagatatattggtagaaccttcccttttcggctgccccttttttctaaaaaacatatatccccgatcctctactgtattagccaaaactcccttctgttttctaaaaaaaaaaaaaaaaaaaaaggttattcgattcccccccacctccgagggggggcgcccggacaccaatttcccccctaaaggggagccnaataaccgcccgctccttgcgccgtcttttttcaaacggcgggggaggggaaaaaccctggccttcacccactttaa

SEQ ID NO: 51958 - protein, 70 aa, Zea mays
  misc_feature: Ceres CLONE 1467257-F
MAGGKLFGRALSYVVNQFLVEGLANNRAVQRFAVKTNKTLESLSSKAKEMREELSEQFKDARGQKDHFKQ

SEQ ID NO: 51959 - DNA, 802 bp, Zea mays
  misc_feature: Ceres CLONE 1467259-F
  misc_feature: Encodes the peptide sequence at SEQ ID NO. 51960
  misc_feature (308)..(308): n is a, c, t, g, unknown, or other
  misc_feature (312)..(312): n is a, c, t, g, unknown, or other
  misc_feature (317)..(317): n is a, c, t, g, unknown, or other
  misc_feature (323)..(323): n is a, c, t, g, unknown, or other
  misc_feature (336)..(336): n is a, c, t, g, unknown, or other
aagctggagctccccgcggtggcggccgctctagaactagtggatcccccgggctgcaggaattcgcacgagaccattacctagaacatcctaatcgaaaaacctcacccctccccataaatgcactgtatcacccctgccttcctgctagttctccagagagagccgggagaacttggctgtctgccctgtctgcaagtacctcgtcttcttcctggagagaaaaagcagaagacaatacaaagatgtccaagatggcggaggagaaggcggcggcagtgggcggactcggaagagccggggcggcngacncggcncaacancagcagctggcancaggggaagccgcggcggcccgggtgccgcccgtgaagaccctgcttcgcgccgcaccgctggggctctgcgtggccgccttgaccgtcatgctccctaacccgcagagccacgagtacgggggccgtcccctaattccgacttgggaaggttttcaggtacctcgtttaacccaaagggcctttgggggtggctaactcgctgggaaccgggtttcaaacctgccgggccaaagcccgccccccttgtccggcctcctgggttccttttccttcctcaacaaggggtcccccaaccatagaacccgggggggggaaacacggggggaaaatttttttttcccccccccaaaagggaacaaaagagggaccggaggaaaaaattttgcgttttttttggaatttttccggggggggggcccccctccccccccctttcttttagcgccctttttttttttcactcc

SEQ ID NO: 51960 - protein, 95 aa, Zea mays
  misc_feature: Ceres CLONE 1467259-F
  misc_feature (23)..(23): Xaa is any aa, unknown, or other
  misc_feature (26)..(26): Xaa is any aa, unknown, or other
  misc_feature (31)..(31): Xaa is any aa, unknown, or other
MSKMAEEKAAAVGGLGRAGAADXAQXQQLAXGEAAAARVPPVKTLLRAAPLGLCVAALTVMLPNPQSHEYGGRPLIPTWEGFQVPRLTQRAFGGG

SEQ ID NO: 51961 - DNA, 653 bp, Zea mays
  misc_feature: Ceres CLONE 1467361-F
  misc_feature: Encodes the peptide sequence at SEQ ID NO. 51962
aagctggagctccccgcggtggcggccgctctagaactagtggatcccccgggctgcaggaattcgcacgagaccattacctagaacatcctaatcgaaaaaggacagcggaggagaaatcgcccttcttccagtttcattcagacaaattccttcccagttttgactgtcgttgctcctgctgcttccgtgcgctccctgaatcccagtctcctcccccgtcgcgtcccggatcggagctcccctccgtccacggtgggacaccgccagcacgggcgtctccactcccctcggatcggccagccccgtcgccgcaagataagcaagctatgaggtgcctgcctttcttgcatggagacgtcagtgagaaggatcctgtcactaagtcggcctctgtacggtccatgagcacaacatcgcgctcccgctccggttcagacttcacctccttgaatgtttccgacatgagcgccgagtcaataaggaggacacagtaccccagcttcactgactgcccgtctaacctgagggtgttctcctttgctgaattgaagagtgccacacgcaacttcagccgatctctcatgcttggcgagggtggctttggctgtgtgttcagcggcatcatcaagacctctgaacaacctaatgaa

SEQ ID NO: 51962 - protein, 108 aa, Zea mays
  misc_feature: Ceres CLONE 1467361-F
  misc_feature: SWISSPROT Homolog: EC 2.7.11.1 Non-specific serine/threonine protein kinase
MRCLPFLHGDVSEKDPVTKSASVRSMSTTSRSRSGSDFTSLNVSDMSAESIRRTQYPSFTDCPSNLRVFSFAELKSATRNFSRSLMLGEGGFGCVFSGIIKTSEQPNE

SEQ ID NO: 51963 - DNA, 743 bp, Zea mays
  misc_feature: Ceres CLONE 1467364-F
  misc_feature: Encodes the peptide sequence at SEQ ID NO. 51964
  misc_feature (24)..(24): n is a, c, t, g, unknown, or other
  misc_feature (36)..(36): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (53)..(53): n is a, c, t, g, unknown, or other
  misc_feature (54)..(54): n is a, c, t, g, unknown, or other
tggttttttcgctcgtcgcccccncccccccccccnttntnnnncaaaccccnnccaaactgggactcaccgcggtggcggccgctctataatagtggatcccccgggctgcaggtattcgcacgagaccattacctagaacatcctaatcgaaaaaaacagatctctccacccccagcccatccatggcgatcgtgtacgccctggtcgcgcggggcacggtggtgctggccgagttcgccgccgtctcgggaaacgccggcgccgtgacccgtcggatcctcgagaagctgccgcccgacgccaagtccaggctgtgcttcgcgcaggaccggtacatcttccacgtcctccgatccgacgccgccggcatcaccttcctctgtatggccaacgacaccttcggaagaaggatcccctttctctacgtggaggacatccaaatgaggttcatgaaaaactatttccacccccccactctgcgctggcttacgccatgaacgatgagttcccccaacggctccatcagcaaatggagttcttctccaggaacccaagcgccgacatactcaaccgtctccgtgggacaagtcagcagagatacaaccccgtcttgggtcgaacaacatagtagaaaaattctgtgaacagaaggggaattggcattcccggcttccttggtcctacaaagaacattccaaccagatgtcttagaacaacaggcccttttcgacattaccggg

SEQ ID NO: 51964 - protein, 104 aa, Zea mays
  misc_feature: Ceres CLONE 1467364-F
MAIVYALVARGTVVLAEFAAVSGNAGAVTRRILEKLPPDAKSRLCFAQDRYIFHVLRSDAAGITFLCMANDTFGRRIPFLYVEDIQMRFMKNYFHPPTLRWLTP

SEQ ID NO: 51965 - DNA, 629 bp, Zea mays
  misc_feature: Ceres CLONE 1467374-F
  misc_feature: Encodes the peptide sequence at SEQ ID NO. 51966
  misc_feature (487)..(487): n is a, c, t, g, unknown, or other
  misc_feature (495)..(495): n is a, c, t, g, unknown, or other
  misc_feature (498)..(498): n is a, c, t, g, unknown, or other
  misc_feature (503)..(503): n is a, c, t, g, unknown, or other
  misc_feature (569)..(569): n is a, c, t, g, unknown, or other
  misc_feature (570)..(570): n is a, c, t, g, unknown, or other
  misc_feature (578)..(578): n is a, c, t, g, unknown, or other
  misc_feature (599)..(599): n is a, c, t, g, unknown, or other
aagctggagctccccgcggtggcggccgctctagaactagtggatcccccgggctgcaggaattcgcacgagaccattacctagaacatcctaatcgaaaacacatctcccccggcgtcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctcgaggctgccaagaagttcgagccgaaataccgcctcatcaggaatggtcttgctactaaggttgagaagtcccgcaagcaaatgaaagagcgaangaacaggnccnagaangatcgtgggtgtcagaagaccaaagctggtgacgcccagaagaaagtaaacgtcgtttacatttgnnatactggntctgggctctggggtgtctanctgcattgtcataattatggtccggggtag

SEQ ID NO: 51966 - protein, 163 aa, Zea mays
  misc_feature: Ceres CLONE 1467374-F
  misc_feature (28)..(111): Pfam Name: Ribosomal_S24e Pfam Description: Ribosomal protein S24e
  misc_feature (117)..(117): Xaa is any aa, unknown, or other
  misc_feature (120)..(120): Xaa is any aa, unknown, or other
  misc_feature (121)..(121): Xaa is any aa, unknown, or other
  misc_feature (122)..(122): Xaa is any aa, unknown, or other
  misc_feature (144)..(144): Xaa is any aa, unknown, or other
  misc_feature (145)..(145): Xaa is any aa, unknown, or other
  misc_feature (154)..(154): Xaa is any aa, unknown, or other
MADSKATSAVTLRTRKFMTNRLLARKQFVLEVIHPGRANVSKAELKERLAKAYEVKDPNTIFVFKFRTHFGGGKSTGFGLIYDNLEAAKKFEPKYRLIRNGLATKVEKSRKQMKERXNRXXXDRGCQKTKAGDAQKKVNVVYIXXTGSGLWGVXLHCHNYGPG

SEQ ID NO: 51967 - DNA, 1039 bp, Zea mays
  misc_feature: Ceres CLONE 1467375
  misc_feature: Encodes the peptide sequence at SEQ ID NO. 51968
gcgtcaccggcatttaatcccgcgtcccattccgaacagcgagcacaaccaccgctgctgcgatctcgccgtctccttcctccacgccgtctcggtctccctcccatggccggctacccgcctcccggctccggctacccctacggtcccggcgggggctacggcgccccgccgccgccctacggctcctcgcccgcgccctccgccccgccgtacggcgagaagcctcccaaggaaggcaagacctcgacctcctccgcgcccccctactacggcgcgcctcccccatcctacggcgcgccgcccccctcccagccctacggcggcgggggcgggggcgggggcgggggcgggtacgggtacggcgcctcgcagccgccgccctacggcggcgccccgcagcagcagcagcagcagcccccgtacgggggcggggccccggcagggttcggcagcccgttcgcgtcgctggtgccctccgcgttcccgcccggcaccgaccccaacgtcgtggcctgcttccaggcggccgaccgcgacggcagcggcatgatcgacgacaaggagctgcagtccgcgctgtccgggtacaaccagagcttcagcctccgcaccgtccacctcctcatgtacctcttcaccaacaccaacgtccgcaagatcggacccaaggaatttacttctgtgttttacagtcttcagaactggagagcaatatttgagaggtttgatcgtgatcgaagtggcaggatcgacatgtcagaactgcgcgatgctcttctcagtctcggatattctgtgtctccaactgtccttgatctgcttgtgtctaaatttgacaagactgggggcaagagcaaagcaatcgaatatgacaacttcattgaatgctgcctcactgttaaggggctgacagagaagttcaaggagaaggacaccgcctactctgggtcggcgactttcacctacgaggccttcatgctgaccgtgctgcctttcctcattgcgtagtggcagtccactccgccgctcaaaacaa

SEQ ID NO: 51968 - protein, 301 aa, Zea mays
  misc_feature: Ceres CLONE 1467375
  misc_feature (200)..(228): Pfam Name: efhand Pfam Description: EF hand
  misc_feature: SWISSPROT Homolog: EC 3.4.22.52 Calpain-1
MAGYPPPGSGYPYGPGGGYGAPPPPYGSSPAPSAPPYGEKPPKEGKTSTSSAPPYYGAPPPSYGAPPPSQPYGGGGGGGGGGGYGYGASQPPPYGGAPQQQQQQPPYGGGAPAGFGSPFASLVPSAFPPGTDPNVVACFQAADRDGSGMIDDKELQSALSGYNQSFSLRTVHLLMYLFTNTNVRKIGPKEFTSVFYSLQNWRAIFERFDRDRSGRIDMSELRDALLSLGYSVSPTVLDLLVSKFDKTGGKSKAIEYDNFIECCLTVKGLTEKFKEKDTAYSGSATFTYEAFMLTVLPFLIA

SEQ ID NO: 51969 - DNA, 586 bp, Zea mays
  misc_feature: Ceres CLONE 1467381-F
  misc_feature: Encodes the peptide sequence at SEQ ID NO. 51970
  misc_feature (402)..(402): n is a, c, t, g, unknown, or other
  misc_feature (403)..(403): n is a, c, t, g, unknown, or other
  misc_feature (481)..(481): n is a, c, t, g, unknown, or other
  misc_feature (482)..(482): n is a, c, t, g, unknown, or other
  misc_feature (493)..(493): n is a, c, t, g, unknown, or other
tggagctccccgcggtggcggccgctctagaactagtggatcccccgggctgcaggaattcgcacgagaccattacctagaacatcctaatcgaaaaactgtctcctccaacgccgctcacggcttcgcttcagtgtcttcacgggccgccggcggagatgcggttcacggcgtctccggtggtggagcttccggtcagcggcgcggtgttgactttcgagcaggacaacgactccttcgaggtgggcacctctgtgtggccctcgtccctggtcctcgtcaagttcgtcgagcgctgcatccgcgacccggccctcccctttgccgacgtgctccgcttcccgggaacccgggccgtggagctcgggtccgggtgcggaccggcaggacttggcctctccnncgctcggcctcacgatctcgtcctcaccgacatcgccgccgtgctcccggcgctccgccgcaacctgcggcgcaaccnngagtcactcgngcgcgcgccccgccctcgccagtttcactggaactgccccgcgcatctcgcgacgctagccacccgcgccgcttcgatctcgtcgtcgccgca

SEQ ID NO: 51970 - protein, 142 aa, Zea mays
  misc_feature: Ceres CLONE 1467381-F
  misc_feature (82)..(82): Xaa is any aa, unknown, or other
  misc_feature (108)..(108): Xaa is any aa, unknown, or other
  misc_feature (112)..(112): Xaa is any aa, unknown, or other
MRFTASPVVELPVSGAVLTFEQDNDSFEVGTSVWPSSLVLVKFVERCIRDPALPFADVLRFPGTRAVELGSGCGPAGLGLSXARPHDLVLTDIAAVLPALRRNLRRNXESLXRAPRPRQFHWNCPAHLATLATRAASISSSP

SEQ ID NO: 51971 - DNA, 732 bp, Zea mays
  misc_feature: Ceres CLONE 1467403-F
  misc_feature: Encodes the peptide sequence at SEQ ID NO. 51972
  misc_feature (12)..(12): n is a, c, t, g, unknown, or other
  misc_feature (28)..(28): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
ggatgtgtaaanaaccaccaaaaaaacnanaaannncnnnnnntgggggactnnnnccaaaactggagctccccgcggtggcggccgctctagaactagtggatcccccgggctgcaggaattcgcacgagaccattacctagaacatcctaatcgaaaaaaacctccacgaccaacgaggcaacgaccaaacgtccaaacccttccccctccctagctccgtgctccagcgggagtccgcggcggcggtgaagatgattatcccagtgcgctgcttcacctgcggcaaggttattgggaacaagtgggatctatacctcgacctcctccaggccgactactcagaaggggatgctctggatgctttggaattggtccgctactgctgcaagcgaatgctcatgacacatgttgacctcattgagaagttgctcacctacaaccccctaaaaaaagaccgaaacaagttaggcgagcacatcatgcttccaaaaacactaccggtttggcagtatcctaaagctttaaggaggaaggggggccccttccccccaacaaaaaaaaaagggtttgggagaggggaaaaactggtttttttaaaagggagcttttttcctgggcaaaaaagggggctttttttttgcgcccccccccttttttccccacaaaaagggggggggggaaaattattttttttggagggggggggggaataattcctgcggcgccaca

SEQ ID NO: 51972 - protein, 153 aa, Zea mays
  misc_feature: Ceres CLONE 1467403-F
  misc_feature (1)..(60): Pfam Name: RNA_pol_N Pfam Description: RNA polymerases N / 8 kDa subunit
  misc_feature: SWISSPROT Homolog: EC 2.7.7.6 DNA-directed RNA polymerase
MIIPVRCFTCGKVIGNKWDLYLDLLQADYSEGDALDALELVRYCCKRMLMTHVDLIEKLLTYNPLKKDRNKLGEHIMLPKTLPVWQYPKALRRKGGPFPPTKKKGFGRGEKLVFLKGSFFPGQKRGLFFCAPPLFSPQKGGGGKLFFLEGGGE

SEQ ID NO: 51973 - DNA, 705 bp, Zea mays
  misc_feature: Ceres CLONE 1467409-F
  misc_feature: Encodes the peptide sequence at SEQ ID NO. 51974
  misc_feature (438)..(438): n is a, c, t, g, unknown, or other
  misc_feature (439)..(439): n is a, c, t, g, unknown, or other
  misc_feature (453)..(453): n is a, c, t, g, unknown, or other
  misc_feature (467)..(467): n is a, c, t, g, unknown, or other
  misc_feature (600)..(600): n is a, c, t, g, unknown, or other
tggagctccccgcggtggcggccgctctagaactagtggatcccccgggctgcaggaattcgcacgagaccattacctagaacatcctaatcgaaaaggactcaccatcgtcgtctttttttcggccctacttctgtctgactgtctctacggctgccgacgagccgcgcaaccgaactcattgcacgaggactcgcacagatcggtgagcgagcaagcgagagatggctgggaggctaaccgcggcagggtcccgcatcctgggcggcggcggcgcacgcgccgcggcttccgccctccgacaccgcgccggcatgggcctccccgtcggccgccacttcgtccccgacaagcccctccccgtgaatgatgagttggtatgggataacgggacgcccttcccggaaccctccatcgaccgccttgccccgcccatcnncaagtaccacgcgntggcctggctgtgnggaggggtagggttcttcgctgccctcgggtatggctgctgtttctgaaggaccaggccctccaattttccattgtactcccaaaggttttcccgttccggacacctttgcagagcctggagcctaggggganaggaaccataagaaagggttttttttggtcaaggttttgacgcacggcacccttttggattgacaatatgcaacccagcaaaatcccatacatccctaccactct

SEQ ID NO: 51974 - protein, 96 aa, Zea mays
  misc_feature: Ceres CLONE 1467409-F
  misc_feature (72)..(72): Xaa is any aa, unknown, or other
  misc_feature (77)..(77): Xaa is any aa, unknown, or other
  misc_feature (81)..(81): Xaa is any aa, unknown, or other
MAGRLTAAGSRILGGGGARAAASALRHRAGMGLPVGRHFVPDKPLPVNDELVWDNGTPFPEPSIDRLAPPIXKYHAXAWLXGGVGFFAALGYGCCF

SEQ ID NO: 51975 - DNA, 662 bp, Zea mays
  misc_feature: Ceres CLONE 1467412-F
  misc_feature: Encodes the peptide sequence at SEQ ID NO. 51976
  misc_feature (575)..(575): n is a, c, t, g, unknown, or other
aaagctggagctccccgcggtggcggccgctctagaactagtggatcccccgggctgcaggaattcgcacgagaccattacctagaacatcctaatcgaagacacagccacgagccaagcgcgacggatcccaatccatcttctcctcatccccaccacgaccaaaaaaaaatccggtcgccgatgccgtctgctgcctgacatcggtcagccagggtagatcgcgcaggcaggcaggcagccccacacacatacgaaacccaatcctgcttcgatcccgtcggccggcgatggagggccggcggccgggcgcgcccgtggcgggcctgcccatcggcttccgcttccgccccaccgacgaggagctgctgctgcactacctccgccgcaaggcgctggcctgcccgctccccgccggcgtcatccccgacgccgacctcgcgcgcctccacccgtgggacctcctccccgccgccgccgccgcaccagggggatccggagccgacgccgacggggagcgcttcttcttccaccgcccggtgaccgggtgcgaaaaaaggggggcggcggcgcgnccaagggcggccggcaccggcgtctggaggccgtccggcaaggagaccctcgtcctgtccccgcgctgcaagcgtcccgtcggcacc

SEQ ID NO: 51976 - protein, 124 aa, Zea mays
  misc_feature: Ceres CLONE 1467412-F
  misc_feature (13)..(124): Pfam Name: NAM Pfam Description: No apical meristem (NAM) protein
MEGRRPGAPVAGLPIGFRFRPTDEELLLHYLRRKALACPLPAGVIPDADLARLHPWDLLPAAAAAPGGSGADADGERFFFHRPVTGCEKRGAAARPRAAGTGVWRPSGKETLVLSPRCKRPVGT

SEQ ID NO: 51977 - DNA, 675 bp, Zea mays
  misc_feature: Ceres CLONE 1467415-F
  misc_feature: Encodes the peptide sequence at SEQ ID NO. 51978
  misc_feature (489)..(489): n is a, c, t, g, unknown, or other
taaagctggagctccccgcggtggcggccgctctagaactagtggatcccccgggctgcaggaattcgcacgagaccattacctagaacatcctaatcgaaaaggtcgcctcctccgccactgccatctccctcctctgtcctccgtaccactcgtcttcgtctagccgccgaccgccaccaccatggcacccggcctctacaccgacatcggcaagaagaccagagatctgctgtacaaggactacaacacgcaccagaattctgcctcccacctcctcccccatggcgtcgcatcacagccgcaggaacaaggaaaatgagtccatctttggtgagcttcaccccagaataagaacaagaaattgacagttgatgtcaaagcaaactcagaatcagatctttttaacaacatcactgttgatgaagttcggtactccagggctaaaatcattattcaatttggttgtccaaaaccaaagtcaggaantcttgaattcccaacctaactgaaatagctgggggaaaagaaaaccccgggttaattcccaacccagggtaacccttttgggggcccttgaaaaaaaaccctcccccccggggttgatgtcccttttttaaaggggaattagttttttcccaaaaaaaaaggggcgccaggaccccacaaaaaaaa

SEQ ID NO: 51978 - protein, 45 aa, Zea mays
  misc_feature: Ceres CLONE 1467415-F
MAPGLYTDIGKKTRDLLYKDYNTHQNSASHLLPHGVASQPQEQGK

SEQ ID NO: 51979 - DNA, 706 bp, Zea mays
  misc_feature: Ceres CLONE 1467428-F
  misc_feature: Encodes the peptide sequence at SEQ ID NO. 51980
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (152)..(152): n is a, c, t, g, unknown, or other
  misc_feature (354)..(354): n is a, c, t, g, unknown, or other
  misc_feature (365)..(365): n is a, c, t, g, unknown, or other
  misc_feature (367)..(367): n is a, c, t, g, unknown, or other
  misc_feature (371)..(371): n is a, c, t, g, unknown, or other
  misc_feature (372)..(372): n is a, c, t, g, unknown, or other
  misc_feature (374)..(374): n is a, c, t, g, unknown, or other
  misc_feature (375)..(375): n is a, c, t, g, unknown, or other
  misc_feature (387)..(387): n is a, c, t, g, unknown, or other
  misc_feature (436)..(436): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagaactagtggatccccncgggctgcaggaattcgcacgagaccattacctagaacatcctaatcgaaaactctctctagcgccggtggcggcgacgggcgcacgacgtctgagaccatggcgccgccgccggagcctcgccgccccgtacagcgaccggccatctcccgacagcagcgccgtcgggagctcgcactcccagcgcagtcggctcggcggnccgatgcccangntcgnngnngcgcgccctcgncatttttctcctcaccacccagggggcctaccgcggccaccagtcccgncggatttcaaggggaggaggaatccgagccctgaggagggaggattaacccccgacctcacctggctgtgggggttcccggggggcccccccccccccctccagggttcccccgggtttcaaaaacccgtttgggggtttccccccgcccaggttttttcctccccaaaaatggaaagggtgatatatcccccccccccaattttttaaagggaaaggggggtttttttttttccccacacctttttggggaaaaaaaaatttttggggt

SEQ ID NO: 51980 - protein, 72 aa, Zea mays
  misc_feature: Ceres CLONE 1467428-F
  misc_feature (35)..(35): Xaa is any aa, unknown, or other
  misc_feature (38)..(38): Xaa is any aa, unknown, or other
  misc_feature (39)..(39): Xaa is any aa, unknown, or other
  misc_feature (41)..(41): Xaa is any aa, unknown, or other
  misc_feature (42)..(42): Xaa is any aa, unknown, or other
  misc_feature (46)..(46): Xaa is any aa, unknown, or other
  misc_feature (62)..(62): Xaa is any aa, unknown, or other
MAPPPEPRRPVQRPAISRQQRRRELALPAQSARRXDAXXRXXAPSXFFSSPPRGPTAATSPXGFQGEEESEP

SEQ ID NO: 51981 - DNA, 849 bp, Zea mays
  misc_feature: Ceres CLONE 1467462-F
  misc_feature: Encodes the peptide sequence at SEQ ID NO. 51982
  misc_feature (13)..(13): n is a, c, t, g, unknown, or other
  misc_feature (16)..(16): n is a, c, t, g, unknown, or other
  misc_feature (41)..(41): n is a, c, t, g, unknown, or other
  misc_feature (44)..(44): n is a, c, t, g, unknown, or other
  misc_feature (488)..(488): n is a, c, t, g, unknown, or other
  misc_feature (489)..(489): n is a, c, t, g, unknown, or other
  misc_feature (849)..(849): n is a, c, t, g, unknown, or other
tttggtgggtggntgntgcccccccttctctctcccccccntancccaaaaaccccccaaactggagctccccgcggtggcggccgctctagaactagtggatcccccgggctgcaggaattcgcacgagaccattacctagaacatcctaatcgaaaagcggctttttcctcctcctcttccaccccagactccagagctatggcgctcgccaaggtcaaggagatcgtcgccgccgctcccgtcgtcggcttaaggacgtgttactgccctttttgtgtgcaggtgcagaagttgttcccgtcgctgggagctcgttgctgggccaggtagttggactctgaaagcgacggacctgagattcatacacctcttgctgaagggactgggcaaaggaaatgtatcccaaggtttttttgcaccgcgaacaaacatcttccgccttgtgaccgatacttgtggcgactgaaaggaagggtagggaaacnnaacatttggcccccacataaattgaaggatttgtaaatgaatcaatacgggattccttgtctttgggagagagccacccccccccccttccttttaaaccctcctgattttgccagaaagtctgtccgtgggggtccgagacaccaccctgtccggtgttcacacttggctgtagtcttacccaataattcgttacgtccccggacccgcccccgggtgggtggaactcgattttacgaacagggtgcccgtgggccgggccccccgcccccgtgtgttcggcggggatgtcccccgccgcttctcacgcgcccccccccgccatataacgcccctcttgccttcggcgggcgcgccaan

SEQ ID NO: 51982 - protein, 43 aa, Zea mays
  misc_feature: Ceres CLONE 1467462-F
MALAKVKEIVAAAPVVGLRTCYCPFCVQVQKLFPSLGARCWAR

SEQ ID NO: 51983 - DNA, 689 bp, Zea mays
  misc_feature: Ceres CLONE 1467473-F
  misc_feature: Encodes the peptide sequence at SEQ ID NO. 51984
ctagaacaggtggatcccccgggctgcaggaattcgcacgagaccattacctagaacatcctaatcggaaagtctgtcacctaccctaccctgctcgacaaggcaatctgaaaatgctctccgcaatctccacctccgcaatctccacctccctactagtagtactcttcggtgcagtccgcatccccacatctgaccgactctcaaagttcacagctccaatcctggggcaagcgcacagaagcggatcaagatgtggggaggagacgggccatcggcgtcgctccagctcctcttgctggggcttcgtgctcctctacttcttcaccctcagaagactcggtgcatccgggaaggcggggggggttcgaatgaaaaccctcggcaaaaaaattccaccacgcccggttcccaggtggacctgccccgccgatccacaaagggcggggtcagtcctaccaccggggatagctccggcggtcccggcccccgcctgtcctctcccgatccaagatgtacccccagccgtgtgccgggccccctgggcacccccccatcacccaccattcccctgccctcgccccgggtccccccccactctaaccccccggtcccctgccctcttccactcggaggcacgtagtttccaccgtcgcgcccccccctaaccccccttgtatcccccaccc

SEQ ID NO: 51984 - protein, 184 aa, Zea mays
  misc_feature: Ceres CLONE 1467473-F
MLSAISTSAISTSLLVVLFGAVRIPTSDRLSKFTAPILGQAHRSGSRCGEETGHRRRSSSSCWGFVLLYFFTLRRLGASGKAGGVRMKTLGKKIPPRPVPRWTCPADPQRAGSVLPPGIAPAVPAPACPLPIQDVPPAVCRAPWAPPHHPPFPCPRPGSPPTLTPRSPALFHSEARSFHRRAPP

SEQ ID NO: 51985 - DNA, 787 bp, Zea mays
  misc_feature: Ceres CLONE 1467477-F
  misc_feature: Encodes the peptide sequence at SEQ ID NO. 51986
  misc_feature (607)..(607): n is a, c, t, g, unknown, or other
aaagctggagctcaccgcggtggcggccgctctagaactagtggatcccccgggctgcaggaattcgcacgagaccattacctagaacatcctaatcgaaaaatttcagtgtcctccctcgtctcgagaccttgccccatccagcccaacgctccgtccatcaactgaatagcttggcggtgtaaccctgtcgtgtgcgatgagcccctcgccgttggtcaccgccgcggcgtcggctgccgtggtggcgctggctgtcgccaaccgcgtgcttcacaagctcgcgcttgtgcctctcaaggcgtacccctttcttcctcgcccagcttcaccacctttcggggacctttgccctggaacttcttcgaatgcctcctaccccaaggtacccgccactgggggatgggtggaacaaagaaaaacttggtttggtggagtttccccacaaaacaacccgggttccggctccccttatcccggctttttgccttgggaaaacacaccctctttggaaaagtccccccctccccctgggcgcattgaattcttgcccctgagaaacacctttttgctcttaacaaaaggggggcccccggggcaaaaatcntccccctattaacctggggttccccccacaattttctttttgttgtggggaccaataatttttgagggtgcacaaagagtaattttttattttttttttggtctccccctcactcctcttacaacaaaaattatttttgggggggaggggttttttccccccgtgggtgacgcgccccca

SEQ ID NO: 51986 - protein, 139 aa, Zea mays
  misc_feature: Ceres CLONE 1467477-F
MSPSPLVTAAASAAVVALAVANRVLHKLALVPLKAYPFLPRPASPPFGDLCPGTSSNASYPKVPATGGWVEQRKTWFGGVSPQNNPGSGSPYPGFLPWENTPSLEKSPPPPGRIEFLPLRNTFLLLTKGGPPGQKSSPY

SEQ ID NO: 51987 - DNA, 644 bp, Zea mays
  misc_feature: Ceres CLONE 1467480-F
  misc_feature: Encodes the peptide sequence at SEQ ID NO. 51988
ctagaactagtggatcccccgggctgcaggaattcgcacgagaccattacctagaacatcctaatcgaaaaatacgatctgacgctcatcccacatcagtagtcgaccaagcacaagcagcacagccggccggaatatgtggacgatcaggaaggtggcgacgccgcaggtggccgtcctcctgctgctcctcatcgtcgttgcgcaagaggcggcgccgttggcggaggcgcgcgtgtgccggcgcctgagcgcgggcttcacgggggtctgcatgtccgaccacaactgcgcgcaggtgtgcttgcaggagggctactgcggcggcaactgcgacggcatcatgcgccagtgcaagtgcatcagggagtgctagttagttaggctctaggatctaccaagctagctatatcggcctttaattaaattaataaggatcgacgtcttggccggggcgctaaatatgtactactataccgtctacacctcatgcaataatgcaccacatgtacgccgtacccgcgcccaagctgtgtggacgccgccaccttgtattgcacggcccatccgttcttatccgttcttcccccgccctttccaaattcttcattgaattttgccccgttcacggtccacccctttct

SEQ ID NO: 51988 - protein, 79 aa, Zea mays
  misc_feature: Ceres CLONE 1467480-F
  misc_feature (33)..(79): Pfam Name: Gamma-thionin Pfam Description: Gamma-thionin family
MWTIRKVATPQVAVLLLLLIVVAQEAAPLAEARVCRRLSAGFTGVCMSDHNCAQVCLQEGYCGGNCDGIMRQCKCIREC

SEQ ID NO: 51989 - DNA, 674 bp, Zea mays
  misc_feature: Ceres CLONE 1467496-F
  misc_feature: Encodes the peptide sequence at SEQ ID NO. 51990
aagctggagctccccgcggtggcggccgctctagatctagtggatcccccgggctgcaggaattcgcacgagaccattacctagaacatcctaatcaaaacaacccaggaaacacagcaatcagcacaaaaacatctccttggccttccatccatatgatccatccctccaggctccagctaactccaaactaccctctggttcgactcgcgttcgcatcgcaagcagcagcgtaccatcgaggcaatggtggtgatggccaaagtagtgtcgaccaccggcgcggcgctccggagcccggccacgcagcagccggcggcggcgggcgcggcgaagggcaccgacgctgagaagctccagttcatcgaggacatgacctccaacgtggacgccgtgcaggagcgcgtgttaggagagagccccgcccgtaacgcggacaccgagtacctctccagcaagtgcggcctcgccggcgctacggaccgcgccaccttccgcgccaaggtgccgatggcgacgtacgaggacctgcagtcgtacatccggggcatcgccgacggcgaccgctcgcccatccttgccgggcaccccggcttccgagttcctcaccggttccgggccgtcccggggggaaacgcgaagctcatggcccaccatcgtaggacgacaccaac

SEQ ID NO: 51990 - protein, 142 aa, Zea mays
  misc_feature: Ceres CLONE 1467496-F
MVVMAKVVSTTGAALRSPATQQPAAAGAAKGTDAEKLQFIEDMTSNVDAVQERVLGESPARNADTEYLSSKCGLAGATDRATFRAKVPMATYEDLQSYIRGIADGDRSPILAGHPGFRVPHRFRAVPGGNAKLMAHHRRTTP

SEQ ID NO: 51991 - DNA, 693 bp, Zea mays
  misc_feature: Ceres CLONE 1467503-F
tcaccgcggtggcggccgctctagaactagtggatcccccgggctgcaggaattcgcacgagaccattacctagaacatcctaatcgaaaaattctttccgtcctcatcccggccattccttgcctgcccgccgcgcggactctatataagccttgtgccccatctcatcaggatcaatcaccaccatctcccatccatctcttcggatgtttgtgctacccttcccttcacctcacacaggacatactagaggataaagcagctccttcgatacatatatacttttttccggaaaaaaaaaggctgagccggtgcaaaccaagcttgaccgcttgagccacggcgagcgcttttacctcgagggcatgcgcgctgggtggctctgctaatggggctctgaacggcccccccccccccccccaggattgacaacccgcttgcaggtgacctggggcgactgctgccagaatccgtctctcccaaggccagggggcggacgctgtccctccgaccaccccttccgcctccggggttccctctccaaggaaaacgcaccctcttcatagtccccccaccttgcacaattaaggttccgccccccgcacatcttccgtctggaaaaggcccccccaccttggtaaccccaccacctcccataatcccccccgattagcccccacgggggcccctta

SEQ ID NO: 51992 - DNA, 675 bp, Zea mays
  misc_feature: Ceres CLONE 1467511-F
  misc_feature: Encodes the peptide sequence at SEQ ID NO. 51993
aagctggagctccccgcggtggcggccgctctagaactagtggatcccccgggctgcaggaattcgcacgagaccattacctagaacatcctaatcgaaaaaacggaacttagctgccgagcgcccaaagccccaccgccgctcccatcaagcggcgctaaaggtttcctcgcccgcaacgcgatgccgaagaacaagggaaagggaggcaagaaccggaagcggggcaagaacgaggcggacgacgagaagcgggagctggtgttcaaggaggacgggcaggagtacgcgcaggtgacacggatgctggacaacggccgctgcgaggcgctctgcatcgacggcaccaagcgcctctgccacatccggggcaagatgcacaagaaggtgtggatcgccgccggggacatcgtgctcgtcggcctgcgcgactaccaggacgacaaggcggacgtcatcctcaagtacatgaacgacgaggcccgcctgctcaaggccttaccgcgagatccccgacaacgtcaggctcactgagggcctctgtaataaggaggatcccggcgcgaaagatgactatttcccgtttcgaggactaaggacatcaccaagaattggatgaaccccccccttcaacacgggccccttttcatggtgaaattaaacgtatgcaaaaaa

SEQ ID NO: 51993 - protein, 116 aa, Zea mays
  misc_feature: Ceres CLONE 1467511-F
  misc_feature (30)..(94): Pfam Name: eIF-1a Pfam Description: Translation initiation factor 1A / IF-1
MPKNKGKGGKNRKRGKNEADDEKRELVFKEDGQEYAQVTRMLDNGRCEALCIDGTKRLCHIRGKMHKKVWIAAGDIVLVGLRDYQDDKADVILKYMNDEARLLKALPRDPRQRQAH

SEQ ID NO: 51994 - DNA, 817 bp, Zea mays
  misc_feature: Ceres CLONE 1467550-F
  misc_feature: Encodes the peptide sequence at SEQ ID NO. 51995
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nnnnnnccggttcttatacccccccttcaactccannnnnntttaatnnnnacaaactggagctccccgcggtggcggccgctctagaactagtggatcccccgggctgcaggaattcgcacgagaccattacctagaacatcctaatcgaaaaactcttctaggattatagtatatatataagtatacactcttctaggatcaatcgtgaggagttccttaaattgtcttgcgacatggagtacagaaagagggtggatgcgctagtgtttttctcgttacttctcctcggatactttgctgctcatgcacatgggaaggatgatgtcggtgtttctactccagctaaagaaggaattatgcaagggaaacggagcaacgatgtgtttgaaaggggttccctccatgcaaagataaccaaggggctactgctgcaatttgggggggcgaaactcatggttcgctactcctacgaatgggtgaagtgcacaacatggccttgccttcttaaaccaaaatttaagcatccgctggtttattataatacctttggcaaatcgggcagggccaaaccggctatttattgaacataacgcggaaatttctagtgttatgtgtatttgtagatataaagggggaaaaaatagtttaatttaaataccgttcgaaccttctgaggcggggggtcccgggtaacccccattttcccgccctgcaaacgggaaggccttaatcccactcgtagcccaccccggtgacggtatatttttacaaatattctccaacgccccgggtacaacacccttgggcaatttgg

SEQ ID NO: 51995 - protein, 116 aa, Zea mays
  misc_feature: Ceres CLONE 1467550-F
MEYRKRVDALVFFSLLLLGYFAAHAHGKDDVGVSTPAKEGIMQGKRSNDVFERGSLHAKITKGLLLQFGGAKLMVRYSYEWVKCTTWPCLLKPKFKHPLVYYNTFGKSGRAKPAIY

SEQ ID NO: 51996 - DNA, 754 bp, Zea mays
  misc_feature: Ceres CLONE 1467554-F
  misc_feature: Encodes the peptide sequence at SEQ ID NO. 51997
  misc_feature (13)..(13): n is a, c, t, g, unknown, or other
  misc_feature (754)..(754): n is a, c, t, g, unknown, or other
gcggggggccctnccccgccctgccattaaactacgatttgagtgattccccctccaaaagtgtgactccccgcggcggcggccgctctattcctagaggatgccccgggctgcaggaatccccacaagagcattacctagaacatcctaatcgaaaaaaaaaaaacacctcgccttttgtactcttgcgtctctgccctcgcgttatcgccttcgtcacgctcgctcgcctggctggcttgtgccttgccttgctcggcgtacgcgaacgcagcgagagggaggagcaaggaaatagagagagacagagagagagagagaaaaaatcaagtcatccccctttcctctgagctcgttccatggagaactcttctcacaagcgggcgcgggaggcgggcgacctcctcgccggcggctgcggagaggagggctcgccgcatgccgactccaagaggctgcggccgcatgacctgctcgacacgctggaggacgacaccgacgcggccgcggccggtgacctagcgtcggtcatgccgagcctggatgaggagatagccagcttccaacagatctcctgaggcgcaggcgccggtgccgggagactgggcctccccgcttgagggcccccttaatcaccaagttgggggcctgcccccccccccgtccttttttggtaagaacccaccccatgttatgtgccccccccccccgggttagtggaccccacttttacacacaggcacctcacatgttn

SEQ ID NO: 51997 - protein, 72 aa, Zea mays
  misc_feature: Ceres CLONE 1467554-F
MENSSHKRAREAGDLLAGGCGEEGSPHADSKRLRPHDLLDTLEDDTDAAAAGDLASVMPSLDEEIASFQQIS

SEQ ID NO: 51998 - DNA, 664 bp, Zea mays
  misc_feature: Ceres CLONE 1467555-F
  misc_feature: Encodes the peptide sequence at SEQ ID NO. 51999
aaagctggagctccccgcggtggcggccgctctagaactagtggatcccccgggctgcaggaattcgcacgagaccattacctagaacatcctaatcgaaaattcaaaccctcctcttcatggggcctctatcgttgctaccatactcagggacagcgagatgttcaacgaatggactctggaactgaaggccatgggtgataggatcattaacatgaggcaacaactatttaatgcgctgaaatccaaaggaacccctggtgattggatccatatcatcaactaacttgggatgttgactttcgctgaactcaacacacaacaagtcgcattagtgaggcaagcataccacatttatatgacatctgagagggatcatcagcatggcgaggctagagcatgacgactgtaccacatcttccacatgccatacgcacaccagtatctcaactgaaatgaggatcgtatcgcagctttcgtgactcagacctgagtacatcacaacattgttctaagtcactcacgcagcggtatttactgcttgacctactgtactttcgctcggaatagatatatatttttggctgccgcccgcaacctttttactagaggatgagaacggactctgaatatggcccttcccggaccttgtatactgccaaat

SEQ ID NO: 51999 - protein, 41 aa, Zea mays
  misc_feature: Ceres CLONE 1467555-F
  misc_feature: SWISSPROT Homolog: EC 2.6.1.1 Aspartate transaminase
MFNEWTLELKAMGDRIINMRQQLFNALKSKGTPGDWIHIIN

SEQ ID NO: 52000 - DNA, 648 bp, Zea mays
  misc_feature: Ceres CLONE 1467562-F
  misc_feature: Encodes the peptide sequence at SEQ ID NO. 52001
  misc_feature (25)..(25): n is a, c, t, g, unknown, or other
  misc_feature (28)..(28): n is a, c, t, g, unknown, or other
  misc_feature (235)..(235): n is a, c, t, g, unknown, or other
acccgcggtggcggccgctctaacntantggatcccccgggctgcaggaattcgcacgagaccattacctagaacatcctaatcgaaaaatccctatcttcttgctgcgttgttcgctcgcctgctgtgcctgtgcatgcagaccaggtctagcggaggcgggcgggcctggcgttccagtacggcgtgctggtgctggagctggtgacggggcagtccccgggcgccgactgcnagctcgtgcgctgggcgcaagaccccgggctccgcagcctccgtgcaccggatggtggacgccgacctcggcggcgtctacgacgcccgcgagctccgcgacctcatcgccgtcgctaggctctgcaccagggaccacagggacgagggcgctggcgtcgtcaccattccccacatcgtcaggtacctccaggggaagcctgacccgatcgggttgcaggcccagttcggatgatggtgatggttcacctgccttgcgtgcccccgcctgttggtggctttcttcttctttaaaaccctgtctgtaccatcaaatgtacaaaagcccgtggctttttcttcctggggatgccccacaatctgtttggtgtcaatccgtcgacagatggaaccaagtgagtttgctgactgcca

SEQ ID NO: 52001 - protein, 60 aa, Zea mays
  misc_feature: Ceres CLONE 1467562-F
MVDADLGGVYDARELRDLIAVARLCTRDHRDEGAGVVTIPHIVRYLQGKPDPIGLQAQFG

SEQ ID NO: 52002 - DNA, 653 bp, Zea mays
  misc_feature: Ceres CLONE 1467588-F
  misc_feature: Translation starting site: 117
  misc_feature: SWISSPROT Homolog: EC 5.1.3.3 Aldose 1-epimerase
ctgaactagtggatcccccgggctgcaggaattcgcacgagaccattaactagaacatcctaatcgaaaagctagtaaatcgagctcggaggcgaatctctcgctaactgtcatcaatggcggccgagcccaagatcctagagctctccaacggcaagatcaccgcgaggatctccaactggggcgccaccatcacctccctcctcgtccccgacgcccaggaaaggcatgtcaccttattttggctgcatagttggccgtgtctctaataggatcaaggatgggaagtttacactaaacggacttgagtattcattacctgtcaacaatggacctaaacagccttccatggtgggtatgaaagggcatttaaatatgggccatggtggaaatgtcccgcgaaacccaaaaaataggccaaatggccccttaaaaaaaactttttcccgccctatcccaaacccagggcaccggggaaaaaaaagggctctccccgccgatttaaacccattccgggagaaaaaataccttctttttccccgaaacccccccaccttttaagagcccttggaactctgaacacccttacccccccaaaaaacaaaaacccccaccttcccttaaaaaaaccttgggcgccgatccccacaccc

SEQ ID NO: 52003 - DNA, 657 bp, Zea mays
  misc_feature: Ceres CLONE 1467596-F
  misc_feature: Encodes the peptide sequence at SEQ ID NO. 52004
  misc_feature (582)..(582): n is a, c, t, g, unknown, or other
  misc_feature (632)..(632): n is a, c, t, g, unknown, or other
ccgcggtggcggccgctctagaactagtggatcccccgggctgcaggaattcgcacgagaccattacctagaacatcctaatcgtcttcccatccgtacgaactcgcagatcagagagaccgaggcgcccgcggttctgctttccttccttgccccgttcacgagagaattttctggagtcttcgactcgagcagggttccgatggcgctgcaatggatgatcctggcgtgcgtggtggcggtggaagctgcggtggctgcgctggtcacgctcccggtgccccgcgctgtgcggggccagatcgtcgcgctcacgtccttgttcctgcagcccctgtccagtgtgatacccttcgccgccttccagatcctcgatctctactggaagaaggagcacagactgatgtgcacctcggagatttgcaccgccgaagagcgcattcgcttcgagaaatctatgtttaaagctcagagaaatgtcattctttgtgtttcagcatgtctcctttattggtgcatttatcgtattgtaaaattgaacaaggatattaaggctttggaagagaccgagaagcgcctcanggaagagtagatctattgtgttttaaggttagtgattttagtggtgattncatgtgtactaggttcttgcacttt

SEQ ID NO: 52004 - protein, 129 aa, Zea mays
  misc_feature: Ceres CLONE 1467596-F
  misc_feature (127)..(127): Xaa is any aa, unknown, or other
MALQWMILACVVAVEAAVAALVTLPVPRAVRGQIVALTSLFLQPLSSVIPFAAFQILDLYWKKEHRLMCTSEICTAEERIRFEKSMFKAQRNVILCVSACLLYWCIYRIVKLNKDIKALEETEKRLXEE

SEQ ID NO: 52005 - DNA, 671 bp, Zea mays
  misc_feature: Ceres CLONE 1467599-F
  misc_feature: Encodes the peptide sequence at SEQ ID NO. 52006
  misc_feature (394)..(394): n is a, c, t, g, unknown, or other
  misc_feature (397)..(397): n is a, c, t, g, unknown, or other
  misc_feature (588)..(588): n is a, c, t, g, unknown, or other
  misc_feature (608)..(608): n is a, c, t, g, unknown, or other
  misc_feature (615)..(615): n is a, c, t, g, unknown, or other
aaaagctggagctcaccgcggtggcggccgctctagaactagtggatcccccgggctgcaggaattcgcacgagaccattacctagaacatcctaatcgaaaaagagatgggaatcacctcctcaacctccagcccaacctccagcccggaatcgagagcaatggcgctcgccaaggccaaggagatcgttgcctccgctcccctcgtcgtcttcagcaaaacttcctgccctttctgcgtccgtgtgaagcagttgttcgagaagctcggagcaagctacaaggccattgagttggataaggaaagtgatggagctgagctccataatgccctgaaggagtggactggacagaggactgtcccaaatgtcttcatcaatggggagcatattgncgnctgtgatgatactatggcactgaacaatgatgggaagctggtgcctctgctgactgaggctggagccatcgccggttctgcctcgaagacaaccatcactgcttgacatgtgtgttaccattcccgtgcttaaaaataatgatgctttgcaagtgctgaacttgcaaatgctatgtgggagtgactgttcnttccctgtgtaaaactccanacatcantccagtcctgttgctgtggtggttgggaaatctacatatccttgctacaaaatggc

SEQ ID NO: 52006 - protein, 131 aa, Zea mays
  misc_feature: Ceres CLONE 1467599-F
  misc_feature (33)..(95): Pfam Name: Glutaredoxin Pfam Description: Glutaredoxin
  misc_feature: SWISSPROT Homolog: EC 1.11.1.15 Peroxiredoxin
  misc_feature (96)..(96): Xaa is any aa, unknown, or other
  misc_feature (97)..(97): Xaa is any aa, unknown, or other
MGITSSTSSPTSSPESRAMALAKAKEIVASAPLVVFSKTSCPFCVRVKQLFEKLGASYKAIELDKESDGAELHNALKEWTGQRTVPNVFINGEHIXXCDDTMALNNDGKLVPLLTEAGAIAGSASKTTITA

SEQ ID NO: 52007 - DNA, 464 bp, Zea mays
  misc_feature: Ceres CLONE 1467604-F
  misc_feature (198)..(198): n is a, c, t, g, unknown, or other
gcggtggcggccgctctagaactagtggatcccccgggctgcaggaattcgcacgagaccattacctagaacatcctaatcgaaaaatctattttctacccctcgcctcccccataccggggcccggtaaccagcatccctcggcagccgctgccgaccgatccgtgtccgtgcgagacgcgggagggattggcgccnggaggctgaccggggatgttctcccggcgactggacgcccgcgtggcggcacctgcttgcacccaagaaaaaaacgccagccctcggggaaaatcccatgggaagggtgtttttgccaaaaagggggggaaaacgggaaaggggaaacccctgggggaaaaggggggtttagggaaaaaaagggtcccccaaaaaaaaattgctcccaaaaaaaaaaccccgggggggggtataaaaaaaaaaaaaacccccccccccgggggggg

SEQ ID NO: 52008 - DNA, 614 bp, Zea mays
  misc_feature: Ceres CLONE 1467619-F
  misc_feature: Translation starting site: 241
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (395)..(395): n is a, c, t, g, unknown, or other
  misc_feature (407)..(407): n is a, c, t, g, unknown, or other
  misc_feature (467)..(467): n is a, c, t, g, unknown, or other
  misc_feature (473)..(473): n is a, c, t, g, unknown, or other
  misc_feature (568)..(568): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctgggactccccgcggtggcggccgctctagactagtggatccccctggctgcaggaattcgcacgagaccattacctagaacatcctaatcgaaaaactttgagtcttgaagaaaggtcatcatcatcaacgtcgagaataatggcttctctttgtgcttcctctgccatcgccgccatttcttctcctagtttcttgtgtggcaagaagctaaggctgaacaagaagctgagtgttgcagctgtttcaaatcagctgcgtctgtgcgggccgttgcagcggatcccgagagaccnatctggttcccntggagcactcctccagagtgcctcgacggtagcctccctgggtgactccgatttgatccntctggntcttcatctgacccctatagtctaaaatggaacgtacaagcagagatagttcactgcccggtgggcaatgctaagtggccgccggaatttttatncccggagttccaaccaagaatcgggatccctcaaccgcccttcggg

SEQ ID NO: 52009 - DNA, 669 bp, Zea mays
  misc_feature: Ceres CLONE 1467620-F
  misc_feature: Encodes the peptide sequence at SEQ ID NO. 52010
  misc_feature (458)..(458): n is a, c, t, g, unknown, or other
aaagctggagctccccgcggtggcggccgctctagaactagtggatcccccgggctgcaggaattcgcacgagaccattacctagaacatcctaatcgaaaaatccaccacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatgggcctcatgagccccctcgcctccgccaccccaggcgcgcgtcgcgctttccctgtacggctgctgctccaggcatctgcgctcgcgccgcgccagcgcgccttgcccgtgaccgtgagggcccagagcgacgacgccgaggccgagccaaaggaggaagccgcggcggccaccaccccggcgccaaagtccaaggcggcggcgacngcaagccccgggctgtaggacgcgctggcgttcagcggcccggctcccgagcgcatcaacggccgcctcgccatggtggggcttcgtgtcggcgctccgcgtcaaggcgtcccgcggcgggggccctcctctcccaaggcggcaagcgggtccgggctccgcttggttccccgcccacggttgccgtgctggccctggacccgcctgtggc

SEQ ID NO: 52010 - protein, 80 aa, Zea mays
  misc_feature: Ceres CLONE 1467620-F
MAATVMGLMSPLASATPGARRAFPVRLLLQASALAPRQRALPVTVRAQSDDAEAEPKEEAAAATTPAPKSKAAATASPGL

SEQ ID NO: 52011 - DNA, 592 bp, Zea mays
  misc_feature: Ceres CLONE 1467621-F
  misc_feature: Encodes the peptide sequence at SEQ ID NO. 52012
  misc_feature (517)..(517): n is a, c, t, g, unknown, or other
  misc_feature (518)..(518): n is a, c, t, g, unknown, or other
  misc_feature (565)..(565): n is a, c, t, g, unknown, or other
tggagctccccgcggtggcggccgctctagaatagtggatcccccgggctgcaggaattcgcacgagaccattacctagaacatcctaatcgaaaaaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccaacaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccccggccctgccaaaatttttcatcccccaaaacttccccccatttgggggggggggcccccccccccaaaaaaaaaaaaaaaagggggcccggccgccnnttaaaaaaaaaaaaaaacaccccttttttttttttggggggcggggnccccacccccccccccccacccccaac

SEQ ID NO: 52012 - protein, 129 aa, Zea mays
  misc_feature: Ceres CLONE 1467621-F
MGAPVAYPPPAYPPGVAAGAGAYPPQLYAPPAAAAAQQAAAAQQQQLQIFWAEQYREIEATTDFKNHNLPLARIKKIMKADEDVRMIAAEAPVVFAPGPAKIFHPPKLPPIWGGGPPPPKKKKKGGPAA

SEQ ID NO: 52013 - DNA, 657 bp, Zea mays
  misc_feature: Ceres CLONE 1467624-F
  misc_feature: Encodes the peptide sequence at SEQ ID NO. 52014
  misc_feature (475)..(475): n is a, c, t, g, unknown, or other
acccgcggtggcggccgctctagaactagtggatcccccgggctgcaggaattcgcacgagaccattacctagaacatcctaatcgaaaacgaccacttccgacgggccactcgccgccgctcgcccgccctgctcttcaccccttctcccgggaccgggacaagcgatctcccctccccgtccccgtagtccgcaggagagagatttttttttctcggttgcaatgaagagttatccgtgggcgggggcccgccctcctgccgtcgtgcagctcctcctcttcctcgcccacctcgtcgaccgcggcggcgctgccggtggaggcagcaagggcagctcagtgtacccggcggctgtcgtctaccagcatcactcccgccagatctcctggaaacccagggtgttcctgtatcagcacttcctcagcgacgacgaggctaaccacctgatctccctcgcgagagcggagctcangaggtcagcggtcgccgataatatgtccggcaagagcacgctcagtgaggtccgcaccagctccggcaccttcctcaggaagggccagatcctatttgtgagggtatagagggacaaattgctgcatggacattctttccaaaagagaatgatgaagatatccaagtcctaggattaagcag

SEQ ID NO: 52014 - protein, 119 aa, Zea mays
  misc_feature: Ceres CLONE 1467624-F
  misc_feature (84)..(84): Xaa is any aa, unknown, or other
MKSYPWAGARPPAVVQLLLFLAHLVDRGGAAGGGSKGSSVYPAAVVYQHHSRQISWKPRVFLYQHFLSDDEANHLISLARAELXRSAVADNMSGKSTLSEVRTSSGTFLRKGQILFVRV

SEQ ID NO: 52015 - DNA, 650 bp, Zea mays
  misc_feature: Ceres CLONE 1467636-F
  misc_feature: Translation starting site: 217
  misc_feature (467)..(467): n is a, c, t, g, unknown, or other
aagctggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgacccactgtcatcgatgaagtgaggactggcaccctacgncagctcttccaacctgagcagctcatcagtgggaaggaggatgcagcaaacacttttgccgtggtcactacaccatgggcaagaagattgttgacctatgccttgatcgcatcaagaagcttggcgaccactgccctggtcctcaggggcttcctcggtcttcaagctggttgatggaggaag

SEQ ID NO: 52016 - DNA, 466 bp, Zea mays
  misc_feature: Ceres CLONE 1467642-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (306)..(306): n is a, c, t, g, unknown, or other
  misc_feature (311)..(311): n is a, c, t, g, unknown, or other
  misc_feature (315)..(315): n is a, c, t, g, unknown, or other
  misc_feature (382)..(382): n is a, c, t, g, unknown, or other
  misc_feature (383)..(383): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnttttnnnnnaaaagtggactccccgcggggcggccgctctagaatagtggacccccgggctgcagattcgcacgagacattacctagaacatcctaatcgaaaattccattcccacccgtccatccatcctccgaagctcctcggcagacaagcagcagcgagagaaagcaagcaaggcaaaagcagttgtgttgcttgtcggtccgtcaatggcgccaaagaaacantgtcngccngcggccgccggcgaacaacccaaagcttgccccgccttgccgaaacggccggtggggccggtacccnncgaaaaatcccccaaccccgtttcccaaaaagccccccttgttggttttgggcccctttaaaacccccggaaaaagggggggg

SEQ ID NO: 52017 - DNA, 672 bp, Zea mays
  misc_feature: Ceres CLONE 1467646-F
  misc_feature: Encodes the peptide sequence at SEQ ID NO. 52018
  misc_feature (433)..(433): n is a, c, t, g, unknown, or other
tggagctccccgcggtggcggccgctctagaactagtggatcccccgggctgcaggaattcgcacgagaccattacctagaacatcctaatcgaaaaaagcagtgacattaatcacccactctactactcgaagttactaccaccagcttgcttcatcagtagaagagagcgagaggatggcgtcaccgaagccctcgtcggcggacctgctcctcctggcggaggcggccgtgctggcgctggcgcgcgcgcacctgacgctcgacaactgcgtgaagaacaagaaggtgacggtgcagaacctgtgcggccacgacgtgacgctgacgctggagctgctggatcacagccagacgctgttcacgagtactatgagctgctcccactcagccacgctgaagtccccatgtgctggaggacggtgctcatggnggtgaccgacaccgtccaggtggactccaggtcggggtcgaccgcgggtacttctactggacccccaacgcgcagccggcccgaagcgtaccagtcctcgtccccccggaaagggctcccggatgcatggcccacatccccgccgatggctgggccattccagggcccgattgttccggagcgcccgttgggccttgcggcaactggctccaacgttcaaagaaaaagagaaaatttcg

SEQ ID NO: 52018 - protein, 85 aa, Zea mays
  misc_feature: Ceres CLONE 1467646-F
MASPKPSSADLLLLAEAAVLALARAHLTLDNCVKNKKVTVQNLCGHDVTLTLELLDHSQTLFTSTMSCSHSATLKSPCAGGRCSW

SEQ ID NO: 52019 - DNA, 651 bp, Zea mays
  misc_feature: Ceres CLONE 1467652-F
  misc_feature: Encodes the peptide sequence at SEQ ID NO. 52020
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (516)..(516): n is a, c, t, g, unknown, or other
  misc_feature (521)..(521): n is a, c, t, g, unknown, or other
  misc_feature (555)..(555): n is a, c, t, g, unknown, or other
  misc_feature (609)..(609): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttnnnnnncccaagctgggactccccgcggtggcggccgctctagactagtggatcccccgggctgcaggaattcgcacgagaccattacctagaacatcctaatcgaaaacttcctcctccgcctcctcttcctctcttttgcttttgtgttgctgttaggttcttggatagtgtgcatcggcaccagcagcagcagtagtaattcatactagtgggcggtgtgatagcagcagtgagatcgaggagaggatggaggtgttcatccacgaggactacgtgaacaagcgcaacgagctgaggagggagcagaggcgccgggaactgcaaaggctgcaggtggagagcaaccccgacgcgtcccgggaagcgctggcaagccgggagagccgaagacgccggctcagtgcctgacgccnacggncgcgtcgccgtccagcttcagatccccgactcgnagagcacgctgcattccgccgcccgcacggcggggcaggctgctggtttgcccntcggaacatccccgccttctagactgcctaaaggcgtactag

SEQ ID NO: 52020 - protein, 53 aa, Zea mays
  misc_feature: Ceres CLONE 1467652-F
MEVFIHEDYVNKRNELRREQRRRELQRLQVESNPDASREALASRESRRRRLSA

SEQ ID NO: 52021 - DNA, 660 bp, Zea mays
  misc_feature: Ceres CLONE 1467657-F
  misc_feature: Encodes the peptide sequence at SEQ ID NO. 52022
acccgcggtggcggccgctctagaactagtggatcccccgggctgcaggaattcgcacgagaccattacctagaacatcctaatcgaaaaaagctcttgaaaactgctcgtcccctccacttcaaaatctactactcaaggatggaaagctgtcatctctgtacacaacccaaggtgtggcggttgctgagctacagttctgccatcctgaggttgtcccaacgtcaaagaacttctggaagccactatgtgcatctctgcagaatctgctgaggtgcagcgtcgacatccgaatcaacctatctcctatctccggcaacggggcgggatccaaggactcgtccgtcagccttgtcatggagtcaagagaagaagaccgcgaggcacaggacccagccacctcaaactgcagaaccgtggtgtcatccgggagagactgcccttccccacccttggggcaggccaaggagagatcgtcccacatcctgaggtgcctccatggcggcgcgggtggcgacgccgtggacaccgagccgaagatcctgagctaccagaagatctccgttgtccctgcagcatccaccccaggaaacactccactgaaagccgctgccgccgctgccggagacgagtcaaaggttgatgcatggcgaggttcgt

SEQ ID NO: 52022 - protein, 101 aa, Zea mays
  misc_feature: Ceres CLONE 1467657-F
MESREEDREAQDPATSNCRTVVSSGRDCPSPPLGQAKERSSHILRCLHGGAGGDAVDTEPKILSYQKISVVPAASTPGNTPLKAAAAAAGDESKVDAWRGS

SEQ ID NO: 52023 - DNA, 438 bp, Zea mays
  misc_feature: Ceres CLONE 1467664-F
  misc_feature (235)..(235): n is a, c, t, g, unknown, or other
aagctggactccccgcggtggcggccgctctagaactagtggatcccccgggctgcggattcgcacgagaccattacctagaacatcctaatcgaaaaaggagagcactggcttgtatccctctggcctctctcgtctccagcgacggcagcgggcgagggttacgcgaggcgaagcggagtatggaacagaggcgcagcatgggcgtgatggaaaagctcagatcttgtcgtangagccgtagtccgcctctgctctcgctgattcgtctcttctcagcattgtcgggcatcctgatcctggcaacgcggaacattctcccctttctattgatgggtggagggtccccggaaaaaaaaggaaaactgcgttgtttccccgccatttgccccattttcttcccggttttttccgggcacaaatgggaaggtttcccaa

SEQ ID NO: 52024 - DNA, 690 bp, Zea mays
  misc_feature: Ceres CLONE 1467673-F
  misc_feature: Encodes the peptide sequence at SEQ ID NO. 52025
  misc_feature (547)..(547): n is a, c, t, g, unknown, or other
  misc_feature (575)..(575): n is a, c, t, g, unknown, or other
cgattgggtaccgggccccccctcgagccctgcagtggtaaagggatcaaattggcgagaggagcgagagagaacccaaacggagagagacaatcgagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactggtacggcaatggagcgtcgacgctgtgcgtgatctacaaccagacgggcggaaccctgcggtacgtcaacgactaggactggctgggctacccggggccgacgccctacccgacggagatcggcaacgggcagtgggcgtccttcctccacgtccacaagaccggcgcctcgtcggggtccatggccgctgtcgtctaccgcggcaaggacggcggcgggaacaaacgcaacatcccccatggtcctggagcacccccctgggggcccctcccanaaacaggggcttacttgcgagatcgggnaacgttcgggttcttttccggtccgggggggggaccatcctcttacaaaaaaacttccaccaagggccgggaaaccccttacccaacggcagagtggtaaccaagccctcgttcc

SEQ ID NO: 52025 - protein, 81 aa, Zea mays
  misc_feature: Ceres CLONE 1467673-F
MANCFGDVVDNYKLDTMPRYIGKKKTREDRAREASYLSNENEKYKKAKDYVNMLKDWYGNGASTLCVIYNQTGGTLRYVND

SEQ ID NO: 52026 - DNA, 685 bp, Zea mays
  misc_feature: Ceres CLONE 1467677-F
  misc_feature: Encodes the peptide sequence at SEQ ID NO. 52027
  misc_feature (370)..(370): n is a, c, t, g, unknown, or other
cgattgggtaccgggccccccctcgagccctgcagtggtaaaggggcgagaggccgccatggcgtccatcatcgtcatcgccgccgtgctcgtcctggacgtcctcgccttcgtgctcgccatcggcgccgagcgccgccggagctacgtgaactacgtgagcgtggacccggccggggggtcctactgcgtgtacagctccgacgcgtccacggcgtacggcgtgagcgcgctgctgctgctgctcgccgcgcaggccgtggccatggtcgccacccgctgcttctgctgcggccgcgcgctctcgccgggccgctggcgggcgtggtccggcatctgcttcatcctctgctgggtgacgttcgtgatncgcgagctgtgcctgctggccgggtcggtccggaacccctatcaaccaagtacttccccaagggcgacgccccgccccctggcccttgctggccaaggggggttttctccgcgggggccccttttcctttcttaccggggtttttccgaagtgtttttacctttttccccccggggggggaaacccccccccccccggggccccccctttttgggggggttcggtttcccccccttgggtgggggagaaaattcccccggggggtggaaacccggggggggggggggttttttttttctcttatccccccccccc

SEQ ID NO: 52027 - protein, 209 aa, Zea mays
  misc_feature: Ceres CLONE 1467677-F
  misc_feature (44)..(157): Pfam Name: DUF1218 Pfam Description: Protein of unknown function (DUF1218)
  misc_feature (104)..(104): Xaa is any aa, unknown, or other
MASIIVIAAVLVLDVLAFVLAIGAERRRSYVNYVSVDPAGGSYCVYSSDASTAYGVSALLLLLAAQAVAMVATRCFCCGRALSPGRWRAWSGICFILCWVTFVXRELCLLAGSVRNPYQPSTSPRATPRPLALAGQGGFSPRGPLFLSYRGFSEVFLPFSPRGGKPPPPRGPPFLGGFGFPPLGGGENSPGGWKPGGGGGFFFLLSPPP

SEQ ID NO: 52028 - DNA, 665 bp, Zea mays
  misc_feature: Ceres CLONE 1467678-F
  misc_feature: Encodes the peptide sequence at SEQ ID NO. 52029
  misc_feature (644)..(644): n is a, c, t, g, unknown, or other
  misc_feature (665)..(665): n is a, c, t, g, unknown, or other
cgattgggtaccgggccccccctcgagccctgcagtggtaaaggaaactaagcgacccaatccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgactactatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacgaggcgccccgtgctccccaccgatggtctcttcgacgatttcgactggaggggacacggtgccgtcggccccgtcaagaaccaggttcgtgcgggtcgtgctggtcgttcatcgcgtctggatcgctgtagggtgcgcactacctcgcaactggtaagctgggagtgctttcngagcagcacttcgtcgactgn

SEQ ID NO: 52029 - protein, 170 aa, Zea mays
  misc_feature: Ceres CLONE 1467678-F
  misc_feature (48)..(104): Pfam Name: Inhibitor_I29 Pfam Description: Cathepsin propeptide inhibitor domain (I29)
  misc_feature: SWISSPROT Homolog: EC 3.4.22.41 Cathepsin F
MAHRVLLLLSLASAAAVAAAVDAEDPLIRQVVPGGDDYYLELNAESHFLSFVQRFGKSYKDADEHAYRLSVFKANLRRARRHQLLDPSAEHGVTKFSDLTPAEFRRTYLGLRKSRRALLRELGESAHEAPRAPHRWSLRRFRLEGTRCRRPRQEPGSCGSCWSFIASGSL

SEQ ID NO: 52030 - DNA, 640 bp, Zea mays
  misc_feature: Ceres CLONE 1467681-F
  misc_feature: Encodes the peptide sequence at SEQ ID NO. 52031
cgattgggtacgggccccccctcgagcatggcatgggtaaaggggtgctctgctgcaactgatgccctgcctgccttttcttctctcgtccccctaggtctgagtctctgttcgatttcgtgaggagctactaagggaccgtttcgcaacgccctacgacaacgtagtgccatgccgccttcggccggttcttcttccccatcgccggcgtccagtgacccaccaagttcatacatggcccagaccgtgtttcctctgctcgttggacgggatgatgcatgtcatcgtccagatcggagtcattctcatgagcccttcctgtgatgtctgctacatatcttcggtgtcctggatactttgaaactgctatggcgattgctcgaatgatatggtcggcatatcatacgctggaagaatatcatcttcgatccatcgagtatgatgcttgtacgtagggtcaggaagatttcacacacgagcgcgaagtgatctactgatgtcagatggtcttatgtggttcacgagatccatgcatttccttggagactcgatcggtaccctgattgagcatccatactggaccatgacgcacgcttgcactgattcgtacgcctggaccctgaacacatttcgtggctgc

SEQ ID NO: 52031 - protein, 48 aa, Zea mays
  misc_feature: Ceres CLONE 1467681-F
MSDGLMWFTRSMHFLGDSIGTLIEHPYWTMTHACTDSYAWTLNTFRGC

SEQ ID NO: 52032 - DNA, 618 bp, Zea mays
  misc_feature: Ceres CLONE 1467683-F
  misc_feature: Encodes the peptide sequence at SEQ ID NO. 52033
tcgagccctgttttggtaaaggctgccataaccattccttttacaccacctcgcctgcgatcttcgtaccctccgtcgcgtcgagcatacatcatgtcggcctactgcggaaagtacaacgatgagctcatcaagaatgctgcctacattggcacccctggcaagggtatccttgctgctgatgactccactggcaccattggcaagcgcctttccagcatcaatgtccacaacgttgaggacaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgatgctgttggcactgataaggagaccaccacccaaggtcatgacgaccttggcaagcgctgctccaagtactacgaggccggtgcccgctttgccaagtggcgcgctgttctcaagattggccccaatgagccatcacagcttgccatcgacctgaacgctcagggtctggctcgctatgccatcatctgccaggaa

SEQ ID NO: 52033 - protein, 175 aa, Zea mays
  misc_feature: Ceres CLONE 1467683-F
  misc_feature (11)..(175): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYNDELIKNAAYIGTPGKGILAADDSTGTIGKRLSSINVHNVEDNRRALRELLFCCPGALQYISGVILFEETLYQKTKDGKPFVDVLKEGGVLPGIKVDKGTIDAVGTDKETTTQGHDDLGKRCSKYYEAGARFAKWRAVLKIGPNEPSQLAIDLNAQGLARYAIICQE

SEQ ID NO: 52034 - DNA, 644 bp, Zea mays
  misc_feature: Ceres CLONE 1467689-F
  misc_feature: Encodes the peptide sequence at SEQ ID NO. 52035
caattgggtaccgggccccccctcgagccactgcagtggtaaaggatagccagcgcctaccccggaaaggtggaaacccatcgcatctaatccccaaccccaaacctccgatccacccatcccctcctcatccactccgggcggccatggcctgctccttcgacgccgcgaccgacgtctcttccgcccccaccccggccgccaggcccctcgccgctgccccgcagtccgtctctgtttcccgctccgcgatcgccaccgccaccaggacgctccgcctcggcacctccagatccgcgcgggccatcatactcatcgcccgcgccggcggcgtcgatgacttgccgctggtcgggaacaatgcgccagacttcagagccgaggccgtgttcgaccaagaattcatcaacgtgaagctctctgattacatcgggaagagatacgtcgtactgttcttctaccccttggatatcgcctttgactgcccgacctatattactgccttcggtgacagatctgacgacttcgagaagttgaactctgaggctcttgatgtctctatagagagcgtgatctcccaccttgcatgggtgcagaagacaggactactggtggccttgtcgatctaaatacgcactcatttc

SEQ ID NO: 52035 - protein, 160 aa, Zea mays
  misc_feature: Ceres CLONE 1467689-F
  misc_feature (69)..(159): Pfam Name: AhpC-TSA Pfam Description: AhpC/TSA family
  misc_feature: SWISSPROT Homolog: EC 1.11.1.15 Peroxiredoxin
MACSFDAATDVSSAPTPAARPLAAAPQSVSVSRSAIATATRTLRLGTSRSARAIILIARAGGVDDLPLVGNNAPDFRAEAVFDQEFINVKLSDYIGKRYVVLFFYPLDIAFDCPTYITAFGDRSDDFEKLNSEALDVSIESVISHLAWVQKTGLLVALSI

SEQ ID NO: 52036 - DNA, 680 bp, Zea mays
  misc_feature: Ceres CLONE 1467691-F
  misc_feature: Encodes the peptide sequence at SEQ ID NO. 52037
cgattgggtaccgggccccccctcgagccctgcagtggtaaaggagcctatcttgtgatcctccctcagccgcgtcacgtcgcatcctactaggctcagctctctctggtcgccggtcgcatgcttggctaagaactactcgaccgtgagcgccgagtacactcaggctgtggacaaggccaggagcaagctcctagccctcatcgccgagaagagatgcgccccgctcatgctccgcctcgcgtggcactccgcggggacgttccacgtgtcttcgaggaccggcggaccattcggcacgatgaagcatcagtcggaattggctcacggggctaacgcggggctggacatcgcggtgcggctgctccagcccgtcaaggaggagtttgcaatcttctcttacgccgatttccaccacctcgcggaagttgtggacggggacgtcaccggtgggcctgagattcccttcccccccggtagggaggaaaagcctcagcccccacctgagggcccgccttccttgaagccacttgggggtttctgaacaccctgaggtaaggttttctggcaagccagatggtgtttggagcgatccagaacattggttgcccctcctctgggcgggcccccaccctttgggtaagggtgcccccccaaacaacggcccctggggttaccaa

SEQ ID NO: 52037 - protein, 104 aa, Zea mays
  misc_feature: Ceres CLONE 1467691-F
  misc_feature: SWISSPROT Homolog: EC 1.11.1.11 L-ascorbate peroxidase
MLRLAWHSAGTFHVSSRTGGPFGTMKHQSELAHGANAGLDIAVRLLQPVKEEFAIFSYADFHHLAEVVDGDVTGGPEIPFPPGREEKPQPPPEGPPSLKPLGGF

SEQ ID NO: 52038 - DNA, 665 bp, Zea mays
  misc_feature: Ceres CLONE 1467708-F
  misc_feature: Encodes the peptide sequence at SEQ ID NO. 52039
  misc_feature (487)..(487): n is a, c, t, g, unknown, or other
cgattgggtaccgggccccccctcgagccactgcagtggtaaaggtcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggngaggccatcaagcactcgctggggcagtcccacccggtgcgcctggtgccctacaacccggactttttggaccattcggggctgtggacggagagccccaacttcggcaaccgcttccgctgcgtccgcagggtcaaaaacatctacctcaactttcaacgccctccccggcgacaag

SEQ ID NO: 52039 - protein, 175 aa, Zea mays
  misc_feature: Ceres CLONE 1467708-F
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNKATGEAIKHSLGQSHPVRLVPYNPDFLDHSGLWTESPNFGNRFRCVRRVKNIYLNFQRPPRRQ

SEQ ID NO: 52040 - DNA, 649 bp, Zea mays
  misc_feature: Ceres CLONE 1467711-F
  misc_feature: Encodes the peptide sequence at SEQ ID NO. 52041
cgattgggtacgggccccccctcgagccctgcagtggtaaaggggtcccccattccgatccgatccccggtgggccacctaccaccggtcagccccatcaaactctgatgcaccgacagccatcacgactccctcgtcaatctccccgccgccgccgatgctaataccataatggacgacgacgccgcctctgctgccactgccatctaccctctgcaccgatgcaaaatcatactgctggtgaggcatgcccaacgggtccacaacgtggaaggcgacacggatcacagcgcctacatgaaacccgacttcttcgacgcgcgcatctctcccttggactggaacccacttgacctcctgcgaaagcattcgaaggaatctgcgcttgcaaaaaagattgagctgattatttcttctcctttgtcgagaaccatgcagactgtctcgagtactctttggtgtgcaaagctgctctaatgacgtgaatgtgcctcatctgagggtggacaatgctggacatccggcagtatcaagtctgaactgcccactatttcttgctgttgacgcctgatgcagcagcttgactgtccatccctgcgagaccatgagagcatcacacatcagcgtgctctcattcctgacattgatt

SEQ ID NO: 52041 - protein, 101 aa, Zea mays
  misc_feature: Ceres CLONE 1467711-F
MDDDAASAATAIYPLHRCKIILLVRHAQRVHNVEGDTDHSAYMKPDFFDARISPLDWNPLDLLRKHSKESALAKKIELIISSPLSRTMQTVSSTLWCAKLL

SEQ ID NO: 52042 - DNA, 657 bp, Zea mays
  misc_feature: Ceres CLONE 1467714-F
  misc_feature: Encodes the peptide sequence at SEQ ID NO. 52043
cgattgggaccgggcccccctcgagccctgcagtggtaaaaggggtccggtggcggcgcgacgtcgtcccggtggccgaaggcggaggttcacgcgctgatacagctgcggagcacccttgacacgcggtaccaggagaccgggcccaaagggcccctctgggaggagatctccgccggcatgcggggcatgggttacaaccggaacgcgaagcggtgcaaggagaagtgggagaacatcaacaagtacttcaagaaggtgaaggagagcaacaagaagcgtcccgaggactccaagacgtgcccctacttccaccagctcgacgcactctaccgcaacaaggcggcgatcacctcatcctccggcgccggagccatggtgcacgctaacgcatcgtcggcaccgcaggagatggtcacggtcacggccgcgacgcccatctcacagacgccgccgcctccaacacagccttcccagtcccatcacgcggcgaagaacggcggcagcagcaactccgctggcacaggcactgggaacggcagctacgcatcagagcacggctccaggggcatgcaaacgcaggcgagcaacggcagcgctgcagccagcatgttcgtcggcctcggcggcggcgcggcctcggcagcgaagaagcaa

SEQ ID NO: 52043 - protein, 159 aa, Zea mays
  misc_feature: Ceres CLONE 1467714-F
MRGMGYNRNAKRCKEKWENINKYFKKVKESNKKRPEDSKTCPYFHQLDALYRNKAAITSSSGAGAMVHANASSAPQEMVTVTAATPISQTPPPPTQPSQSHHAAKNGGSSNSAGTGTGNGSYASEHGSRGMQTQASNGSAAASMFVGLGGGAASAAKKQ

SEQ ID NO: 52044 - DNA, 709 bp, Zea mays
  misc_feature: Ceres CLONE 1467734-F
  misc_feature: Encodes the peptide sequence at SEQ ID NO. 52045
aaagctggagctccccgcggtggcggccgctctagaactagtggatcccccgggctgcaggaattcgcacgagaccattacctagaacatcctaatcgaaaaagagatcgtttcagcagccctgctgaggatccatggcacacaagtcgcggagatgcctttcgcaggcacgctgccagcttaccggaaacaaggaatgatgcgtcgcctggtcagtgctgtggagcaggtgctggcgtcagtgcaagtggagaagctggtgatacctgccatagattctctggtggacacatggaagaggtccttcttcttcaggcccgtggatccccagctgagggaggagctcaagaggctgagcctggtggtgatcaccggcaccaccctgctccacaaacccatcgttccgctgccgccgccacgtccaccgtcgccccaacaagcggggagtccagaggcatggtggcgcaagtacgcggacccgtcggcgcgcctgaccgacgacgagcgggcgttcctggagatggacgtcgacacggcgccgcccttccgctacaccgacctggtcacaggcaacgtgtctctgcacaggttctgtcaagccgggagctcgtcgtcggcctgcgccgctgccgtgtccacagggagagcgagcggcagcgctgcaccgcctccgggtccgggagcatttgcggtgcagccgggcggctgg

SEQ ID NO: 52045 - protein, 185 aa, Zea mays
  misc_feature: Ceres CLONE 1467734-F
MPFAGTLPAYRKQGMMRRLVSAVEQVLASVQVEKLVIPAIDSLVDTWKRSFFFRPVDPQLREELKRLSLVVITGTTLLHKPIVPLPPPRPPSPQQAGSPEAWWRKYADPSARLTDDERAFLEMDVDTAPPFRYTDLVTGNVSLHRFCQAGSSSSACAAAVSTGRASGSAAPPPGPGAFAVQPGGW

SEQ ID NO: 52046 - DNA, 752 bp, Zea mays
  misc_feature: Ceres CLONE 1467739-F
  misc_feature: Encodes the peptide sequence at SEQ ID NO. 52047
  misc_feature (313)..(313): n is a, c, t, g, unknown, or other
aagctggagctccccgcggtggcggccgctctataactagtggatcccccgggctgcaggaattcgcacgagaccattacctagaacatcctaatcgaaaaatccccctgtgctctcctctcgtggccttgtttcctggcggcgacggctggtcgagcggcgccgcccttggctaggtcttcgctgggtccttccccggcgacgagcgtccatctggggtcgactgaactgagcaggcagtaggaagagacactatgttgttcttctcctacttcaaggagctggtggggaaggaggtgacagtggagctcangaatgacttggcgatcccgcggacgctccactcggttgaccagtacctcaacatcaggctcgagaacacccgcgtattcaaccaggaccagtacccccccatgctttcagtgcgggaattgctctctcgggggctcgtggggggggaacggggcgctccccgcgggggggggggggaatttgaatttcttcccaaagcccccccggaaggaggggccccgaaaattttaccttgggccccccccccccccccacccgggtaggggggggtttcccccccatgtggaaaaaactgcgtgtgggggggggggggaaaacaaaccccccccttttttcttttgggggggggcgcgaaaaaaaatcccccgggggggaaagcccccccccccccctttttttttctctctcccttaaaaaaaaaaaaatatttttcttcccct

SEQ ID NO: 52047 - protein, 106 aa, Zea mays
  misc_feature: Ceres CLONE 1467739-F
  misc_feature (20)..(20): Xaa is any aa, unknown, or other
MLFFSYFKELVGKEVTVELXNDLAIPRTLHSVDQYLNIRLENTRVFNQDQYPPMLSVRELLSRGLVGGERGAPRGGGGEFEFLPKAPPEGGAPKILPWAPPPPPPG

SEQ ID NO: 52048 - DNA, 711 bp, Zea mays
  misc_feature: Ceres CLONE 1467746-F
  misc_feature: Encodes the peptide sequence at SEQ ID NO. 52049
caaagctggagctccccgcggtggcggccgctctagaactagtggatcccccgggctgcaggaattcgcacgagaccattacctagaacatcctaatcgaaaaatccagcatacgatctgacgctcatcccacatcagtagtcgaccaagcacaagcagcagagccggccggaatatgtggacgatcaggaaggtggcgacgccgcaggtggccgtcctcctgctgctcctcatcgtcgttgcgcaggaggcggcgccgttggcggaggcgcgcgtgtgccggcgccggagcgcgggcttcaagggggtctgcatgtccgaccacaactgcgcgcaggtgtgcttgcaggagggctacggcggcggcaactgcgacggcatcatgcgccagtggcagtgcatcagggagtgctagctagctaggctctaggatctagcaagctagctatatcgggcctttaattaaattataaggatccacgtcgtggcccggtcgctaaatatgtactacttattcgtctaccctacttgcaaaaaggcccccaatgttacccctacccccgccccaatttgtggggaaccccaaattaaaatgccgggccatcgttccaaaaactccccccctggtcttttaaaaaaccctggaaacgggggttccaaaacccccccggggttccggcgccccccccttttagaaggggcccagaaccc

SEQ ID NO: 52049 - protein, 79 aa, Zea mays
  misc_feature: Ceres CLONE 1467746-F
  misc_feature (33)..(79): Pfam Name: Gamma-thionin Pfam Description: Gamma-thionin family
MWTIRKVATPQVAVLLLLLIVVAQEAAPLAEARVCRRRSAGFKGVCMSDHNCAQVCLQEGYGGGNCDGIMRQWQCIREC

SEQ ID NO: 52050 - DNA, 667 bp, Zea mays
  misc_feature: Ceres CLONE 1467760-F
  misc_feature: Encodes the peptide sequence at SEQ ID NO. 52051
aagctggagctccccgcggtggcggccgctctagaactagtggatcccccgggctgcaggaattcgcacgagaccattacctagaacatcctaatcgaaaaaccgaagaagaggacgcggcaccatggcgacggcacaggcagcgtcggcgtccccaacccaccaccgcgcgtctccagggatgtcgccgccgcagccgccgtaccccagcgccgccaggatcgccgactccgcctgcttcccccagtacaccgcctcgctcaagtgtatggaggccaaccaagacaagaccaagtgccagcagcagttcgacgattacaaggaatgcaagaagaaagagagggaggctcggctggaacggaataaaaccagatcactctttgggtgaacaatggcgtcccacctgagcaatatgctggcggtgcaataagtctcctgctgatgtgagcgaaatcacgggctttttctttgtttcatgatgatcctctgcaacttgtgcaaggtagggaatagaaataccgatctcaagattgagagagatgtaaggccgtctgggaacagctcattaacacatggctacggtgaaatgatcgaatgagcgaggatgtattttgagaacaacaggcgtcatgaaacgacagtttggtcaataaaattgtttcccccc

SEQ ID NO: 52051 - protein, 87 aa, Zea mays
  misc_feature: Ceres CLONE 1467760-F
  misc_feature (31)..(71): Pfam Name: CHCH Pfam Description: CHCH domain
MATAQAASASPTHHRASPGMSPPQPPYPSAARIADSACFPQYTASLKCMEANQDKTKCQQQFDDYKECKKKEREARLERNKTRSLFG

SEQ ID NO: 52052 - DNA, 758 bp, Zea mays
  misc_feature: Ceres CLONE 1467762-F
  misc_feature: Encodes the peptide sequence at SEQ ID NO. 52053
  misc_feature (416)..(416): n is a, c, t, g, unknown, or other
aaactggagctccccgcggtggcggccgctctagaactagtggatcccccgggctgcaggaattcgcacgagaccattacctagaacatcctaatcgaaaaatacgccgccatcttcgcaagccaccgcaaccgaagcccgccttcgccgccgccgcctctgcgatccccgaaaggtcgcaaacatgtctaccgtgctccagcgcccgacccccggtacggtccagtgcttccgccgcaagaagacagctgtggccgtcacctacagcaggccggggcgcgtgctgatttgccccaacgggggaccgaatcgacctcatcaggcctcgagatactcccgcctaaagacctctcaaaccattcgtggctgtaaagccccccccccggaggcgggggggggggagtccaaccaccccnctttcccaccccccccgcgtaaaacctccaacacaacaaaaaccaccccatcctgaaccgtgacgcgcagggagtcacaccaccgagacaccctgcacacaagccctcgcaccaacgaccgcccattctctcatccccacccgttaactccctcccgcctctggtcctcgctccccctccttttctcctcataaccaaaccctttgcccggtcgccaaccgccacaaatgctgtatacacaccccccggacagccctccctcggtccactcagccttctccaccccgtccttaactccactctcccccacccacccttaccaccgcaacgcccgatcatgca

SEQ ID NO: 52053 - protein, 95 aa, Zea mays
  misc_feature: Ceres CLONE 1467762-F
  misc_feature (78)..(78): Xaa is any aa, unknown, or other
MSTVLQRPTPGTVQCFRRKKTAVAVTYSRPGRVLICPNGGPNRPHQASRYSRLKTSQTIRGCKAPPPEAGGGESNHPXFPPPPRKTSNTTKTTPS

SEQ ID NO: 52054 - DNA, 685 bp, Zea mays
  misc_feature: Ceres CLONE 1467764-F
  misc_feature: Encodes the peptide sequence at SEQ ID NO. 52055
  misc_feature (301)..(301): n is a, c, t, g, unknown, or other
  misc_feature (357)..(357): n is a, c, t, g, unknown, or other
  misc_feature (436)..(436): n is a, c, t, g, unknown, or other
tggagctccccgcggtggcggccgctctagaactagtggatcccccgggctgcaggaattcgcacgagaccattacctagaacatcctaatcgaaaatccgaccctagggtttccatccggctcttccggaagcttccgaaaatggccaccgacgagctcgcccacgccgtcgcccccgccccggccgggggcgaccactccccggccttctcgttcagcatctggccgccgacgcagcgcacgcgggacgcggtggtgcggcgcctcgtggagacgctcgcgggggacaccatcctctgncagcgctacggcgcggtgccggccgccgacgccgagcccgcggcgcgcgccatcgnaggcgaggccttcgacgccgcggcctcacggggaggcgccgcgcccccctcggtggaagaggggatcgagggcctgcanttctactccaaggaaggggagccccgccctcccgatttcgtaaagtcccgcgtcccggaaccccaaggcggtaaacccccctccgaaagaggcccggggcccctgggccccccaagagcaaaggcccccacccccggggggtgggacccggaaaaacctttcctcccgtttttaatttcccccgcccccggggggggggttggggccaaattttttaaaaattaaaactttttgtgttgtgcccacctt

SEQ ID NO: 52055 - protein, 172 aa, Zea mays
  misc_feature: Ceres CLONE 1467764-F
  misc_feature (53)..(53): Xaa is any aa, unknown, or other
  misc_feature (72)..(72): Xaa is any aa, unknown, or other
  misc_feature (98)..(98): Xaa is any aa, unknown, or other
MATDELAHAVAPAPAGGDHSPAFSFSIWPPTQRTRDAVVRRLVETLAGDTILXQRYGAVPAADAEPAARAIXGEAFDAAASRGGAAPPSVEEGIEGLXFYSKEGEPRPPDFVKSRVPEPQGGKPPSERGPGPLGPPRAKAPTPGGWDPEKPFLPFLISPAPGGGVGAKFFKN

SEQ ID NO: 52056 - DNA, 663 bp, Zea mays
  misc_feature: Ceres CLONE 1467765-F
  misc_feature: Encodes the peptide sequence at SEQ ID NO. 52057
aaagctggagctccccgcggtggcggccgctctagaactagtggatcccccgggctgcaggaattcgcacgagaccattacctagaacatcctaatcgaaaaacaccagaaaagcttttctgcctcctctccaccttgcttcccgcaactaccacgcacgccgaatacttggcaagaagaaaccctttctcgtcccgttgaactggcgccgtcgactccaccggggcacgctgtcgcgggttgctctccggtcctcgttctccttgctgctgaatccgctagtggagatcgacctgatttctcctgtcctgtcaattggattttagcccggctttcaaggtagagaaagaagctgtctggtccatcacgcccttcccaagggggggtggggtttttgttgacaaaaaccaacacataaatagaggtaagagggctgctggatcaaggaccaaagggctgaacccgtcggaaaatcctgggaatctaaagaggagagctcttcgggatttgtccaactttgccaaggaacaggtttgaagggcacttcccccttaaaaaagaggccccaccccagggttttaattatgggaccaaccctttttaaaggcccggctttaaagaaaggcccctcaagaaaaaaaattccaccccaaaaccaaagcg

SEQ ID NO: 52057 - protein, 66 aa, Zea mays
  misc_feature: Ceres CLONE 1467765-F
KAGAPRGGGRSRTSGSPGLQEFARDHYLEHPNRKTPEKLFCLLSTLLPATTTHAEYLARRNPFSSR

SEQ ID NO: 52058 - DNA, 697 bp, Zea mays
  misc_feature: Ceres CLONE 1467777-F
  misc_feature: Encodes the peptide sequence at SEQ ID NO. 52059
ctggagctccccgcggtggcggccgctctagaactagtggatcccccgggctgcaggaattcgcacgagaccattacctagaacatcctaatcgaaaaataaaggcattctcctcgcgccccacccggcggttatcttcaccaccatatcgacatcgacgccagcgagccaaggacagaacagccggcgcccggccctaaaactgccgtgcagcgagagagaagcgagggaaagatggaccggtaccagagagtggagaagcagggggaggaggcacccatcaaggaaaacgagatccgcattaccacgcaggggaggatgcgcaactacatcacctacgccaccggcttgcttcaggacaaaggttctgatgaggttgtattcaaggccatggggagggctatcaataagactgtcatggttgtggaattgatcaagaggaggattgttggcctccatcagaataccaccactggatctactgatattactgatatgtgggagccattggaggaaggcctacttccgtaagtgacttgtttctattccaggatagaactataactgcatatgaacctgtaattttggaagtcaagattatatctctctgcaggcttgagacacaagacatgtctctatgatcactataactctttcaaagaggagctggacacatcatctatcgggtatgcatact

SEQ ID NO: 52059 - protein, 98 aa, Zea mays; identical to SEQ ID NO: 48370
  misc_feature: Ceres CLONE 1467777-F
  misc_feature (17)..(87): Pfam Name: Alba Pfam Description: Alba
  misc_feature: SWISSPROT Homolog: EC 3.1.26.5 Ribonuclease P

SEQ ID NO: 52060 - DNA, 697 bp, Zea mays
  misc_feature: Ceres CLONE 1467779-F
tggagctccccgcggtggcggccgctctagaactagtggatcccccgggctgcaggaattcgcacgagaccattacctagaacatcctaatcgaaaaactcgaagaaaccctatcacaccgctggaggcctccgccgccgccgccgccttcctctgtctccttccttctccgattgcaggatgaacttcgtcggtgcctagctgattgcttacgtctctggtcaacgccaacccctgctgtagaggacctgcacctgcattgcgttgaccttgtggctgagaaatccacaatgaccaagatggaactcatgctgccccatgtgaagggaaaggacttcgctgagctcttggctcgctggtagggataatctttgctgccccaccatctggtggggacgtcggtgtggttgtcccctccgatgatcctgtggctggtagcgctgctgctcctgcgccttactcaaacatccatcaggaggtcgtgcgacaatcgcatgagatgatgatgacctgggcttccgtctgtcccactggatccagcggcatctcgtgtctgcagggtttatccgtgctcggcaaactctagtccatgatgtatgagcctgtgttccgcttagtcgagaagcgctgctcacaccatgattggactcgcaatccagcccctggtttgctggctgatttactggtcgagccctac

SEQ ID NO: 52061 - DNA, 695 bp, Zea mays
  misc_feature: Ceres CLONE 1467780
  misc_feature: Encodes the peptide sequence at SEQ ID NO. 52062
cacttctagagtttagctatagcctcactgctagagcgccgccatggctcaggtaaggggcagtgctcgtggcactggcagtggcagcagcgccgccgcgctggcgctggtcctcctgtgcgcgctcctccgcggcgagttcgccgagtcggcggtgtacacggtcggcgaccgcggcgggtggagcttcaacaccgccagctggcccaacggcaagcgtttccgcgccggcgacgtcctcgtgttcaggtacgacgccagggcgcacaacgtggtgcccgtgagcgcggcggggtacagctcgtgcagcgcgcccgagggcgccagggcgctcgccaccgggaacgaccgcgtcacgctgaggcgcggcgccaactacttcatctgcagcttcccaggccactgccaggccggcatgaaggtcgccgtcaccgccgcctaggcactgcagggcggccaatcagccggcggagagcgccgcgctcacggagtagtaaagcacgtagctaattagacggtgctgcccttgttgttcaataatatcgtctgtcgtcccgtacttcataacctgcgcggcgtgttagtagttgtttggtggtgtttggcgactggcactataaagaagggtcagatcgagtgatgtacttgctaccaataaaggtatacggtttgtgtgttcaaaaaaaaaaaaaaaa

SEQ ID NO: 52062 - protein, 132 aa, Zea mays
  misc_feature: Ceres CLONE 1467780
  misc_feature (47)..(125): Pfam Name: Cu_bind_like Pfam Description: Plastocyanin-like domain
MAQVRGSARGTGSGSSAAALALVLLCALLRGEFAESAVYTVGDRGGWSFNTASWPNGKRFRAGDVLVFRYDARAHNVVPVSAAGYSSCSAPEGARALATGNDRVTLRRGANYFICSFPGHCQAGMKVAVTAA

SEQ ID NO: 52063 - DNA, 671 bp, Zea mays
  misc_feature: Ceres CLONE 1467784-F
  misc_feature: Encodes the peptide sequence at SEQ ID NO. 52064
  misc_feature (554)..(554): n is a, c, t, g, unknown, or other
  misc_feature (600)..(600): n is a, c, t, g, unknown, or other
ggagctccccgcggtggcggccgctctagaactagtggatcccccgggctgcaggaattcgcacgagaccattacctagaacatcctaatcgaaaagtgtcgagcaggagagagcgcgatggggaagatgcggcagctgatctgcctcgtggccgccgtcgccgccgcggccatcctcctgacagcgtcggccaagaagtccggcgacgtcaccgagcttcagatcggcgtcaagtacaagcctgagtcatgtacgctgcaagcacacaaaggagacaaaattaaggttcactatcgtgggacactgactgatggatcagttttcgattctagctatgacagaggtgacccgtttgaattcacccttggaaatggccaagtgataaaaggttgggaccaaggattgctcggtatgtgcgtgggtgaaaagaggaagctaaagatacctgcaaagatgggttatggtgagcgaggctcccccacaaagattccaggtgggagcactctgatcttccacacggagcttatcgcccgtcacgggaagacatcccgcngtgcaaaagcagagagtgatagtgagctctgattacatgccttggnagagtccaaagctcgagaggagtagtagcagcgtccccatagttcattaggtggaagggggtgctgtttcc

SEQ ID NO: 52064 - protein, 155 aa, Zea mays
  misc_feature: Ceres CLONE 1467784-F
  misc_feature (43)..(137): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature (146)..(146): Xaa is any aa, unknown, or other
MGKMRQLICLVAAVAAAAILLTASAKKSGDVTELQIGVKYKPESCTLQAHKGDKIKVHYRGTLTDGSVFDSSYDRGDPFEFTLGNGQVIKGWDQGLLGMCVGEKRKLKIPAKMGYGERGSPTKIPGGSTLIFHTELIARHGKTSRXAKAESDSEL

SEQ ID NO: 52065 - DNA, 655 bp, Zea mays
  misc_feature: Ceres CLONE 1467785-F
  misc_feature: Encodes the peptide sequence at SEQ ID NO. 52066
  misc_feature (367)..(367): n is a, c, t, g, unknown, or other
  misc_feature (375)..(375): n is a, c, t, g, unknown, or other
  misc_feature (512)..(512): n is a, c, t, g, unknown, or other
tccccgcggtggcggccgctctagaactagtggatcccccgggctgcaggaattcgcacgagaccattacctagaacatcctaatcgaaaagaagcgaagcctccctgactacagagaaccggaggactgaggaggaggaggagacgtcacgcctgcgcggctgcgcccaccatggacgaggaggagttccggcgcatgctcgacctcttcccggtcgtccgctcccgagactactgctgctccgatcttggaacatccagcagaggaaccagacagcgatcacgagttcaggagggcactaagggcgataataaggactcgtccggtggacgagatatgtttatgcagaaattgaagatggctgcngagaatangattgggagcgacaaggcagagttcttctgcaagacattcgaagaaagtcatgagaaacttggtcacagagagctgaatttggatgctgctaagaagtccctgagcgcttatgagagctgaatgatgacattaggtnatgctgcttaagggtcgtagttgccatgatctggaaagttgtgatgctgttaaaatttgaaccccggcaaacttttaaacaccgggaaatgctggtgaacgctactgatccccccgattggtcacccatcccccctacccagc

SEQ ID NO: 52066 - protein, 107 aa, Zea mays
  misc_feature: Ceres CLONE 1467785-F
  misc_feature (68)..(68): Xaa is any aa, unknown, or other
MDEEEFRRMLDLFPVVRSRDYCCSDLGTSSRGTRQRSRVQEGTKGDNKDSSGGRDMFMQKLKMAAENXIGSDKAEFFCKTFEESHEKLGHRELNLDAAKKSLSAYES

SEQ ID NO: 52067 - DNA, 677 bp, Zea mays
  misc_feature: Ceres CLONE 1467791-F
  misc_feature: Encodes the peptide sequence at SEQ ID NO. 52068
  misc_feature (511)..(511): n is a, c, t, g, unknown, or other
  misc_feature (512)..(512): n is a, c, t, g, unknown, or other
aagctggagctccccgcggtggcggccgctctagaactagtggatcccccgggctgcaggaattcgcacgagaccattacctagaacatcctaatcgaaaagaaggggggatatctgaaaaaaacgcaaggtaccagcagcgcaaagagccgggtgttggcacagatcaggcggccgccatggcggatcagttcgcggattcggcgaacaacgtgatcatcgaggaggtgaacaagggcctgaacccaggaatggtggttctgctcgtggttgccagcttcctgctgctcttcttcgccgggaactacgcgctgtatgtgtacgcgcagaagacgctcccgcccaagaagaagaagccggtctccaagaagaagctgaagagggaaaagctgaagcagggggtctccgctccaggggagtgaacagacagggatgccgccgaatcgcccgtcctgagcccgccccctatttacatgattgtcgaaaaaaaaaataccactgctgaaacccnncgtgtcgtaataattttgttcggaaatgccttttgttgccttccagggaaggcctttgtattggaacccttgtttccccactgatgatcttttgctaaaaaaaaaaaaaaaaagctatcgaaccctcaaccccgaggggggcccggaacccaatcccccaaaagg

SEQ ID NO: 52068 - protein, 80 aa, Zea mays
  misc_feature: Ceres CLONE 1467791-F
  misc_feature (10)..(80): Pfam Name: S1FA Pfam Description: DNA binding protein S1FA
MADQFADSANNVIIEEVNKGLNPGMVVLLVVASFLLLFFAGNYALYVYAQKTLPPKKKKPVSKKKLKREKLKQGVSAPGE

SEQ ID NO: 52069 - DNA, 717 bp, Zea mays
  misc_feature: Ceres CLONE 1467803-F
  misc_feature: Encodes the peptide sequence at SEQ ID NO. 52070
aagctggagctccccgcggtggcggccgctctagaactagtggatcccccgggctgcaggaattcgcacgagaccattacctagaacatcctaatcgaaaaagcaactagatactcctctaccggccggcgtacgccgacgacgggcacaacaaacagctagacgcctagacatagcgagctctagctaccgagcgagctcgacatatgggtgacgacactggcgcgaacatgcccccctggggcgggctctacggtggctgcggcgcgccggcggcggcggcgggcgggtcggcgtcaagcccgacccgcgcgcagcccggcgggcgcgtcgggaagccgcccgcgcggcggcggtcccgcgcgtcccgccgcgcgcccgtcacgctgctcaacacggacaccgcccacctccgcgccatggtgcatcagttgaccggggtcccgccggggccctgcggccccggcggcgagtacggcgcgccgctggtggtgcgcccgtcgacaacgacggtcgtcgcgccgttcgggcacccgcaccggtccacgtcgttgcagagccagctcttctggccgcagcctcaactgcagtaacaatactacggcgggcgcgggtaccgcggggaggaacggcatggcccccgttcctggaaggcgggttttcaattctccggggaaggaagggcttgctgctgccagagcatggggcccgggggcg

SEQ ID NO: 52070 - protein, 128 aa, Zea mays
  misc_feature: Ceres CLONE 1467803-F
  misc_feature (55)..(85): Pfam Name: VQ Pfam Description: VQ motif
MGDDTGANMPPWGGLYGGCGAPAAAAGGSASSPTRAQPGGRVGKPPARRRSRASRRAPVTLLNTDTAHLRAMVHQLTGVPPGPCGPGGEYGAPLVVRPSTTTVVAPFGHPHRSTSLQSQLFWPQPQLQ

SEQ ID NO: 52071 - DNA, 672 bp, Zea mays
  misc_feature: Ceres CLONE 1467804-F
  misc_feature: Encodes the peptide sequence at SEQ ID NO. 52072
  misc_feature (529)..(529): n is a, c, t, g, unknown, or other
  misc_feature (544)..(544): n is a, c, t, g, unknown, or other
aaagctggagctccccgcggtggcggccgctctagaactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctccaaatatgattcgtctggtctggcgcgcgtgagtccagctcgtgtgtcgtgtgtgtctctgtgtgaagtgtccgcgggcgtgtgtgtatgtatggagtcngccgcggcggcggcngcggaagaggtgtgcccgtggtgggtggtacctgcttcaacgcgccactgtttgtcgcggcgatcatgtactaccctgcggcgttttctggttatcaatgaaatgaattatttgaatcaaaaaaaaaa

SEQ ID NO: 52072 - protein, 57 aa, Zea mays; identical to SEQ ID NO: 43282
  misc_feature: Ceres CLONE 1467804-F

SEQ ID NO: 52073 - DNA, 633 bp, Zea mays
  misc_feature: Ceres CLONE 1467807-F
  misc_feature (528)..(528): n is a, c, t, g, unknown, or other
  misc_feature (559)..(559): n is a, c, t, g, unknown, or other
ggggaattcgcacgagaccattacctagaacatcctaatcgaaaaatccatccgccatggcgaccgctaccctactgagctcctccttcgccatgcccggcgccgcccggagggccccctccccttcctccgtctcattgagcttcgccacgtcgcagctcgccggcctcttgctctccgccggagttgcaactccaaccgccgtcgcctgcctccccaagagggaccacctccagcccactgtcgcgcggcgagtgtgcccgttcacggacaacaaaacgaaccgggccgatatcgtgtcgttttccaaccacaagaggaagaagcagcagttcgtgaacctgcagtacaagaagttcgcctcgcgaggccggcaagagcttcgtcaagctgcgcctttccacctaggccctcaagattctcgagaaggacggcctcgacgccgtcgcgcgcaaggccggcatcgacctcaataatttgtgagcaagaagtgagcccatcttatgagcaactaaattagtgtggggnggcactagcttaacattctcgtgcgcagggncgactcgtctgtttgtctgcctgcctgtctgcctcctgctgctctttcgcaatcaaatcaaatcgttatatctc

SEQ ID NO: 52074 - DNA, 670 bp, Zea mays
  misc_feature: Ceres CLONE 1467812-F
  misc_feature (251)..(251): n is a, c, t, g, unknown, or other
  misc_feature (324)..(324): n is a, c, t, g, unknown, or other
  misc_feature (341)..(341): n is a, c, t, g, unknown, or other
  misc_feature (345)..(345): n is a, c, t, g, unknown, or other
  misc_feature (351)..(351): n is a, c, t, g, unknown, or other
  misc_feature (361)..(361): n is a, c, t, g, unknown, or other
  misc_feature (362)..(362): n is a, c, t, g, unknown, or other
  misc_feature (386)..(386): n is a, c, t, g, unknown, or other
aaagctggagtccccgcggtggcggccgctcagaatagtggacccccgggctgcagattcgcacgagaccattacctagaacatcctaatcgaaaagtaacgacccgtcgagctagtcttccttccttccttccttccatcgccggccctttttccgtgcacaaaggcgtgtgtgtgcgtatatatatacacatacacacactgctccatgccaccgttgtacaagttctcccatctacaacaccataatncaggagatcgctgctccccagactcggtttcctctgcttcgcgtcaaatcatggccgcagctggcagtcgtcntcggcatgaagaaacgntgcngcaacngcgcgcgcgnnggcgcccggaatgaccggcagccncaaacggggcatcgctacctgctcatgttgccggccttgtcgccactaggggtttactaaaatttcggcctgctccgggccggcaaacctcagggaaaagaaagtttttggggctttttggttcccggggggcctaaccttttaaagttcccgggccaaattttattttttggtttcccactttgttttttgggaaaatgaaaagggaaaaccgggtcctggggccacccccccaaccgggaaaggggtttttaaaaactctccccgggaaaaaccgtaaaaaa

SEQ ID NO: 52075 - DNA, 729 bp, Zea mays
  misc_feature: Ceres CLONE 1467815-F
  misc_feature: Encodes the peptide sequence at SEQ ID NO. 52076
  misc_feature (565)..(565): n is a, c, t, g, unknown, or other
aaagctggagctccccgcggtggcggccgctctagaactagtggatcccccgggctgcaggaattcgcacgagaccattacctagaacatcctaatcgaaaaaggtttactctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacacatgggggatgtcgacatggtctcagttgaagagtcttcagaagctgcaaaagggcaagtcccaagtgaaagtccattgtgaagaaaaactcaggaattcggattaggagttaaaagggccaaggccggaaaaagccaaaaggcaaaaccccctgcaaggaaaatttaatccctgggaaaaaagaccttgagccccggggncctgggggaaaaaaaaacaacccccccccccttggtggttttccaaagtttggggggggcgcccccccccaaaaggggggggggtttttttacttttgcccgagggtgaaaaaaacccctttggcggggggtgtgttgttcaaaaaaaagattcctttaaaggg

SEQ ID NO: 52076 - protein, 102 aa, Zea mays
  misc_feature: Ceres CLONE 1467815-F
MAKYNVVQKNKRQCNQDRKRAAHGEPGTGKLKQRTAPVSMSGKRKKKLERRLNRKQKEAAMIKALENTWGMSTWSQLKSLQKLQKGKSQVKVHCEEKLRNSD

SEQ ID NO: 52077 - DNA, 732 bp, Zea mays
  misc_feature: Ceres CLONE 1467816-F
  misc_feature: Encodes the peptide sequence at SEQ ID NO. 52078
  misc_feature (706)..(706): n is a, c, t, g, unknown, or other
  misc_feature (707)..(707): n is a, c, t, g, unknown, or other
tggagctccccgcggtggcggccgctctagaactagtggatcccccgggctgcaggaattcgcacgagaccattacctagaacatcctaatcgaaaaacctcaaaattcacagtagccagatccagcagaattgagtgacaggctcaaacacaagctagaagataggtgcttagtgagttaaccagtgggatgtcgctggaagatagtttgaagaagagggtggccaagtgccgcagggagtatgacattatttacaagcagctaccggtgctgctagagaagatgggaattctatttcctacggggaagaagatggagagctccgagctggagaacaatcccaagcaaagggggagccggtcgatccgctgcaaaccatgacgccggcaaaataggggaacgctacacccacctgccgaaaccggcaagggaattctccaggatttggacaaagccaaaaagggaatcctccaggccaaaacagggggaaaccccccttttttagggggaaacaatttttattgaaggcggtcgccccccaccccccacggaagggggggcctggttttctcctcgggggccccccccccccaaaaaaaaacccccccgaaaatttttttttccgcggggtttcccccggggaaaccccgggggggggggaaaaataccggcggggggggggggaaacccacaaaaagagggggnnaaatggggggtctcctttttttttt

SEQ ID NO: 52078 - protein, 63 aa, Zea mays
  misc_feature: Ceres CLONE 1467816-F
MSLEDSLKKRVAKCRREYDIIYKQLPVLLEKMGILFPTGKKMESSELENNPKQRGSRSIRCKP

SEQ ID NO: 52079 - DNA, 793 bp, Zea mays
  misc_feature: Ceres CLONE 1467818-F
  misc_feature: Translation starting site: 196
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (648)..(648): n is a, c, t, g, unknown, or other
  misc_feature (651)..(651): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
aaagctggagctccccgcggtggcggccgctctagaactagtggatcccccgggctgcaggaattcgcacgagaccattacctagaacatcctaatcgaaaaaaacaatacccgtcttgccttcaaatcgaactcctcccccgatcgatcccaatcgaacccaccaagccgataccctaaccctcgcccttctcgatgtcggccgccaccaccggcccagccccttcagtagccactccgatggcgccccctccgtcctacccggcctcctccacggcctcttcctccatctccgcgtccgccgaggaggaggaggacctctatggccgcctcaaatcgctccacgcctgtgatcactgggnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnncggnnnnnnnnnnnnnnnnnnnnnnnnnnnnnnnnnnnnnnnnnnnnnnnnngccngangtnnnnnnnnnnnnnnnnnnnnnnnnnnnnnnnnnnnnnntannnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnn

SEQ ID NO: 52080 - DNA, 713 bp, Zea mays
  misc_feature: Ceres CLONE 1467821-F
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (407)..(407): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (425)..(425): n is a, c, t, g, unknown, or other
  misc_feature (426)..(426): n is a, c, t, g, unknown, or other
tggagctccccgcggtggcggccgctctagaactagtggatcccccgggctgcaggaattcgcacgagaccattacctagaacatcctaatcgaaaacacaagctactcaagcaaaaaagcgtgaaattgaggacaattcaaggaaaataggggcattgttttcaaaactaaatagtgatgacatatctccaaacgtttcatcaaaactcaggcagttgtgcagtgcaattgatgctagcgattttgccactgcgatgcacctccaggtagattggacgctgatcttttaggtactcttgacaacatgatggacaggacttctggtcctaggtaannnnnnnnnnnnnnnnnnnnnnnnnnntnnnnnnnnnnnnnnagnnnnnnnnnnnnnnnnnnnnnnncnngngnnnnttttttnnnnccnnttctgtacacacctttttctgctgcttgccaaaaatgatagctgtagcagttcagagagtttgcctgcacaggggtcttatcatgctgctttggtccccgcgcctgggatctgccaaagcctttggcaccccggggcgggtaactttttaaaaaaattttttgttttccaaattccaaaaaggggacccggggccggggggtccccaaagaaggtaatgaagagaactttctccgttttacgggggaacaccgttcaaaccccccccaaaaataccccggtgggaaa

SEQ ID NO: 52081 - DNA, 749 bp, Zea mays
  misc_feature: Ceres CLONE 1467823-F
  misc_feature: Encodes the peptide sequence at SEQ ID NO. 52082
  misc_feature (392)..(392): n is a, c, t, g, unknown, or other
  misc_feature (419)..(419): n is a, c, t, g, unknown, or other
  misc_feature (512)..(512): n is a, c, t, g, unknown, or other
ggagctccccgcggtggcggccgctctagaactagtggatcccccgggctgcaggaattcgcacgagaccgttacctagaacatcctaatcgaaaaagactcatcatcagttcaattcaatccaatccaatccaatcccaccccgccccttccaagaactctagtatcaaccaaccgtccaacaaaagcaggagtcgcatccgaccccccgcatcagagacaggcagggagggaaccgagatccgtccgtccgtgtcgatggagtcaacggtggagcggataagctcgtcggtgcagtcctgggtgaaggaccacgagctcgcagccatcggaagcgtgtggggctgcggcgtgggcactttcgtggcgtacagccggaagagggcccccancggggcacggcccttgcgctcaatcangcaagaatgcacgcgcaggcgctcacgctcgccgtcctcgggggggccggcctttttccataataagggaaacggggggcccaagaaaaaggncaaaaaaattaaccttaaatttttattgcagggtgcccccggcccccaaacccaaaggaaaaaaaaaaacttgttggattttttaaaaaaaaaaaaaaaaaattttccaaaaaaacagggggggggttcgaaaaaaaaaaattggagggggggcccaataaagggggggggggggggaaataattggggggaacaaccaaccccccccctataaaaaaaaaaaaggggggggctttt

SEQ ID NO: 52082 - protein, 155 aa, Zea mays
  misc_feature: Ceres CLONE 1467823-F
  misc_feature (45)..(45): Xaa is any aa, unknown, or other
  misc_feature (54)..(54): Xaa is any aa, unknown, or other
  misc_feature (85)..(85): Xaa is any aa, unknown, or other
MESTVERISSSVQSWVKDHELAAIGSVWGCGVGTFVAYSRKRAPXGARPLRSIXQECTRRRSRSPSSGGPAFFHNKGNGGPKKKXKKINLKFLLQGAPGPQTQRKKKNLLDFLKKKKKNFPKKQGGGSKKKNWRGGPIKGGGGGNNWGEQPTPPL

SEQ ID NO: 52083 - DNA, 717 bp, Zea mays
  misc_feature: Ceres CLONE 1467825-F
  misc_feature: Encodes the peptide sequence at SEQ ID NO. 52084
  misc_feature (295)..(295): n is a, c, t, g, unknown, or other
  misc_feature (337)..(337): n is a, c, t, g, unknown, or other
  misc_feature (386)..(386): n is a, c, t, g, unknown, or other
  misc_feature (387)..(387): n is a, c, t, g, unknown, or other
  misc_feature (391)..(391): n is a, c, t, g, unknown, or other
  misc_feature (394)..(394): n is a, c, t, g, unknown, or other
  misc_feature (402)..(402): n is a, c, t, g, unknown, or other
  misc_feature (403)..(403): n is a, c, t, g, unknown, or other
  misc_feature (411)..(411): n is a, c, t, g, unknown, or other
  misc_feature (419)..(419): n is a, c, t, g, unknown, or other
  misc_feature (457)..(457): n is a, c, t, g, unknown, or other
aaagctggagctccccgcggtggcggccgctctagaactagtggatcccccgggctgcaggaattcgcacgagaccattacctagaacatcctaatcgaaaagcgctggacaccaccgcatgctagggaggcagggaggggagccgagccgaggacgatggcgctgggcgtgttgttccacggcgcacagctagcgctggatctggcggtggccgggatgtcgctggcggtggcgctcgggttcttcgccctcatcactaccttgctctgctccgcggcgttcctccacactccnagcccgccgcgtagtcatagcctccacagcgaccaacgcgtnctcacctctggggcgatgcaaacttgagtatgtggcatcctttcctccnnagtnganggacgaannaaggtacnactaccgntggcctgcctgaattgatcctgaggctttccggaatcnaagctgtcagggaaaaggtttgcggatcggaaaaaaaaaaggcgaccccccccagcttgggggctcttttggggggcaaaaaacctgaaccccgaagggcgaaacccggcccgggggtttttttccccgggcggttttttttccccgaaaaaagttttttcccccgcccctccctatttaaaaaaccccggccccctttaaaaatttccggcgccccgcggtttatttccccaattttaaaccccccccttttccccggt

SEQ ID NO: 52084 - protein, 68 aa, Zea mays
  misc_feature: Ceres CLONE 1467825-F
MALGVLFHGAQLALDLAVAGMSLAVALGFFALITTLLCSAAFLHTPSPPRSHSLHSDQRVLTSGAMQT

SEQ ID NO: 52085 - DNA, 717 bp, Zea mays
  misc_feature: Ceres CLONE 1467829-F
  misc_feature: Encodes the peptide sequence at SEQ ID NO. 52086
  misc_feature (406)..(406): n is a, c, t, g, unknown, or other
  misc_feature (408)..(408): n is a, c, t, g, unknown, or other
  misc_feature (421)..(421): n is a, c, t, g, unknown, or other
  misc_feature (423)..(423): n is a, c, t, g, unknown, or other
  misc_feature (425)..(425): n is a, c, t, g, unknown, or other
  misc_feature (427)..(427): n is a, c, t, g, unknown, or other
  misc_feature (429)..(429): n is a, c, t, g, unknown, or other
  misc_feature (679)..(679): n is a, c, t, g, unknown, or other
  misc_feature (680)..(680): n is a, c, t, g, unknown, or other
acccgcggtggcggccgctctataactagtggatcccccgggctgcaggaattcgcacgagaccattacctagaacatcctaatcgaaaagatctgttgtatacggagttacggactggcgccgccgcttagtcaccacccaccaaacttcacggcttcggctatcttcaagagacaagagtggagggcgaagagcagagctgggggggagatgaacagcggcgtggacactcaggcgcgggcgctcgcggacgaggtgcgcgttagtttagagacgaagaactggatgctggacctcggtcacccgctcctgaaccgcgtcgccgagagcttcgccaaggccgcggggatcggcgcagtgcaggcggtcgccagggaatctctctgaggaggggcgcgaacctcntngcgagatgagggnancngngnccggcgcgaccggcgcaaggaaacgctcgttcccggagctcaatgggacgaacagtatcccgcatccagtctgcgcaagccctggtgaaaagcgtgagcaaagagtccttacactgggggctccccggctgggggcgcccccggcctccaccggaccccgggggggggggggggcgcacccccgatggagacagggccggtggttggctcgaggggggggggggggtccttttccatgaaattgcccccnncaaagggggggggggggtgcgcccccccccccccccc

SEQ ID NO: 52086 - protein, 58 aa, Zea mays
  misc_feature: Ceres CLONE 1467829-F
MNSGVDTQARALADEVRVSLETKNWMLDLGHPLLNRVAESFAKAAGIGAVQAVARESL

SEQ ID NO: 52087 - DNA, 691 bp, Zea mays
  misc_feature: Ceres CLONE 1467833-F
  misc_feature: Encodes the peptide sequence at SEQ ID NO. 52088
aagctggagctccccgcggtggcggccgctctagaactagtggatcccccgggctgcaggaattcgcacgagaccattacctagaacatcttaatcgaaaagtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcaaaacgtgctcggcaagaagggccccaggatcagggaccttacctccgtcgtccagaagaggttcaacttccctgagaatggcgtcaagctttacgccgaaaaggtcgtcaaccgtgggctctgtgccatcgcgcaggccgagtccctccgttacaagctcctcggaggccttgccgtccgcagggcttgctatgggggtcctcgttatgtaatggagagtgctcccaagggttgtgaggtgattgtaagtgaaaagctccgggcccaaagaacccaagccatgaagttcaaggatggctacttgatctcacctggtcacc

SEQ ID NO: 52088 - protein, 162 aa, Zea mays
  misc_feature: Ceres CLONE 1467833-F
  misc_feature (45)..(102): Pfam Name: KH_2 Pfam Description: KH domain
MATQISKKKKFVSDGVFYAELNEMLTRELAEDGYSGVEVRVTPMRTEIIIRATRTQNVLGKKGPRIRDLTSVVQKRFNFPENGVKLYAEKVVNRGLCAIAQAESLRYKLLGGLAVRRACYGGPRYVMESAPKGCEVIVSEKLRAQRTQAMKFKDGYLISPGH

SEQ ID NO: 52089 - DNA, 743 bp, Zea mays
  misc_feature: Ceres CLONE 1467834-F
  misc_feature (447)..(447): n is a, c, t, g, unknown, or other
  misc_feature (454)..(454): n is a, c, t, g, unknown, or other
  misc_feature (471)..(471): n is a, c, t, g, unknown, or other
aaagctggagctccccgcggtggcggccgctctagaactagtggatcccccgggctgcaggaattcgcacgagaccattacctagaacatcctaatcgaaaaaaacggccgtccctatctatcggattgcttccagttccagctcgagcactggggcttcgcaggcgagatgaagaggctgcttgctcgtggcaagtccggttgcccctcccggagtttggttggcagaatccctgccctgcctgtactttgcaacaacgttcttcccggccataggtactattcagccgagaaacacgatgacgacaccacgctaggtgagatcggggacaaggcaaggtcgacagccgaggagttcctgagggtggccaagagaaagacgacgacgtcgcgaagggcgcgaaggagaccctgcacgagaccaaggaaagcgtggtcggggagtcngacgacnaaaaggaaattcaaaangggagggtggaaggaagggaattaccttcctccgaaaaaaaaagtggcttgggttcccttggctggaaagccaacccaggcttggaataaaaaacaaacccaaagggccttttatttttgaaaaatttactcttttgtctcccaagggtgtcgatgtcctgtaaaaaaaaaaaaaaatccccttttgggcgccaccacccaaaaaaaaaaaaaaaaaccttttcttcccccccccccccgggggggggggcccgggccacacttccccccag

SEQ ID NO: 52090 - DNA, 691 bp, Zea mays
  misc_feature: Ceres CLONE 1467835-F
  misc_feature: Encodes the peptide sequence at SEQ ID NO. 52091
aaagctggagctccccgcggtggcggccgctctagaactagtggatcccccgggctgcaggaattcgcacgagaccattacctagaacatcctaatcgaaaaaaattggcacttccgtaccccgaccccggccaccgtgtggaaacagaaacagcaatggcggggaggctggtgccgagcacgaagaaggcgatggagcaccgggaggagaagcccaaggtgccgtcgagcgacccgggctccgacctcgacctggtgcagctggtggccgggcagcagccgcccaacatctcggagatgaagccgctgacgcgggaggcgtacggcggcgggatgtacgcggccgaggaggagggcggccggcggaggggccccgcgcggccgcgcgcgagcgccacacagagcgccaaccggcccgaggagcagcgcgctggcgcgaggcccagccacccgccgccgccgtccaccggggaacgcaacctcgacatcaccggacagtcctacatccagtacccgcatgtgccggttgcccagcgccgcgcttgggcgttggccattgccggtgtgtgtgtgtacccagtacccttccgggaggtacttgctacaatacttggttgggttcttgaccaagtgtccttgtacacctcgctttggttaaaatgtgcacctccttcctaattgcccacaacac

SEQ ID NO: 52091 - protein, 173 aa, Zea mays
  misc_feature: Ceres CLONE 1467835-F
MAGRLVPSTKKAMEHREEKPKVPSSDPGSDLDLVQLVAGQQPPNISEMKPLTREAYGGGMYAAEEEGGRRRGPARPRASATQSANRPEEQRAGARPSHPPPPSTGERNLDITGQSYIQYPHVPVAQRRAWALAIAGVCVYPVPFREVLATILGWVLDQVSLYTSLWLKCAPPS

SEQ ID NO: 52092 - DNA, 728 bp, Zea mays
  misc_feature: Ceres CLONE 1467836-F
  misc_feature: Encodes the peptide sequence at SEQ ID NO. 52093
  misc_feature (388)..(388): n is a, c, t, g, unknown, or other
  misc_feature (416)..(416): n is a, c, t, g, unknown, or other
aagctggagctccccgcggtggcggccgctctagaactagtggatcccccgggctgcaggaattcgcacgagaccattacctagaacatcctaatcgaaaatacgacgacgaaggtgacgttcccgatcctggcggacccggcgcgggacgccatccggcagctgaacatggtggaccccgacgagaaggacgcggcggggcggagcatgccgtcccgcgcgctccacgtcgtcgggcccgacaaggccgtgaagctgagcttcctgtacccggccaccacggggcggaacatggacgaggtgctgcgcgccgtcaactcgctgctcacggccgccaagcatggcgggagggtggccacgcccgccaactggaagcccggggagtgcnccttcatcgcgcccgggcgtctcccacnaggaggccagggaagatgttcccgcagggggttcgagaccgccgacctgccctccaagaagggctacctcccgtttccaccagggtttacctaggccgacgtacgggcacggaacatttagcttcgtctgtcagtcccccctcccaccgggggggccccggatccttttgggcccggccggggggtttccccggaccaagtaaaaataaaggctcccaaggatgtggggaaccaatcccccggccctggttttccccccggtaggggggggcaacccggttctggggccccacccccccttaaatttggcca

SEQ ID NO: 52093 - protein, 113 aa, Zea mays
  misc_feature: Ceres CLONE 1467836-F
  misc_feature: SWISSPROT Homolog: EC 1.11.1.15 Peroxiredoxin
  misc_feature (74)..(74): Xaa is any aa, unknown, or other
  misc_feature (83)..(83): Xaa is any aa, unknown, or other
MVDPDEKDAAGRSMPSRALHVVGPDKAVKLSFLYPATTGRNMDEVLRAVNSLLTAAKHGGRVATPANWKPGECXFIAPGRLPXGGQGRCSRRGFETADLPSKKGYLPFPPGFT

SEQ ID NO: 52094 - DNA, 717 bp, Zea mays
  misc_feature: Ceres CLONE 1467840-F
  misc_feature: Encodes the peptide sequence at SEQ ID NO. 52095
  misc_feature (369)..(369): n is a, c, t, g, unknown, or other
aaagctggagctccccgcggtggcggccgctctagaactagtggatcccccgggctgcaggaattcgcacgagaccattacctagaacatcctaatcggaaaaagcaatagcagtccttgctcctccaacttccctcctggcttctgcccctttgtctgcgctcctcacgccgccccccgccccagcctcacacccgcattccccagatctccatggactcgacccctcccacggacccggcggcctcctgcttggcctccgcctctgcggcggtggcatcgggggacgtcgccgcgatgctgccggactcgccgccgcggcgtggggcgggccaccgccgcgcacagtcggagatcctcctcgggggngcggcgctccccaacaacctcaccttcgacgcggacctccccccccccccggggaggcctgcgtggccggcgacaaggatgaggaggatgactaccaccacaagaaaggggtcggcggcgctggcggcagccggaatgtcgagatgtccctccaaaacgggggcaagcccccaagaaccgccggaacccgtcgggcccatccgaatttcaacccccccgcggccccgggacccctcacagcatgttttatggatgggggccccgttctttggttgggttccccccccccccccggaccccctggggaggtccggccccttaatccccaaaaagggcaatttcccaacc

SEQ ID NO: 52095 - protein, 168 aa, Zea mays
  misc_feature: Ceres CLONE 1467840-F
MDSTPPTDPAASCLASASAAVASGDVAAMLPDSPPRRGAGHRRAQSEILLGGAALPNNLTFDADLPPPPGRPAWPATRMRRMTTTTRKGSAALAAAGMSRCPSKTGASPQEPPEPVGPIRISTPPRPRDPSQHVLWMGAPFFGWVPPPPPDPLGRSGPLIPKKGNFPT

SEQ ID NO: 52096 - DNA, 695 bp, Zea mays
  misc_feature: Ceres CLONE 1467846-F
  misc_feature: Encodes the peptide sequence at SEQ ID NO. 52097
aagctggagctccccgcggtggcggccgctctagaactagtggatcccccgggctgcaggaattcgcacgagaccattacctagaacatcctaatcgaaaaagctattattcgatccaaaacataaaatacgagggtcaaatctctcgtctcgctcggctcctctgggcccacagcggccagcaaactgcctccgtcctccctgcgggctgtgccgcctcttcttcgcgtcggcgccgccctcctcccttctcttctgctgctgatggaactggatcctcgcctctacgagaacgtctctgtcagcgacaacgatgtccgaaacatagttctatcttatcttatgcacaactgttttaaagggacggcagaggcattcctatctagcactgggttgaatttacctgtcgactatagtgtggatgtggataagcgtaaagcaatttttaattttgtgctagaagggaatgcccttaaagccatagagctgacagaagaaatggcacctaacttgctagagaatgatatggatctacattttgatcttcttagtctccacttcattgagctagttcgctcaaaaaaattcacagaagctcttgactttggccagaaaaaattgacatcatttcagaaggttaccaagtatattgagaaactagaggactttatggccctcctggcttatgaagagcc

SEQ ID NO: 52097 - protein, 143 aa, Zea mays
  misc_feature: Ceres CLONE 1467846-F
MELDPRLYENVSVSDNDVRNIVLSYLMHNCFKGTAEAFLSSTGLNLPVDYSVDVDKRKAIFNFVLEGNALKAIELTEEMAPNLLENDMDLHFDLLSLHFIELVRSKKFTEALDFGQKKLTSFQKVTKYIEKLEDFMALLAYEE

SEQ ID NO: 52098 - DNA, 750 bp, Zea mays
  misc_feature: Ceres CLONE 1467847-F
  misc_feature: Encodes the peptide sequence at SEQ ID NO. 52099
  misc_feature (364)..(364): n is a, c, t, g, unknown, or other
  misc_feature (365)..(365): n is a, c, t, g, unknown, or other
acccgcggtggcggccgctctagaactagtggatcccccgggctgcaggaattcgcacgagaccattacctagaacatcctaatcgaaaaaacgcttaggagtgcagagagattctccggagaagaagcaggagcgggtgcggtggcgaggtctatgtccacgacggcggggtacctggcgcggccctcgcggcagaaggagcgggtgcggctgctctaccgccgcgcgctcatggacttcctccactgtgctgtccaccgtcacctcttctatcaggacgcgtctgagctcagggacaagttcgaggccaacagaaatgtggagaacctggacgtgatcgataggctcatcgaggaaggaaanncccagcagaggaactttcatgacccggattctcccccccggtcaaggagcttcctgatagcatctaaatttataagggaacccttccttcccctggaagggattgagattccttttacacctatgggcaaaaaacgcccactgaaccaggcaatctttgtttttttggacccgaacccttggacccgggcggaatgtcaaaaggatctacctttttcctcttcccccaaaaaatcccctggcacctgaacccggctgcgtttggtaaaaaacacaagaaaaaattttccctcccccccctttcccagtgggttttctttttaaccccggggggggtttgtatggcccccacctttgttttgggcgcccccccccataaaagaaca

SEQ ID NO: 52099 - protein, 152 aa, Zea mays
  misc_feature: Ceres CLONE 1467847-F
  misc_feature (13)..(78): Pfam Name: Complex1_LYR Pfam Description: Complex 1 protein (LYR family)
  misc_feature (70)..(70): Xaa is any aa, unknown, or other
  misc_feature (71)..(71): Xaa is any aa, unknown, or other
MSTTAGYLARPSRQKERVRLLYRRALMDFLHCAVHRHLFYQDASELRDKFEANRNVENLDVIDRLIEEGXXQQRNFHDPDSPPRSRSFLIASKFIREPFLPLEGIEIPFTPMGKKRPLNQAIFVFLDPNPWTRAECQKDLPFSSSPKKSPGT

SEQ ID NO: 52100 - DNA, 771 bp, Zea mays
  misc_feature: Ceres CLONE 1467853-F
  misc_feature (285)..(285): n is a, c, t, g, unknown, or other
  misc_feature (287)..(287): n is a, c, t, g, unknown, or other
  misc_feature (288)..(288): n is a, c, t, g, unknown, or other
  misc_feature (293)..(293): n is a, c, t, g, unknown, or other
  misc_feature (294)..(294): n is a, c, t, g, unknown, or other
  misc_feature (423)..(423): n is a, c, t, g, unknown, or other
aaagctggagctccccgcggtggcggccgctctagaactagtggatcccccgggctgcaggaattcgcacgagaccattacctagaacaccctaatcgaaaaactcacctcactccacctcttgactgaagaagccgtctgcctgcctccgactcccgcgtctctcctccaagtgatctccttccacctttgccgatcgcccgttgccaccggccgggcgatcctcgtacttccacttccaccatggcctcctcctcctcttcctcctcctccaccaccaggagntnntggtnntggcgcttcctacccccgctgctaggacaaagagcaaacccctccctcccctcgagtgatggggggagggttgggagttgggggatccataaaaaaaatttcccactggggggttgtcgaccccccccngttgtgggtggggtttcatccaccgcccttaccacaacccaagatcaaaacaaccaacaaaaacattaaaatccccagatttatatgtaagggggcgagcgtaggaatcgtgcaccgccccgtccgtcatattaaatcggccgaactgcccccccaaatatctatgcctccttaacaatctccccagatcactatcgctgttacaaaagcttgcacacctccccgctgattttaatatatttatatctggcgcttaaatttccccccacccctcttaaatacacgctggcgttgttatcaaaatattagaagcccccgccgcgggagctttcaggcgaggacattttt

SEQ ID NO: 52101 - DNA, 692 bp, Zea mays
  misc_feature: Ceres CLONE 1467854-F
  misc_feature: Encodes the peptide sequence at SEQ ID NO. 52102
aaagctggagctccccgcggtggcggccgctctagaactagtggatcccccgggctgcaggaattcgcacgagaccattacctagaacatcctaatcgaaaaccaaccaaacttccggtcttctcttctccactaccacccgcctgcccgcgcgccttctcctccaccactgccccgtcgtggaataggggcaagttcaggcatctcgcttctgtcctggtcgaggggatcggagaaaaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcgcgcctcggcaaccgctgggccgccatcgcgcgcctcctccccggccgcaccgacaacgccgtcaagaaccactggaactgctccctcaagcgcaagctcgccgccgcgtccgccccggcgggttcctccgacgtcgacgcgcgcccgaacaagcgcgtcagcctctcgcccgacagcccgtcggggtctgggtccgggtccgaccgtagcgacctg

SEQ ID NO: 52102 - protein, 151 aa, Zea mays
  misc_feature: Ceres CLONE 1467854-F
  misc_feature (11)..(57): Pfam Name: Myb_DNA-binding Pfam Description: Myb-like DNA-binding domain
  misc_feature (63)..(108): Pfam Name: Myb_DNA-binding Pfam Description: Myb-like DNA-binding domain
  misc_feature: The sequence is a functional homolog of SEQ ID NO 142 in the 11/375,241 US patent application
  misc_feature: The sequence is a functional homolog of SEQ ID NO 1918 in the 10/412,699 US patent application
  misc_feature: The sequence is a functional homolog of SEQ ID NO 2180 in the 10/374,780 US patent application
  misc_feature: The sequence is a functional homolog of SEQ ID NO 470 in the 10/225,066 US patent application
  misc_feature: The sequence is a functional homolog of SEQ ID NO 1943 in the 10/374,780 US patent application
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVDARPNKRVSLSPDSPSGSGSGSDRSDL

SEQ ID NO: 52103 - DNA, 708 bp, Zea mays
  misc_feature: Ceres CLONE 1467855-F
  misc_feature: Encodes the peptide sequence at SEQ ID NO. 52104
  misc_feature (379)..(379): n is a, c, t, g, unknown, or other
  misc_feature (382)..(382): n is a, c, t, g, unknown, or other
aagctggagctccccgcggtggcggccgctctagaactagtggatcccccgggctgcaggaattcgcacgagaccattacctagaacatcctaatcgaaaaactctctcttctccctccaataattctctccacccctgcttgctgcagcttcaagcactaccgaatcagggcgagtgggagcagaggagggaatcccatgtctccgcccctcgctggagcagatcgttgtcgagccgacgtggagctgctgcggtagaaagctagcggagcctgcgagctagcctgatccgtccgcagtccgatcgggatcgatgggtggggaggcgccggagccgcggcggctgacccgggcgctgagcatcggcggcggtgatggnggntgggttcccgaggagatgctgcaactcgtgacccctctcgtcgaggacccgcgcgaccgggaggccgcgtcgctggtgtgtcaccggtggcaccgcgacaacgccctctccccgaagcccgtgacggtgcccttctgctacgccgtttccccggcacgcctgctcgcgcggttcccggggctcgagtccctcgcggttgaaagggaagcccccgcgcggccatgtacgggcttcataccccaacgactgggggcgccttaacccccgccccgtgaatcacccgtagcttcgcccgcgtcccacttcgaagtgcccgtcaaggggcc

SEQ ID NO: 52104 - protein, 109 aa, Zea mays
  misc_feature: Ceres CLONE 1467855-F
MGGEAPEPRRLTRALSIGGGDGGWVPEEMLQLVTPLVEDPRDREAASLVCHRWHRDNALSPKPVTVPFCYAVSPARLLARFPGLESLAVEREAPARPCTGFIPQRLGAP

SEQ ID NO: 52105 - DNA, 712 bp, Zea mays
  misc_feature: Ceres CLONE 1467858-F
  misc_feature: Encodes the peptide sequence at SEQ ID NO. 52106
  misc_feature (460)..(460): n is a, c, t, g, unknown, or other
  misc_feature (470)..(470): n is a, c, t, g, unknown, or other
  misc_feature (483)..(483): n is a, c, t, g, unknown, or other
aagctggagctccccgcggtggcggccgctctagaactagtggatcccccgggctgcaggaattcgcacgagaccattacctagaacatcctaatcgaaaagctgaggctgcaaaacttcaatcttctgatgctagtaggttccttagtaatgtacatggctgcgcattgggtggtccaacaagcagactcgcagtgcatagctctggttttacctaccaatgtgtaggcttcaatgaatctattggattctcagaggtcttgcaaggtcaagaaatttctcgggcggttcctaagttccaaggaatgatgtcggaagcttgttcactgaaagacagatatgggctgcatagttatatgcgtgccccagttgctgttaatggattatcagctacaactcaagaatgttctctcgcactatctactcccgcaggagcacaagtgccctctctctaccctgntaatgttgtnaacggaactgtgnttcccacacttggactggcaagaagttttggtggtggaggtacaatggccagcatcttgcccatttgataggccaggggaactttggaccagcccccgcttgaaaaccctgaccaaaaggactttggatccttttagaacaaaaaaaacctcccggcccgaaaaactccaaacctttgggcctgggggagggaagttcccaaaaaaacgtcccaattttttggtttccc

SEQ ID NO: 52106 - protein, 182 aa, Zea mays
  misc_feature: Ceres CLONE 1467858-F
  misc_feature (153)..(153): Xaa is any aa, unknown, or other
  misc_feature (161)..(161): Xaa is any aa, unknown, or other
AGAPRGGGRSRTSGSPGLQEFARDHYLEHPNRKAEAAKLQSSDASRFLSNVHGCALGGPTSRLAVHSSGFTYQCVGFNESIGFSEVLQGQEISRAVPKFQGMMSEACSLKDRYGLHSYMRAPVAVNGLSATTQECSLALSTPAGAQVPSLYPXNVVNGTVXPTLGLARSFGGGGTMASILPI

SEQ ID NO: 52107 - DNA, 774 bp, Zea mays
  misc_feature: Ceres CLONE 1467859-F
  misc_feature: Translation starting site: 159
  misc_feature (404)..(404): n is a, c, t, g, unknown, or other
aaagctggagctccccgcggtggcggccgctctagaactagtggatcccccgggctgcaggaattcgcacgagaccattacctagaacatcctaatcgaaaaacagtcgcatctcgcctccagcagggtgagttcgcctcggcagggtgtggcataccatggagagctcgtcgccgtcagtgccgttcccgctgctgcaggcgccggtcgagagcacctaccgcgcctgcaccatcccctaccgtttcccctccgacaacccgcgcaaggccacccctgtcgagatccaatggattgacctctttctcaactctgtcccgtccttcaaacagcgggcggaagaacgacccccacgtaaccgatgcgcccgcgaaagccgagaagttcgcgcagaggtacacgtncatgccttgaaaactcaaagaagaatccggagagccattggaagaacacccagatggcatacttcttttgtaggccttcgtgagctaatacctcaaaaagctgggatttagggaatacttcagaagggtcaaggataaagaaaaatcccagggttttttccttttttagggggattttttaacgggaatggcacaaattggagataaccggcaaaaaaaattgaaaacttggcccccgggaaatttttacccggaaaacattttttaaattaagaactccccccccctttgaaaaaattttttttccaaaaaaagggcgttgtttttttggggagagttcccacaaaaactttttttccccccccccggg

SEQ ID NO: 52108 - DNA, 716 bp, Zea mays
  misc_feature: Ceres CLONE 1467862-F
  misc_feature: Encodes the peptide sequence at SEQ ID NO. 52109
  misc_feature (679)..(679): n is a, c, t, g, unknown, or other
aagctggagctccccgcggtggcggccgctctagaactagtggatcccccgggctgcaggaattcgcacgagaccattacctagaacatcctaatcgaaaaaagttccagccgtggcgccgagccctactcctcccgccgccgccgcagattcttcctcgcgactcgccgctcgcccgactttccgagctccgacacaaaggagcaccatgggagagccgatcaaggagctcctggacctgccctccgaccccaggcctcccgcctccttcatcgagtcgcttctcgctggcagggagcagcagcagcaggataaggagggaaagcgtaagttgggggcgtccactgatcccctacccaaaagccaagttatcgggaaagtgaaggatttcttgggggagattgcaagggccaaccagaagttgcagcttgatgcacagaacaagcctcctgtggagtacgatattgaagcccttactgggaacgaggagcaatacattgagatggatctgcttctaggtgtcgctgatcttcattcagagcaggctgtggaggcagctgaagcgacaataaacggccgccagacttcagaaatgtcatttgcttgcagctcatctgactcggaagatgatagtgatgacagcgatgaagatgctgatgacaaacctgtcatgtctgancaagataataaatgtaaaagtcctgatgacgcggaga

SEQ ID NO: 52109 - protein, 169 aa, Zea mays
  misc_feature: Ceres CLONE 1467862-F
  misc_feature (157)..(157): Xaa is any aa, unknown, or other
MGEPIKELLDLPSDPRPPASFIESLLAGREQQQQDKEGKRKLGASTDPLPKSQVIGKVKDFLGEIARANQKLQLDAQNKPPVEYDIEALTGNEEQYIEMDLLLGVADLHSEQAVEAAEATINGRQTSEMSFACSSSDSEDDSDDSDEDADDKPVMSXQDNKCKSPDDAE

SEQ ID NO: 52110 - DNA, 703 bp, Zea mays
  misc_feature: Ceres CLONE 1467864-F
  misc_feature: Encodes the peptide sequence at SEQ ID NO. 52111
caaagctggagctccccgcggtggcggccgctctagaactagtggatcccccgggctgcaggaattcgcacgagaccattacctagaacatcctaatcgaaaaaggaaagcaaagcgcttcgcaagcacaggcagtgatcggcaaccaaatccggacagtcttgagctctctcagtctcagcatttcagttcccagattcacatagccccagccccacaagtagcgaaatggcagctgctccgttcgcaattgccggccggctctcccccgttgcgcgcctcccggtccgcgcctggaggccggcgcacgggtttgcgtcgtccgggagagcccgctcgctcgccgtggcgtccgcggcgcacgagaacagggacaacagtgtcgacatacaggttagccagaacggcggcaacacgcagcagggcaacgccgtgcagcgccgcccgcgccgcgcgacagcgctcgacatctccccatccccgttcgggttagttgatccgatgtctccgatgcggacgatgcgacagatgctggacacgatggacaggctgttccacgactccgtggggttccccatggggacacggaggtccccgggcacaccggcaacgtacgcctgccgtgggacatcccggaggaccataaggaggtaaaatgcgaatcgacatgccgggcctcgcgcgagagaaggtgaagtaatgg

SEQ ID NO: 52111 - protein, 141 aa, Zea mays
  misc_feature: Ceres CLONE 1467864-F
MAAAPFAIAGRLSPVARLPVRAWRPAHGFASSGRARSLAVASAAHENRDNSVDIQVSQNGGNTQQGNAVQRRPRRATALDISPSPFGLVDPMSPMRTMRQMLDTMDRLFHDSVGFPMGTRRSPGTPATYACRGTSRRTIRR

SEQ ID NO: 52112 - DNA, 699 bp, Zea mays
  misc_feature: Ceres CLONE 1467868-F
  misc_feature: Encodes the peptide sequence at SEQ ID NO. 52113
  misc_feature (414)..(414): n is a, c, t, g, unknown, or other
  misc_feature (470)..(470): n is a, c, t, g, unknown, or other
  misc_feature (496)..(496): n is a, c, t, g, unknown, or other
  misc_feature (507)..(507): n is a, c, t, g, unknown, or other
  misc_feature (653)..(653): n is a, c, t, g, unknown, or other
ctggagctccccgcggtggcggccgctctagaactagtggatcccccgggctgcaggaattcgcacgagaccattacctagaacatcctaatcgaaaaattcttccagcttccaggctctacgccgcttctagcgccccgatacgcggcgccggcgcaggcgtgcagccatggcgatgagctggatccgatcggttgttaggagggccctcatcgctccgaagccgcggggctcccgccagtttactgtcaccgccgccggcggcggcgcgacgcaaaccgaaagggtggcggcggagatggtccgctacgccctcggcggcgccgtgcaccggagctcgccaggttcctccttcgccccctctatttgcgctagtgtgcattagggttttgaggactcgctcatgtgccctgnaccgctgtcgctggtgtgccagaagagcgatgcggatactgaagcaaggcgcctcnaacccctgcaggagaggcgagggcantgccaaagctngtgggttgctcatgctcgctatgtccacgctgctttaccggaggtgcggtgcgctgccccactcatttttgtaaatgcgacatttcttttacaaatgtcgcggaccctcaaagctgcaatgtggtggatccggtttggggccattngatcttgatctgggcggctaggtatagagttttagcttgggaatag

SEQ ID NO: 52113 - protein, 71 aa, Zea mays
  misc_feature: Ceres CLONE 1467868-F
MAMSWIRSVVRRALIAPKPRGSRQFTVTAAGGGATQTERVAAEMVRYALGGAVHRSSPGSSFAPSICASVH

SEQ ID NO: 52114 - DNA, 710 bp, Zea mays
  misc_feature: Ceres CLONE 1467923-F
  misc_feature: Encodes the peptide sequence at SEQ ID NO. 52115
  misc_feature (542)..(542): n is a, c, t, g, unknown, or other
aagctggagctccccgcggtggcggccgctctagaactagtggatcccccgggctgcaggaattcgcacgagaccattacctagaacatcctaatcgaaaactcatctataggctgcgtcgccgcctccaccacaacccccaaaagcttagcggtcgcttgcgccccgccccaccaccgtgggcggtgggcaggagtccctcgtgttcgcgggtgtgatgcaaggccaaaaatacctggtcacggcactaccgacgcccatcaactactcgcccttcatctactcctcctatggcgacaagatgatggtcatctgggacctcaacgaccacatccatggtcaccgaggactccagctccgagtacagcgtccccttccgccgccatcatgggagacggccactttgccaaggacgtcactcctcatttccgatggccatctcgagctctccggatccaggaacatctagctccgcctctgggacctctccactggtgtcaccgcccagcgcttcgtcttgcaagagtaggatgtcatcaacngtcgccttcgtctttgacaacggacatatagtctacgtctcccggcgagcgcagaatcaaggtgcggaacaccgtcggtgagtggaagtactgcacacggcgctgaacattggaacgcgagcaagagccctgcccggatggggcgcccatgcatgcagtttttccacc

SEQ ID NO: 52115 - protein, 83 aa, Zea mays
  misc_feature: Ceres CLONE 1467923-F
MQGQKYLVTALPTPINYSPFIYSSYGDKMMVIWDLNDHIHGHRGLQLRVQRPLPPPSWETATLPRTSLLISDGHLELSGSRNI

SEQ ID NO: 52116 - DNA, 889 bp, Zea mays
  misc_feature: Ceres CLONE 1468016-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (445)..(445): n is a, c, t, g, unknown, or other
  misc_feature (447)..(447): n is a, c, t, g, unknown, or other
  misc_feature (477)..(477): n is a, c, t, g, unknown, or other
  misc_feature (587)..(587): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (690)..(690): n is a, c, t, g, unknown, or other
  misc_feature (744)..(744): n is a, c, t, g, unknown, or other
  misc_feature (880)..(880): n is a, c, t, g, unknown, or other
nnnaaaacccccccaacccccccagacccccccgnntttttttcnnnnntaaaactggagctccccgcggtggcggccgctctagaactagtggatcccccgggctgcaggaattcgcacgagaccattacctagaacatcctaatcgaaaaaatcgagcatcgcatagataggcgtcttcgtactcgcctacctccgcggctcaaacctttcccccttctcccaattccctccgtcggccgccgctccatcccgtacgactacgccatgagggagtgcatttcgatccacatcggccaggccggtctccaggtcggaaacgcgtgctgggagctgtgcggcctgggagctggggattaagggatgannnncagatgcccggtgacggaaccctgtaggggaggtgaggatgtatagccaccgcctagcttccgcgacactgggngntccggaaccacagttgagcctttgcttgcntttttaccccacccagtgaacccagcggaccctcctccatcaacgttccaggattgccatttcttagcggccccagctccttaccaccccccgaaggaggctcccactcngnnngggggaaaggagacctacgtcccttcctnnncccaacttttgccaccccggggcgccctcctacacagcggtctcgttcaagggtacataattggttgncccctccgacccctgaggactcctagatcggggaacccctctcccccccaccanccctcacaagggtcctcccccagggacactccctggcctcctccccagaccctcttgtgcaagaaaaagcacccgcgcttccgcctcgccctggggttcacatccccgtaaaaaagagcgggggaaatgtccagcncacataaac

SEQ ID NO: 52117 - DNA, 728 bp, Zea mays
  misc_feature: Ceres CLONE 1468019-F
  misc_feature: Encodes the peptide sequence at SEQ ID NO. 52118
  misc_feature (285)..(285): n is a, c, t, g, unknown, or other
  misc_feature (315)..(315): n is a, c, t, g, unknown, or other
  misc_feature (401)..(401): n is a, c, t, g, unknown, or other
  misc_feature (402)..(402): n is a, c, t, g, unknown, or other
  misc_feature (471)..(471): n is a, c, t, g, unknown, or other
  misc_feature (472)..(472): n is a, c, t, g, unknown, or other
  misc_feature (478)..(478): n is a, c, t, g, unknown, or other
  misc_feature (505)..(505): n is a, c, t, g, unknown, or other
  misc_feature (506)..(506): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (534)..(534): n is a, c, t, g, unknown, or other
  misc_feature (555)..(555): n is a, c, t, g, unknown, or other
  misc_feature (556)..(556): n is a, c, t, g, unknown, or other
  misc_feature (564)..(564): n is a, c, t, g, unknown, or other
  misc_feature (565)..(565): n is a, c, t, g, unknown, or other
  misc_feature (575)..(575): n is a, c, t, g, unknown, or other
  misc_feature (576)..(576): n is a, c, t, g, unknown, or other
  misc_feature (598)..(598): n is a, c, t, g, unknown, or other
  misc_feature (623)..(623): n is a, c, t, g, unknown, or other
  misc_feature (631)..(631): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (701)..(701): n is a, c, t, g, unknown, or other
  misc_feature (712)..(712): n is a, c, t, g, unknown, or other
  misc_feature (713)..(713): n is a, c, t, g, unknown, or other
  misc_feature (724)..(724): n is a, c, t, g, unknown, or other
  misc_feature (725)..(725): n is a, c, t, g, unknown, or other
aagctggagctccccgcggtggcggccgctctagaactagtggatcccccgggctgcaggaattcgcacgagaccattacctagaacatcctaatcgaaaaatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcngcggcggtgagctgcggcgaggtgacgtcntcggtggcgccgtgcctcgggtacgcgatgggcagcgcggcgtcgtcctctgcggcccgctgcagcggggggcgctcgctcaaaanncgcgcgtcctcaatagtggaccggcaggccacctgcaactgcctcaagagcatgacggggcggttccgnngccttntatacattgcccaactcctccaaaatnnccctcnnntgggggggcctcactccggngtaccccatcaacaccaccgnnaaactganncaacatccanngatcccaacaaaccctcacggngagcacccccccaccttcatcgggnaaccacanttgaccattnnnaccaaagatacccatcgtccatannnaacaaataacacacaacannnnatatacatgntcacaatcccnncctcaaaacgnnatg

SEQ ID NO: 52118 - protein, 164 aa, Zea mays
  misc_feature: Ceres CLONE 1468019-F
  misc_feature (73)..(73): Xaa is any aa, unknown, or other
  misc_feature (97)..(97): Xaa is any aa, unknown, or other
  misc_feature (99)..(99): Xaa is any aa, unknown, or other
  misc_feature (108)..(108): Xaa is any aa, unknown, or other
  misc_feature (110)..(110): Xaa is any aa, unknown, or other
  misc_feature (111)..(111): Xaa is any aa, unknown, or other
  misc_feature (125)..(125): Xaa is any aa, unknown, or other
  misc_feature (127)..(127): Xaa is any aa, unknown, or other
  misc_feature (128)..(128): Xaa is any aa, unknown, or other
  misc_feature (131)..(131): Xaa is any aa, unknown, or other
  misc_feature (139)..(139): Xaa is any aa, unknown, or other
  misc_feature (147)..(147): Xaa is any aa, unknown, or other
  misc_feature (150)..(150): Xaa is any aa, unknown, or other
  misc_feature (153)..(153): Xaa is any aa, unknown, or other
  misc_feature (154)..(154): Xaa is any aa, unknown, or other
  misc_feature (162)..(162): Xaa is any aa, unknown, or other
MAARSSSSQPQLVAAAAVLAAALLLLAAGAGTASAAVSCGEVTSSVAPCLGYAMGSAASSSAARCSGGRSLKXRASSIVDRQATCNCLKSMTGRFRXLXYIAQLLQNXPXXGGPHSGVPHQHHRXTXXTSXDPNKPSRXAPPHLHRXTTXDHXXQRYPSSIXNK

SEQ ID NO: 52119 - DNA, 836 bp, Zea mays
  misc_feature: Ceres CLONE 1468022-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (433)..(433): n is a, c, t, g, unknown, or other
ttttttttcttnnnnnttttttttgttcttttctttccgacagggttttttttcaagctggagctccccgcggtggcggccgctctataactagtggatcccccgggctgcaggaattcgcacgagaccattacctagaacatcctaatcaaaaactcaccttccaactaacctgtttctatttgtattgggagccttgccgtgccggaatattcccctccggcagcctccctggcttcctccccgcgccgccccgccaaccaaacccaacggtggcaccacctcttccttcctcctcctttccttccgcgacaggagaccccctcgcccccgaattaattgcagctgaaggaacccaaggcggcatccatcgatgatgatgctcaccaaggagttcgccctatcgccgccgccatgtgttgtggggtttccnaaagacttcggagagggtcgttcccatcggcccctcgatgggggtttgttgggtgccccgaacctatggctgcaggacccgccgaccccccggtccccagctttccggccgcccacccgggatttcgccaggcgacccctctggcccttaatgggtcgaactggctacttttgggcaatggctgcgtccccccgaactttccctccaataaaacgggggccaacccacctgggttcccgggaagaacttccccggcatataatttggcggagaagagggaatatcgcggggttttcctccggaaacttttgggcccaccttttgcgggaggcaacggaatcttccaaatgttttgaacgaccctggcggggcctaatcactcatgacaagggaataatcgtgt

SEQ ID NO: 52120 - DNA, 735 bp, Zea mays
  misc_feature: Ceres CLONE 1468023-F
  misc_feature: Encodes the peptide sequence at SEQ ID NO. 52121
  misc_feature (425)..(425): n is a, c, t, g, unknown, or other
  misc_feature (435)..(435): n is a, c, t, g, unknown, or other
  misc_feature (437)..(437): n is a, c, t, g, unknown, or other
  misc_feature (513)..(513): n is a, c, t, g, unknown, or other
aagctggagctccccgcggtggcggccgctctagaactagtggatcccccgggctgcaggaattcgcacgagaccattacctagaacatcctaatcgaaaaacccaaaaaccccagcgcacccaacccaagagcgaaaatggatccgcaccagttcgccccctcccagcagtcggcgctgaccatggaatcggcggagagcacggccgccgccgccgcgcgggcgtccaacggcgctgcccgagctgtcgtcgaggacgacgacgaggacgacgacgtccccgaggtggccgcctgcatatcgacgatgctcgaccgcgggggtagcgtggagagccaccgcctcttcctggcgcgccgcaccgcgctggagatgctccgcgacccgcggtacgccgttccgggagaagagctcgcccgcacccntccgggagtncngcgcctggtggggatacaggcccggagctcgaaagcctcggctttctccactaccctcacctcgaacccgtccagnaaggtgaaagtggtttcctgtccacctgggacctgtcaaaatcccagcttatccggctgaattttcccgaagtcaaaaaagaaacctggtccaaactgatttctgaatctggcggggaaaaaaatggctccaaccggaaaaccccccggggaaactttccgctttaaaggtgaccctttccaaaacccggaattcggggggaaaacccctaaagggtgcccc

SEQ ID NO: 52121 - protein, 144 aa, Zea mays
  misc_feature: Ceres CLONE 1468023-F
  misc_feature (57)..(138): Pfam Name: RNA_pol_Rpb5_N Pfam Description: RNA polymerase Rpb5, N-terminal domain
  misc_feature (96)..(96): Xaa is any aa, unknown, or other
  misc_feature (100)..(100): Xaa is any aa, unknown, or other
  misc_feature (125)..(125): Xaa is any aa, unknown, or other
MDPHQFAPSQQSALTMESAESTAAAAARASNGAARAVVEDDDEDDDVPEVAACISTMLDRGGSVESHRLFLARRTALEMLRDPRYAVPGEELARTXPGVXRLVGIQARSSKASAFSTTLTSNPSXKVKVVSCPPGTCQNPSLSG

SEQ ID NO: 52122 - DNA, 712 bp, Zea mays
  misc_feature: Ceres CLONE 1468024-F
ggagctccccgcggtggcggccgctctagaactagtggatcccccgggctgcaggaattcgcacgagaccattacctagaacatcctaatcgaaaactcctttccccttggccgccgccccccctgcccacctcctcctccctccattgttgcagccaccaaaaccctagccgcccccccccaatcccctcctccctaggtgctactccgtgtcgctcggatcatcgtcttttggtgcgaatctccaatcgttttggtggaaggaacaagcggaggaaggaaaaggcgacaacccatagtggaggacttcccgatcgttcatagtgattttgcacgaacttcggtaaaagcacctgatctttgctttgagatgcaaggatgtagcacccccgcctccccacttttaaatcaaccgaataactcactaataccgacgccaaaccggaaaaatccaggccaaggaaattattacttttaaccctacacggaaatttaaacctttaatttgggggggcaaaaaattccttttttttcccgggccgtgaaaattcctttttaccccggggggttttttttccaaacccgggaaaatattccttttcttaaaaaaaaaaaaaaaaaaaagtttttaaaaaacccgccaccaccaaggggggggcccggaaacaaaattcccccttatagaggggaggaaatactcgcgccccccggg

SEQ ID NO: 52123 - DNA, 691 bp, Zea mays
  misc_feature: Ceres CLONE 1468027-F
  misc_feature: Encodes the peptide sequence at SEQ ID NO. 52124
tggagctccccgcggtggcggccgctctagaactagtggatcccccgggctgcaggaattcgcacgagaccattacctagaacatcctaatcgaaaaggaacccacctgctgcgcacctgcaagcctcgagtggagctcttccacggccgcggtggagatggcggcgaatctggaggacgtgccgtcactggatctgatgcacgagctgctccgccgcatgaagtgcagctccaagcccgacaagcgcctcatcctcatcggtccacctggctctggaaagggaactcagtctcctattatcaaggatgactattgcttgtgccatttagccactggtgatatgctgagggctgctgtggcggccaagacacctctaggtatcaaagctaaagaagctatgaataagggagagcttgtttcacatgatttggttgtgggcattattgatgaagctatgatgaaaccctcatgccagaaaggtttcattcttgatggctttcctagaactgtcactcaagcacagaagcttgatgagatgttggcaaagcaaggtgccaatgttgacaaagtcctgaacttttgcattgatgatgctgtattggaagaacgattactggtcgttgatcactcagcagtggaggacttacactcaaattgcactccagtctcagagtgatgatgactgaagca

SEQ ID NO: 52124 - protein, 172 aa, Zea mays
  misc_feature: Ceres CLONE 1468027-F
  misc_feature (33)..(163): Pfam Name: ADK Pfam Description: Adenylate kinase
  misc_feature: SWISSPROT Homolog: EC 2.7.4.3 Adenylate kinase
MAANLEDVPSLDLMHELLRRMKCSSKPDKRLILIGPPGSGKGTQSPIIKDDYCLCHLATGDMLRAAVAAKTPLGIKAKEAMNKGELVSHDLVVGIIDEAMMKPSCQKGFILDGFPRTVTQAQKLDEMLAKQGANVDKVLNFCIDDAVLEERLLVVDHSAVEDLHSNCTPVSE

SEQ ID NO: 52125 - DNA, 718 bp, Zea mays
  misc_feature: Ceres CLONE 1468030-F
  misc_feature (382)..(382): n is a, c, t, g, unknown, or other
  misc_feature (408)..(408): n is a, c, t, g, unknown, or other
aagctggagctccccgcggtggcggccgctctagaactagtggatcccccgggctgcaggaattcgcacgagaccattacctagaacatcctaatcgaaaatttatttaggtgccttgatctcaatggaaggggtttccttacaactgcagatattcatactctatttagagacgtacaccagaaatggattgagggagggaactatgagctttgcatagaagacgtgagggatgaaatctgggacatggtgaaacccgcagatcctctcaggatctcgctatcagaccttctttcttgcaagcaaggtgggactgtcgccagcatgcttatagatgtgcgtggcttctgggccacgacacagggagaaccttctccagaangaggaagacaagtggaagagcatgangtctcagctgccaggtaacggtacctgttgctcaaaattgcaacatcctcgggactgcctgtaccgcagtatccgccatggaacccaaaatggggataaaatcggcccccccagtttcctgaacttaaactttgttttaaatgggccaaaagggccctccaaacttgttaaggttaccttaccccccttggcccatttgacctcatcccgggagggccggaatccccgggccccgggttggactcttaattttgccaaagggcgcatttcccttatcttgaaaaagggaatccccccgggaaaataataa

SEQ ID NO: 52126 - DNA, 711 bp, Zea mays
  misc_feature: Ceres CLONE 1468031-F
  misc_feature: Encodes the peptide sequence at SEQ ID NO. 52127
ggagctccccgcggtggcggccgctctagaactagtggatcccccgggctgcaggaattcgcacgagaccattacctagaacatcctaatcgaaaacttgccttcgtctccgcctcccgtctttcctcaagaagtcgattcccttccccaagaacccaagcccccaccatgacaagctcctcctctccttcccgaaaggcgctgagcaagatcgcttgcaatcggctgcagaaggaactcgccgagtggcaactcagcccccctgctgggattcagcacaaggtctccgataacctacaaaggtgggtaattgaggtcactggagcggcgggcaccctttacgccggcgagacctacccagtgcagggtgacctccctgagcattatcctatggaggcacctccgggccatttttcctcatccaggggcaatggttccacaattcttacgaaaagggggaattcggcttaaaaatttttgaaaaaacccggggcccccccacaagacccggaaactccggccgaaaaaaaccccggccattgttggccaagtcccccccaaaaacaccccccggggaaaaaacccctttttttaggaatcccccaccgggtgggccccaaaaaacaaaaaggtgttcccccaaacaccgggatattagccccccaacccccccctgggggggaattttccgagggggaagggggaattttt

SEQ ID NO: 52127 - protein, 100 aa, Zea mays
  misc_feature: Ceres CLONE 1468031-F
  misc_feature (19)..(101): Pfam Name: UQ_con Pfam Description: Ubiquitin-conjugating enzyme
  misc_feature: SWISSPROT Homolog: EC 6.3.2.19 Ubiquitin--protein ligase
MTSSSSPSRKALSKIACNRLQKELAEWQLSPPAGIQHKVSDNLQRWVIEVTGAAGTLYAGETYPVQGDLPEHYPMEAPPGHFSSSRGNGSTILTKRGNSA

SEQ ID NO: 52128 - DNA, 847 bp, Zea mays
  misc_feature: Ceres CLONE 1468032-F
  misc_feature (13)..(13): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (434)..(434): n is a, c, t, g, unknown, or other
  misc_feature (435)..(435): n is a, c, t, g, unknown, or other
ccctttttttcgncggccctttgttggggcgtgannacaacnnnnnnnnccaaactggagctccccgcggtggcggccgctctagaactagtggatcccccgggctgcaggaattcgcacgagaccattacctagaacatcctaatcgaaaatttatttaggtgccgtgacctcaatggaaggggttgagttagagctgccgaaatgcacactctcttaaccgtcgtacacgacagctgtattgagggaggcaactatgaccttcgaattgaagacgtgagggatgaaatctgcgcagtggtgagagcgggagatcctctccagatgtcgctatcagacctctctttctcgaaatcaagggagggactgtcctccgccacgctaagtagatgtgcggggcttcctgggtcgcgcaacagtggggagaaagggtnnccaaggagaataaaaaaccaaggggattgagagttttggtccccaaccccccggggaatgtaacccggtaacttggggggggccccaaaattggtgtaattctccggggaaatggccttggttccccaaatgttgcgggagttttgccccccacggaaaatgcgggggttaaagaacattgtcggggtcccagtgttttctgcaagccgtgaagcatggggtgttaaaaaggggtgggccacaacggggcgctgaaaaaatgtgggggggaggggaagtgggaggctcccctcccgggaccttattctcgaagaatcttgcgcgtggggggggggagatgcttcccgcgcaccaaccaaatctcaccccgtgtggttgttttggcaccaaagcgggtggtctcttatagccg

SEQ ID NO: 52129 - DNA, 693 bp, Zea mays
  misc_feature: Ceres CLONE 1468033-F
  misc_feature: Encodes the peptide sequence at SEQ ID NO. 52130
  misc_feature (340)..(340): n is a, c, t, g, unknown, or other
  misc_feature (379)..(379): n is a, c, t, g, unknown, or other
  misc_feature (420)..(420): n is a, c, t, g, unknown, or other
ctggagctccccgcggtggcggccgctctagaactagtggatcccccgggctgcaggaattcgcacgagaccattacctagaacatcctaatcgaaaaattctcctttctccctcttgtgtcttccaccaggaacaagccgccgccgcacgcctccgcttgctcccacccgcgcccgccggtgcacccgccccggccccgcccgtcgcggctgcccccaccccgcccgcccctaccaccggcgcggccgcctccggccccggccccaaacgctgcacccaacagccccagccgtcccactcccaggggtcatctcagtcgccgtcgcagacacgcagcangcgtcaccccagcagcagcaggtggcggcggtggcagcngcataagcacaagcacagacccaggcggcatgggtaccaancccccaaaatggaaatggccctgcaagaacccatgcgggtctgcaatccggaattaattacccctttccagcccctcagggaacctttcaacgggtgtcaattggcgagggggattttttttccccccggcccttctttggctgaggagcccccccttttggtccccccgttgtgttttcaatggggggaaaaaccctggggaaggcccaattttttccaaaccccccccttttcccccgggggggctcccccgggaaattttccaacccccc

SEQ ID NO: 52130 - protein, 88 aa, Zea mays
  misc_feature: Ceres CLONE 1468033-F
MEMALQEPMRVCNPELITPFQPLREPFNGCQLARGIFFPPGPSLAEEPPLLVPPLCFQWGEKPWGRPNFFQTPPFSPGGAPPGNFPTP

SEQ ID NO: 52131 - DNA, 741 bp, Zea mays
  misc_feature: Ceres CLONE 1468041-F
  misc_feature: Translation starting site: 169
  misc_feature (383)..(383): n is a, c, t, g, unknown, or other
atagctggagctccccgcggtggcggccgctctagaactagtggatcccccgggctgcaggaattcgcacgagaccattacctagaacatcctaatcgaaaaaaaaaagaaaaaaaccacaaagagattcctctcaccaccaccaaccctagacgatcctcctccgccatgatgcgggacggcgtgcctccgtcggtggccggctccggcggcgcggcgggcggcgacgggcccaggcgatgctcgcagtgcgggcaccacgggcacaacgcgcgaacctgcacggcgcggcccgtcaagctcttcggcgtgcgcatcggggacaagcccatccggaagagcgccagcatgggggacatcgcgcacctcgccgcggagggcancggcggcagggaggaagggtacggctcccacggggaccgcccgcccagaaagcgaggggagccttggactgaaaagcaccacataagtttctgcttggggtaaataactagggaaaaggggattggcgggggtttccccgaaatattgttgtttccaggaacccaaaccaaggggtttgccttggcgcaaaatttttcccccccccaaaaaaaggggccaaaaaaaaaagaaaaaaacaccccctcccatttgggggattgaaaccccccccggaaaaaaatttcccccctcccgcggttcctttcccccaaaaggggggcaccccccttcttttaggtacccccaccccgtgtgggg

SEQ ID NO: 52132 - DNA, 662 bp, Zea mays
  misc_feature: Ceres CLONE 1468045-F
  misc_feature: Translation starting site: 162
  misc_feature: Pfam Name: PAP2 Pfam Description: PAP2 superfamily
  misc_feature (547)..(547): n is a, c, t, g, unknown, or other
  misc_feature (585)..(585): n is a, c, t, g, unknown, or other
  misc_feature (586)..(586): n is a, c, t, g, unknown, or other
aaagctggagctccccgcggtggcggccgctctagaactagtggatcccccgggctgcaggaattcgcacgagaccattacctagaacatcctaatcgaaaaatctggatggaattccaaaccaattccacaagctttcccaatcgccgctgccggcgcgcatggcaaacgcagccacctcgccgccggcgccggcgctgtcaaggcccaccctcctaggcggcgtccggggcttcgacgcggctgtgtccctccgcctccacgcccttttcctcccggtgccgcgcctcctcctcaaggcgctcgaggtcgccggcgacggccgcatctggctccccgtccccatctccctgctcctcctctccgcgtcccccgccaacgcgtccggggcggcctccccgctgctggcaggccttgttgccggcctcgtgctggacctcatcctcgttggcctcgtcaaggtcttcgtccgccgcccgcgcccggcctacacgccaaggacatgtacgtggccgtaagcgctgaccactggtctttccccagcggncactcttcccgcgccttcctcgtggcctccttcctcgnncgcggcggcttccgtccccgtgaggggctcttcctctggggcgcgcaacgtcggcgtccagggtgctcctgggcgg

SEQ ID NO: 52133 - DNA, 862 bp, Zea mays
  misc_feature: Ceres CLONE 1468046-F
  misc_feature: Encodes the peptide sequence at SEQ ID NO. 52134
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ttttccctcttccggggcgcnnncnnnnnttttnngggggcccnnnnccatagctggtgctccccgcgggggcggccgctctattctagtggatcccccgggctgcaggaattttcacgagaccattacctagaacatcctaatcgaaaaaaacccaacctcccttttcggagatctcgccgcctccgccggcgacttccgtcgcccccctatcccgcgtccgggcttacccgatggcacggctgcactgccttgaggctgtcctgcccctggggatcatcggcggcatgctctgcatcatgggcaacggccagtatttcatccaccatgccgcgcacggcgggccgaagcacatcggggaacgatatgtggggcgttccccctgcagcgccgcgcacaagaagcgggggggaaggttgattgggggggttaaaactattgaattagacaaccatactctttcgggaatctccgagggggggggcttttcaaaaagccacaaaaaatggcggctactttgtggtgttcctggtagacattgggtaacccgggaacgtggtaaggccttggcgcttcgggaactccccctgcggtctcgggaagaactaattcctgccgcttgggaacgtccgggttttgtttggtaacaatagatgccaaaaacctctgcttaaagtggcccgaaggagagcccattaggtgcgcggccccccgggggcccgaaccccaggaaattacggagataaccatgggggttgtcgccccccgcggtaggggggctggtcggctctaaatcaagaacccaaaagatctgtgctctctctcccaggcccgcgccaagctccgcaggacgggcccgccg

SEQ ID NO: 52134 - protein, 137 aa, Zea mays
  misc_feature: Ceres CLONE 1468046-F
MARLHCLEAVLPLGIIGGMLCIMGNGQYFIHHAAHGGPKHIGERYVGRSPCSAAHKKRGGRLIGGVKTIELDNHTLSGISEGGGFSKSHKKWRLLCGVPGRHWVTRERGKALALRELPLRSREELIPAAWERPGFVW

SEQ ID NO: 52135 - DNA, 637 bp, Zea mays
  misc_feature: Ceres CLONE 1468047-F
  misc_feature: Encodes the peptide sequence at SEQ ID NO. 52136
  misc_feature (215)..(215): n is a, c, t, g, unknown, or other
  misc_feature (217)..(217): n is a, c, t, g, unknown, or other
  misc_feature (218)..(218): n is a, c, t, g, unknown, or other
  misc_feature (264)..(264): n is a, c, t, g, unknown, or other
  misc_feature (266)..(266): n is a, c, t, g, unknown, or other
  misc_feature (267)..(267): n is a, c, t, g, unknown, or other
gggagctccccgcggtggcggccgctctagaactagtggatcccccgggctgcaggaattcgcgcgagaccattacctagaacatcctaatcgaaaaacgctccccggaacgaacgacgcagcccaacccgttcccaccaaaccagcggcaccacccatggcttcggcggcggcgagatccggtctccggtcgctgggcgtgcgcgccggcccgntnngagcgcgcatgtcctcctcccgtcacgacgacgcctatgagacggncnnagtggagaagatcacctacgccgggatcttgacctgcacccctcctgcggcgtacaaactggccaagggcaacccccacttcgattgagccggcgggggtacccctttttggacatccccaaaaaagggaatcccctgggggcccctgaaggttttgtttaaaacaaaaggaccccccctggacccctcgtttgaccccttttcgggaacggggggccggctttaaaaaaaaatatttggggggtttccagagaattttccttttccccctgaaaaaccttttttgtgggccacaaaaaaaaaaaaaaagaccacccccttttttttttgcacggggggggtttaaaaggggggtaggccgtcccccccc

SEQ ID NO: 52136 - protein, 65 aa, Zea mays
  misc_feature: Ceres CLONE 1468047-F
  misc_feature (20)..(20): Xaa is any aa, unknown, or other
  misc_feature (21)..(21): Xaa is any aa, unknown, or other
  misc_feature (36)..(36): Xaa is any aa, unknown, or other
  misc_feature (37)..(37): Xaa is any aa, unknown, or other
MASAAARSGLRSLGVRAGPXXARMSSSRHDDAYETXXVEKITYAGILTCTPPAAYKLAKGNPHFD

SEQ ID NO: 52137 - DNA, 692 bp, Zea mays
  misc_feature: Ceres CLONE 1468048-F
  misc_feature: Encodes the peptide sequence at SEQ ID NO. 52138
  misc_feature (602)..(602): n is a, c, t, g, unknown, or other
aagctggagctccccgcggtggcggccgctctagaactagtggatcccccgggctgcaggaattcgcacgagaccattacctagaacatcctaatcgaaaaaaaaaaggcgcaagcaccgcacggagagcaagcaagaaagcaaccaccgcactgccactacctaacaatggcccgcgcctacgtgtttctcgtcgtgctcctcctggccgctgtcatcgtggcaccgttcgcgggagcgacgcgtgtcgacgtcgttgagggcaggtccatggcgtccgccgacgcgccggaggccgccgcaccatcacccgggcctgactccgcctcgtcaccggactcctcgtcggatgcgccctccagcagcagctcctcggactagatagctagccgctcgacgcacgatctcgctctccatctacacggcgatcgagttctagctttgtcggcatgcaatgcaaaattccgattcttcgggaataatcaagcaccaaaggaatgtgttggcatcactcactactagtaccttgtttttatatatgtttcctctcctgacgctctccgattttaatcttcatgtatgcaacatatgtgatgaatggnaaaatcgatttgtatttgttagtcagtcagtctgtattacaacgccttcgggttctgaaaaaaaaaaaaaaagcttatcgatccgtccac

SEQ ID NO: 52138 - protein, 70 aa, Zea mays
  misc_feature: Ceres CLONE 1468048-F
MARAYVFLVVLLLAAVIVAPFAGATRVDVVEGRSMASADAPEAAAPSPGPDSASSPDSSSDAPSSSSSSD

SEQ ID NO: 52139 - DNA, 678 bp, Zea mays
  misc_feature: Ceres CLONE 1468050-F
  misc_feature: Encodes the peptide sequence at SEQ ID NO. 52140
  misc_feature (399)..(399): n is a, c, t, g, unknown, or other
aagctggagctccccgcggtggcggccgctctagaactagtggatcccccgggctgcaggaattcgcacgagaccattacctagaacatcctaatcgaaaacccaatccccctcgtctcacaaccctagctgcccccgaatccatggatcctaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccagcaggcggcggccgcgcagcagcagcagctgcagatattctgggcggagcagtacagcgagatcgatgccactaccgacttcaagaatcacaacctcccgctcngccggatcaagaagatcatgaaaaccgactaggacgtccgcatgatcgccgccgaagctcccgtggtggttcgccggggctgcgaaaatgtcatcctcgaacccaacccatccggctgggggccacccccaaaagaacaaccgcccccccctcccaaaacccaaaattggcgcttccatcccccccacccaaggaattcaaactcccttggggaaatccttcccggcaaaaaaagaaaaaaaccttaaagggggggccccccaattgccggggtgtggg

SEQ ID NO: 52140 - protein, 95 aa, Zea mays
  misc_feature: Ceres CLONE 1468050-F
  misc_feature (86)..(86): Xaa is any aa, unknown, or other
MDPNKSSTPPPPPVMGAPVAYPPPAYPPGVAAGAGAYPPQLYAPPAAAAAQQAAAAQQQQLQIFWAEQYSEIDATTDFKNHNLPLXRIKKIMKTD

SEQ ID NO: 52141 - DNA, 724 bp, Zea mays
  misc_feature: Ceres CLONE 1468056-F
  misc_feature: Encodes the peptide sequence at SEQ ID NO. 52142
  misc_feature (338)..(338): n is a, c, t, g, unknown, or other
aagctggagctccccgcggtggcggccgctctagaactagtggatcccccgggctgcaggaattcgcacgagaccattacctagaacatcctaatcgaaaactagcccgctacccctgccccttctctcttcgtcgcgcctccgcctccgccgtcgtagcatcctcctccgccacctcggccatggcgacatccccagcgctcctcttcccttctccctcctcggcatcctctgcgccttcgtcggcgcgggtggaggcagtggtgcttttcaacgtctgcgacagctacgtgcggcgcccggaccaggcggaccgcgtcatcggcaccctcctcggnttccctcctctcgacggcacccgtcacgtccgcaactcctatgtcgtcccccacagcgagtcagccgaccaggtcgccatcggaatcgactaccaccattaacttgtacgcctcgcaccagaaggggaacccccaggaagcccaccccggaagttcccaaacggaattgggggttcctggggggaaacccccccccccaaggttttttgaggggaaagaaaaacccccccccctttaaaaggcaaacctggtttttttggggggggggggccctctaaaaaaaaaaatttccaaaattggcccccaaaaaaaaaaaacccccgcccaaatttggaaaaacccccctccgttaaaaaatataaggggggaaaagagggtgttttttt

SEQ ID NO: 52142 - protein, 85 aa, Zea mays
  misc_feature: Ceres CLONE 1468056-F
MATSPALLFPSPSSASSAPSSARVEAVVLFNVCDSYVRRPDQADRVIGTLLGFPPLDGTRHVRNSYVVPHSESADQVAIGIDYHH

SEQ ID NO: 52143 - DNA, 736 bp, Zea mays
  misc_feature: Ceres CLONE 1468057-F
  misc_feature: Encodes the peptide sequence at SEQ ID NO. 52144
aagctggagctccccgcggtggcggccgctctagaactagtggatcccccgggctgcaggaattcgcacgagaccattacctagaacatcctaatcgaaaaaactacaccacaccgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagagccggcaagcttaacgactactgctccccaaagacatcgctatcaaaaatcctggagaagtaccagacccactctggaaagatactgtggggtggagaagcacaaaacccttattgcaaacattgacccgataaagaaagagaacggacccctgcagatcgaggcccaggcccctgaaaggggaaagatctaaaccgcgctgcaaccccaaaaacctgaatctggatccggggaggcccttgggacatggggctgggctaacccggaaaggacaaagcgtatcggccccccggggggaaaagcccttgctacacaaacccctaccaaaaggttgcgagcaacaaccaccaaaattgtggctgggcg

SEQ ID NO: 52144 - protein, 91 aa, Zea mays
  misc_feature: Ceres CLONE 1468057-F
  misc_feature (9)..(59): Pfam Name: SRF-TF Pfam Description: SRF-type transcription factor (DNA-binding and dimerisation domain)
MGRGKIEIKRIENSTNRQVTFSKRRNGILKKAREISVLCDAEVGVVVFSRAGKLNDYCSPKTSLSKILEKYQTHSGKILWGGEAQNPYCKH

SEQ ID NO: 52145 - DNA, 854 bp, Zea mays
  misc_feature: Ceres CLONE 1468058-F
  misc_feature (1)..(1): n is a, c, t, g, unknown, or other
  misc_feature (18)..(18): n is a, c, t, g, unknown, or other
  misc_feature (19)..(19): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (454)..(454): n is a, c, t, g, unknown, or other
  misc_feature (462)..(462): n is a, c, t, g, unknown, or other
  misc_feature (828)..(828): n is a, c, t, g, unknown, or other
nttttttcctccttcccnntctgcgtctttttnnnnnngggaaannnnnnaaaaaatggagctccccgcggtggcggccgctctagaatagtggatcccccgggctgcaggaattcgcacgagaccattacctagaacatcctaatcgaaaatattttttgatgagggtgatgccattgcccccaaaagaactggccctggtgggaattctattggcaatgcccccctccgagaaagacctttgtcgactttattgacccaaatgggaggtttacaactggctccgggaattattgtattgggtggtaccaatcgccccaaggggatgagggtgctttttttcgcacaggggggtgttataaaaggggtgttatgttcccccccccacatggggaaaggggggacaagagaattttttttttctcccccccccggggggggggggggggggganccctcctnctttctttttccccccccccccaggggggggtgggggattaaaaggggggtggggaatcctcaagaaggcccctccccgggagaaaactccgcataggtccctccccctcgggggggagaagaagaatcatccagggggtagtgaagagggagggcccagctactccaaggaagtcctcgagacatagtaaagggaggggaccctcccccctcataaaaaatctcctcgtgctcgcgcggatttctcttatctgggaaccggcggctaatcccccaccgcaagggtggaggcacaaggcgcacccgatggtgaatatattatcttgttgaggaggttttgccggcgcgaacattaaaaccccaccncccctcgcgccgacaaccgtcctccc

SEQ ID NO: 52146 - DNA, 668 bp, Zea mays
  misc_feature: Ceres CLONE 1468064-F
  misc_feature: Encodes the peptide sequence at SEQ ID NO. 52147
  misc_feature (281)..(281): n is a, c, t, g, unknown, or other
  misc_feature (327)..(327): n is a, c, t, g, unknown, or other
aaagctggagctccccgcggtggcggccgctctagaactagtggatcccccgggctgcaggaattcgcacgagaccattacctagaacatcctaatcgaaaaagaacaaggggggaaaaagttgacatacgcttgcagcgatggcctttgccgcccgcgccgcgctcgtgcgcgtcctccctccgcgaccatcgccgacctcccaaccgaagcagctcaagcaaggtctaggcggccgcggcgggtcctcgctcgccgttcgggcgaaggactccgatganctcggggccccttctgtcggagaagctcgatgcgcaggcgcctganaaagcggatggggcgggatgggtttttggaaggagcgaattaccttggaggaagaaaaggagggcaggcccaccggcttcctgggggtggctcacccgatcgggtccagttgaccctgacaaaccaaatccggccccaaaaagcccaaccgcccttgggcaatttgaaacctccattgggggttcccgccttaattcaaccccctgggtccccaaagaaaggaaaattttgggccttggtctccaaattggggtccacccccgaaacccggaattttagaggaaaacccggtgaaacttttccccaaagagccccccccccaaaaaaacaaaattttgggg

SEQ ID NO: 52147 - protein, 61 aa, Zea mays
  misc_feature: Ceres CLONE 1468064-F
  misc_feature (47)..(47): Xaa is any aa, unknown, or other
MAFAARAALVRVLPPRPSPTSQPKQLKQGLGGRGGSSLAVRAKDSDXLGAPSVGEARCAGA

SEQ ID NO: 52148 - DNA, 749 bp, Zea mays
  misc_feature: Ceres CLONE 1468067-F
  misc_feature: Encodes the peptide sequence at SEQ ID NO. 52149
  misc_feature (367)..(367): n is a, c, t, g, unknown, or other
  misc_feature (402)..(402): n is a, c, t, g, unknown, or other
  misc_feature (403)..(403): n is a, c, t, g, unknown, or other
ctggagctccccgcggtggcggccgctctagaactagtggatcccccgggctgcaggaattcgcacgagaccattacctagaacatcctaatcgaaaaatattccgctcagaattcctcaccggcctgcctcagagagagaaaaagcggagattagcggcggcgatggcactcccggcgtcgagctccggcctcttccgcttcgtctccccgcgcagccgcccccagtccaccgacatcgtggctgccgcctcctggggagtcttcgccggcaccgccggcctctacctcgtccaaccatttgactggattaagaaaactttcttcgagaaaccccaaccagaggcataaaaggcttggcagtctgncactttggtacttcacttttatccgggatggtccnntgactgagagaaacttggataactcagcaaataatacgagacccccctcgggtttccttgtttgtttttttattatccagatgtagggcatcccccaccagggaaacagggaaccagaaaacctgttgggtccaccgggggccttataaaccccccggatttttccaaccagcctgtttttaaacccgggggcaaaaaattttttgggtgttttaaaaatttaaaaaaaaaaaaaaagccttttttttcccccccccccccggggggggggcccgggagccaattcccccattagggggcgtttataacccccccccccgggccgcgtttttaaaaagcgggaggg

SEQ ID NO: 52149 - protein, 61 aa, Zea mays; identical to SEQ ID NO: 45456
  misc_feature: Ceres CLONE 1468067-F

SEQ ID NO: 52150 - DNA, 706 bp, Zea mays
  misc_feature: Ceres CLONE 1468069-F
  misc_feature: Encodes the peptide sequence at SEQ ID NO. 52151
  misc_feature (381)..(381): n is a, c, t, g, unknown, or other
aaagctggagctccccgcggtggcggccgctctagaactagtggatcccccgggctgcaggaattcgcactagaccattacctagaacatcctaatccaggaggtgacgtccaaaagtgccctaccccaagctagcgcgagacgagagagagagagacgaccccccaaatcggaatctgcacagccccatgcatggccgccgccctgctccgccgctcgccggcggtgcgcgcgctcctcacatcagcactctcatcccgactcatcgcgaccaatccccactcctcgtcacccgcgccggcggcacctgccaaggtcgcctccagcacgaagaccttctcgatctaccggtgggacccggactcgccgttgatgaatccncacctcaaggactaccaccaggacctgccctactgcgggctgatggtgctggacgctctgctcaaaatcaagagcgagcaagacccgtcgcttacctacagccgcagctgctgcaagggcatctgcaatagctgcgccataaatatcgacagagataacggtctcttctgcctcaccaagatctctggtgtcacctccgcgtccaaagtctcaacgctgcctcaaagttcatcataaagcacctgttgggtggacatgaccaactgctacggacataaatgaacttctagacatggctcaatcgcaaggaccagcgcccacaacc

SEQ ID NO: 52151 - protein, 141 aa, Zea mays
  misc_feature: Ceres CLONE 1468069-F
  misc_feature: SWISSPROT Homolog: EC 1.3.5.1 Succinate dehydrogenase (ubiquinone)
MAAALLRRSPAVRALLTSALSSRLIATNPHSSSPAPAAPAKVASSTKTFSIYRWDPDSPLMNPHLKDYHQDLPYCGLMVLDALLKIKSEQDPSLTYSRSCCKGICNSCAINIDRDNGLFCLTKISGVTSASKVSTLPQSSS

SEQ ID NO: 52152 - DNA, 727 bp, Zea mays
  misc_feature: Ceres CLONE 1468076-F
  misc_feature: Encodes the peptide sequence at SEQ ID NO. 52153
aaagctggagctccccgcggtggcggccgctctagaactagtggatcccccgggctgcaggaattcgcacgagaccattacctagaacatcctaatcgaaaaaaaaattttacggccacaaaaaatgtataaaataggaaatgggaaaaccccatcacagctccacgcctccactgctatccctctcttcctctctgctttccccttccaatggaatcctgtagcttccgtgccgcaaccgcgccttctccctttccctccgctccttcttcatcttcatccccgcgcgccccatgccccatactccgatttcccaggccaagaaaagggaggcagattggggtgcggaggagggcgtccggatttgatgccttcgcgtctttcgccggcaaggtcttcgtggatgaggcgattggagcggaatatggggagggcttcgaaacatttcgaatggatggaccactcaaggttgatgtggattatctgaatgaaaaattgcaagagtgcttccttcaaaggataaggcatgctatgaagccggatgaggcgtttggtctaattttttcgtgggacaatgttattgctgatacagactcgctaaagttgaatgcttggagacaacttgctttggaggaaggtaaggatatcccaagtggtgctcatgtccggaagagcattattcatggtgctgctgaccatgttcttagaaaagttttgtactgggcaa

SEQ ID NO: 52153 - protein, 172 aa, Zea mays
  misc_feature: Ceres CLONE 1468076-F
MESCSFRAATAPSPFPSAPSSSSSPRAPCPILRFPRPRKGRQIGVRRRASGFDAFASFAGKVFVDEAIGAEYGEGFETFRMDGPLKVDVDYLNEKLQECFLQRIRHAMKPDEAFGLIFSWDNVIADTDSLKLNAWRQLALEEGKDIPSGAHVRKSIIHGAADHVLRKVLYWA

SEQ ID NO: 52154 - DNA, 727 bp, Zea mays
  misc_feature: Ceres CLONE 1468083-F
  misc_feature: Encodes the peptide sequence at SEQ ID NO. 52155
  misc_feature (461)..(461): n is a, c, t, g, unknown, or other
  misc_feature (473)..(473): n is a, c, t, g, unknown, or other
  misc_feature (476)..(476): n is a, c, t, g, unknown, or other
  misc_feature (477)..(477): n is a, c, t, g, unknown, or other
  misc_feature (488)..(488): n is a, c, t, g, unknown, or other
  misc_feature (491)..(491): n is a, c, t, g, unknown, or other
  misc_feature (567)..(567): n is a, c, t, g, unknown, or other
aaagctggagctccccgcggtggcggccgctctagaactagtggatcccccgggctgcaggaattcgcacgagaccattacctagaacatcctaatcgaaaagtgcgcgcgcgctcatcacaagctgtcacaaactcagcacacaatcacactgacacacacacaccacaccacggcaccgctagtgagaagcagagcgggaggacacgcggcgcggactgcgatggctcgtgcgctcggcgcttgcgtgctgctcgccgtcctgctcggtgccctggcgccggcgccggcgccggcggcggccgcgcgcgcccacgacgaccagggcagcggggccggcatacggcagccgagcggcgagtaccgcgggaggaaggtgggggccaggaccgaggtgcgggacgtggagggcgacggcgaggtgcaggagctcggccggttctccgtcgccgagtacaccnggcagctccaanaanngtgcggcggcngcngcaggctccagttcggcagggtggtggcggcgcaccggcaggtggtgtcggggctcaagtactacctcccgcctcntgccctggaagagggcggcggccccggaaaccgcggcaaacccctgttcaaccccttcttcttcttaaccccggtttcaaccgggaaccctggtcaagttcgccccccgggccccaaaaaaggcgggccccccccccgggaaggaaaaaccccgggcccc

SEQ ID NO: 52155 - protein, 168 aa, Zea mays
  misc_feature: Ceres CLONE 1468083-F
  misc_feature (80)..(80): Xaa is any aa, unknown, or other
  misc_feature (84)..(84): Xaa is any aa, unknown, or other
  misc_feature (85)..(85): Xaa is any aa, unknown, or other
  misc_feature (89)..(89): Xaa is any aa, unknown, or other
  misc_feature (90)..(90): Xaa is any aa, unknown, or other
  misc_feature (115)..(115): Xaa is any aa, unknown, or other
MARALGACVLLAVLLGALAPAPAPAAAARAHDDQGSGAGIRQPSGEYRGRKVGARTEVRDVEGDGEVQELGRFSVAEYTXQLQXXCGGXXRLQFGRVVAAHRQVVSGLKYYLPPXALEEGGGPGNRGKPLFNPFFFLTPVSTGNPGQVRPPGPKKGGPPPREGKTPGP

SEQ ID NO: 52156 - DNA, 749 bp, Zea mays
  misc_feature: Ceres CLONE 1468084-F
  misc_feature: Encodes the peptide sequence at SEQ ID NO. 52157
ggagctccccgcggtggcggccgctctagaactagtggatcccccgggctgcaggaattcgcacgagaccattacctagaacatcctaatcgaaaagtctccgcaccctagggtttctgtgcctcgccagcgaagcgatgcagccgccgcaccaaccgccgatgaacgggcaacactcccagcctccgccgcaaggacccgtggtgcccatgcctccgcagcagcaggcgcccccgctgccgtactaccagcagcagcaggcgccgcagtactaccaacaggccctcccgcagccgtgggggcagcagcagcagtacgctgcaccgccgccgcagtacccgcctccgcctcagacgcagcattacgcgacaccaccgcagcagtacgcccctctgccgcagcagcagtacgctccctcaccgcagcagcagtacgctccctcgccaatattgtacacccccgggaaaccggtgaatccaggaaccctttggaatccgaaaatcttccccacctgaagggacaaaaactacctccactaaaaagcccttttgggggcctgggcccaaaaaatatgcttctggggaaattttccggaaaaagcaaactggggccctaaaaaggcaaggggtttattggaggtttacccccgaaggcgggggaaaaaaaactcggagaaaatcttggggggaaaaagaccccaaggtggggaagaatttttaaagaaaagggggtcccccaaacacccggaa

SEQ ID NO: 52157 - protein, 117 aa, Zea mays
  misc_feature: Ceres CLONE 1468084-F
MNGQHSQPPPQGPVVPMPPQQQAPPLPYYQQQQAPQYYQQALPQPWGQQQQYAAPPPQYPPPPQTQHYATPPQQYAPLPQQQYAPSPQQQYAPSPILYTPGKPVNPGTLWNPKIFPT

SEQ ID NO: 52158 - DNA, 752 bp, Zea mays
  misc_feature: Ceres CLONE 1468092-F
  misc_feature: Encodes the peptide sequence at SEQ ID NO. 52159
  misc_feature (383)..(383): n is a, c, t, g, unknown, or other
  misc_feature (496)..(496): n is a, c, t, g, unknown, or other
ggagctccccgcggtggcggccgctctagaactagtggatcccccgggctgcaggaattcgcacgagaccattacctagaacatcctaatcgaaaacgagcagtatcagtttggaactttcgaggtgaactggtcacgtcatttgaagatcacctgttgtggcaccccgactgcaacacaaacaacatatacatcacaagcgatcaagatcttattatctcgtactgcaaggctgactcaactgattcaacttcagaagaaaatgctggctctataaacataagcagcatactgtccgggaaatgcctggcaaaaataaacactggaaactccaatgcttgcaaggaaagaaagaaggcgtggaagttccggaacacagtctncgaagcccttgaagacatcacggctctgtactacgacgaagatcgcgacgagatctacactggcaaccggcacggccttgtccatgtgtggtcaagctgaaagctgaaactgncggggcgcctttccaaccgtacccgggggaccgggccttccccctgggccggtataacaagctcaaaggggcccccccgggacacgggggtgggggggccccaaaaaaaggcccccccccaaccccccaaggggaagtctttttttttttccaaggggacaaaaaacctgtcccactttttataaaaaaaaagcccccccaaattttggtaaaacagacccccctccgaaaaaaaaaaaaacccctcgtgtaaaaa

SEQ ID NO: 52159 - protein, 160 aa, Zea mays
  misc_feature: Ceres CLONE 1468092-F
  misc_feature (128)..(128): Xaa is any aa, unknown, or other
GAPRGGGRSRTSGSPGLQEFARDHYLEHPNRKRAVSVWNFRGELVTSFEDHLLWHPDCNTNNIYITSDQDLIISYCKADSTDSTSEENAGSINISSILSGKCLAKINTGNSNACKERKKAWKFRNTVXEALEDITALYYDEDRDEIYTGNRHGLVHVWSS

SEQ ID NO: 52160 - DNA, 721 bp, Zea mays
  misc_feature: Ceres CLONE 1468093-F
aagctggagctccccgcggtggcggccgctctagaactagtggatcccccgggctgcaggaattcgcacgagaccattacctagaacatcctaatcgaaaagatcctgacccgtgagggcgtgcggttcctcgcggacagctccggactccagagccgcctcttcgcccatctcggcgtcggaaggctacggtggctgcttccccgagcctgaaggtagaccaccttgcgttgattcctcgagtcttcacgtgccggttccgtttgcatcttcatttttaactaagcctggaacttattgcatgggtatctaagagacacttctcaccctgcttgtgcttattatatctcacatcccgagcaagtgagataatgtgtatggactattacacctcccgcccatagaaatgccaccccacccactgctcgtgctaaaaaacgaagcccttcaaggtcacctccacccaagagtgcttcatggtacccacggccaaggagcccaaagagacgcatcactccaaggtctcctcctacgacacgcgctagatcaaggtcaagggataggagctcggccacgatcccagatgatagacatccaggggataaccctttaggtaactgggattggcccctcccggtaacggaacgacgactcttgaagaaaatcctttatggattaaagggaaaggccaagaaactggccactgttggttatatgatcc

SEQ ID NO: 52161 - DNA, 722 bp, Zea mays
  misc_feature: Ceres CLONE 1468096-F
  misc_feature: Encodes the peptide sequence at SEQ ID NO. 52162
  misc_feature (553)..(553): n is a, c, t, g, unknown, or other
aagctggagctccccgcggtggcggccgctctagaactagtggatcccccgggctgcaggaattcgcacgagaccattacctagaacatcctaatcgaaaactgttcgccagagccaagcccctagtagccacctcgctccagaagctttcctcccctagatctccctcccgtgcccggtcgcgctgccgacccggccatggcgaccaaggggaagctcggggagctagtgtgggagcaccgggtgcaggcggccgcagcggtggctttcgtggccgcggccgccgtctcgatctccgccgtcgggcccaggctcggcgccgtggtgtcattcttctggccgctgctcgtctccacgggcctcttcctggtggcggtcgccgtgctgctccggatctcgccgccgcccgcgggcgacgacgacgagtccggcaaggagctcatcgacttcgtcgccgggtgccgcccggagcacctcgtcccggatgcggcgccgccggcggccgtagcccccgtggaggctccgcccgagctgcagatctaacgggctgccnggaggaggaggctgacagcagcctagctgtgctgtgtgctgctgcgtggcatggcgtgctccgtccccgggtgaacttcctccagtggcacgggtgggggcaaccgttgcggggccacctgtaagtgtcaggccggcgcgccgccgtggctcggtagcctaggacttct

SEQ ID NO: 52162 - protein, 114 aa, Zea mays; identical to SEQ ID NO: 42026
  misc_feature: Ceres CLONE 1468096-F

SEQ ID NO: 52163 - DNA, 873 bp, Zea mays
  misc_feature: Ceres CLONE 1468112-F
  misc_feature: Encodes the peptide sequence at SEQ ID NO. 52164
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
tttcttcttttctttggggttttgtgggnnnnnnngggtgtgnncccaagctggagctccccgcggtggcggccgctctagaactagtggatcccccgggctgcaggaattcgcacgagaccattacctagaacatcctaatcgaaaaatttgaacctgtcgccggagatcgcaaatgaaatcaagcaagcggaagcacagataaagcgaagaatgggcattggaagccacatatctgagcgacggctgattgatggactaaacaggatgggaatgaacgaatccattgtgagaagagctcttctgattatggcatcaaagagacgaggtggagtacaagagagagcgccatgtgatcgtccggaaggcttgatgtggagagtccagtcagactcattcctgggatacaacgaacggttcatggggaacccctccttcaaaagcgttccatacccttcactggagactgcccatcttgccccgtcctgaggggggaggaaaaacgcccttaatttggccctttgaaaaggactgaactggttgtaaattcagcaaaaaggggtttgggggcaggagaggggctctggtttttttgaaggggaaacaaaaggggtccgggaatgaaaaattttaaattgggcccccggggacccgggctcaatccaatttccgaaaaaggggaaaaaatctggggggctttcccgcacgaggagaaaaaaaaaaaaaaaagagttataataaactcctttccccccctaggggggggggggccgcgggcccccaattcggcccccaaaagggagaggcaataactggcaccccccggggggggggggttctatcacgagggtggggggggggagaacaccgcgg

SEQ ID NO: 52164 - protein, 91 aa, Zea mays
  misc_feature: Ceres CLONE 1468112-F
MGIGSHISERRLIDGLNRMGMNESIVRRALLIMASKRRGGVQERAPCDRPEGLMWRVQSDSFLGYNERFMGNPSFKSVPYPSLETAHLAPS

SEQ ID NO: 52165 - DNA, 644 bp, Zea mays
  misc_feature: Ceres CLONE 1468300-F
  misc_feature: Encodes the peptide sequence at SEQ ID NO. 52166
tggagctccccgcggtggcggccgctctagaactagtggatcccccgggctgcaggaattcgtctcacccctagaaaaaatcgaccggccactcgtctgacgctacgctgcctactatctatctacctctaccctccctcatcacttgttccactacgaccggccacctagctcgccgcgcgcgcaagcctgcgccaccacccactctactagcttagtctcccctcgtgcagcgcgacgacagccagcaatggccgccgcccagtgaggcagggtcgcagtgacggcacgagacgcacacccacgggcgctggcggcatgccgggcgacgcctacgacctcctgtgcgccgaggacgacgccgccggcagcgccctgctgtgcaccaccgacgacgacgacgggtgctgctccgctgtcgaggaggactcggcggcggcggcggcctccatcgccgagctcatcggcggcgaggcccagtactcgcccaggccggactaccccgacaggctccgctccaggtccatcgacccggccgcccgcgccgagtcggtcgcatggattctcaaggtgcaagaatactatgggtttcttccattgacagcctacctcgccgtcaactacatggaccggttcctctctcc

SEQ ID NO: 52166 - protein, 108 aa, Zea mays
  misc_feature: Ceres CLONE 1468300-F
MPGDAYDLLCAEDDAAGSALLCTTDDDDGCCSAVEEDSAAAAASIAELIGGEAQYSPRPDYPDRLRSRSIDPAARAESVAWILKVQEYYGFLPLTAYLAVNYMDRFLS

SEQ ID NO: 52167 - DNA, 666 bp, Zea mays
  misc_feature: Ceres CLONE 1468302-F
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
aagctggagctccccgcggtggcggccgctctagaactagtggatcccccgggctgcaggaattcgtctcacccctagaaaaaatcttgagaatgacctcctcgtcctcgctccctccccaaccttcaagagcgcacacgcacacgcacacgcctcgcgcaagccggccgacgtgcggcatggagaagagcgctacaactggcggcggttcaagcattggcggcggataggctgcggaggaggcgaaggtgcctctgctgcatccgagggctgcggctgcggccgcggcggccgaggatgaccatgcaggaggaggacgagacgactatcaggcggcttcggcgcctgcggatgaagagggcacgaacgctgcttgttcgtcgctgccgctgtcgcggctcgcgtgggaggacaacaccaagctgtggggggtggtcggggctttccccttcacgcgcttcgcgtccttcggtgtagccgtcatcagaaggggcttcgtcggccacatcggtgcccccgaagctcgtcggcctaggcggtgggtgccaccgctcctcattgagtttagcaacggcctccctgggcggnnnnnnggggtgctgccgtgccatnnnnnnnnnnnnnnnnnnnnnnnnnnnnncnnnnnnnnnnnnnnnnnnnnncccg

SEQ ID NO: 52168 - DNA, 654 bp, Zea mays
  misc_feature: Ceres CLONE 1468305-F
  misc_feature: Encodes the peptide sequence at SEQ ID NO. 52169
  misc_feature (551)..(551): n is a, c, t, g, unknown, or other
ggagctccccgcggtggcggccgctctagaactagtggatcccccgggctgcaggaattcgtctcacccctagaaaaattcaaaggaaacacaagctctatcgtcactggagtcatcactggacatagacttctcaacaataccttcagcttggaatgatgatgacattgtagtatcagatgggatgccaaaaggaagcgatgaaaatcaagttccaaataaaaatggtgagctaacccatccagcatctaagtcactggttttatctaagaaagacatagaaatgaacattaccagcaaaaatccttcagattttttatcaagtctagcaatatctaaattagatgtaagtactagtgatggtgaccactcagataccaatattactcctaaaagccttacttcaaatgctgtagaatgccaatcttgtcatgctgctggggagaaaatgttggaggatattggatccaaggacatcgacatggagaagatatcttctcagatatcttcagtaacattaggtggcaacgataagattcagagtatggcangaaatcagcaaccagatgtaatgccatgcacatctattgatgtgcccatggatcagaattttggcagagaccgatctcatctcaatcttaacgagcttttatt

SEQ ID NO: 52169 - protein, 156 aa, Zea mays
  misc_feature: Ceres CLONE 1468305-F
  misc_feature (123)..(123): Xaa is any aa, unknown, or other
MPKGSDENQVPNKNGELTHPASKSLVLSKKDIEMNITSKNPSDFLSSLAISKLDVSTSDGDHSDTNITPKSLTSNAVECQSCHAAGEKMLEDIGSKDIDMEKISSQISSVTLGGNDKIQSMAXNQQPDVMPCTSIDVPMDQNFGRDRSHLNLNELL

SEQ ID NO: 52170 - DNA, 656 bp, Zea mays
  misc_feature: Ceres CLONE 1468306-F
  misc_feature: Encodes the peptide sequence at SEQ ID NO. 52171
tggagctccccgcggtggcggccgctctagaactagtggatcccccgggctgcaggaattcgtctcacccctagaaaaagtgctcgccatctgctggcatctggagtttctgaaatttcagcggaatcgtcatttagcagtatccaagagttccttgaggcacttgagctgtgctacaaatcactgtgtgactgcggcgacaacgccatcgcggacgggagcctcctggacctcctgcgccaggtgttcacgttcgggctctccctggagaagctggacatccggcaggagtcggagcgacacaccgacgtgatcgacgccatcaccacacacctcggcatcgggtcgtaccgagagtggtccgacgacaagaggcaggagtggctgctgtcggagctgcgaggcaagcgcccgctgctgcccccggaccttccccagaccgacgagatcgccgacgtcatcggcacgttccacgtcctcgcggagctcccgcccgacagcttcggcccctacatcatctccatggcgacagccccctcagacgtgctcgccgtacagctcctgcagcgcgagtgcagcgtgcgccagccgctgcacgtggtgcctctgttcgaggagcatggcgacctgcagtcagcgcctgcgtacgtggagcg

SEQ ID NO: 52171 - protein, 44 aa, Zea mays
  misc_feature: Ceres CLONE 1468306-F
  misc_feature: SWISSPROT Homolog: EC 4.1.1.31 Phosphoenolpyruvate carboxylase
MATAPSDVLAVQLLQRECSVRQPLHVVPLFEEHGDLQSAPAYVE

SEQ ID NO: 52172 - DNA, 657 bp, Zea mays
  misc_feature: Ceres CLONE 1468310-F
  misc_feature: Encodes the peptide sequence at SEQ ID NO. 52173
  misc_feature (629)..(629): n is a, c, t, g, unknown, or other
cgcggtggcggccgctctagaactagtggatcccccgggctgcaggaattcgtctcacccctagaaaaaggttgtgcggcggacgaagtcgcagggaaaccaggaggaaggctagtgcagagaatcagagctgtctgggtgaaagggcaaaggcaagcagcagagggaggccattacgtgtctccttcctccaggttcctctctgggctgccatggatttgctcagcagaggggcggcggtgttcaaggccctggtgttcctctgcttcatcagatcgtctcaaggaggagatctgaatctccctcccttggtgaaggcaagcaggttccaaagcgaggcatacgactacatcattgtcggcggcggcacggccgggtgcccgctggcggccacgctgtcccacaagtacaaggttctcctgctggagcgaggtgggtctccatatggcaaccgcaacatcacgttgctggagaacttccacatttgcctggccgacgtttcaccgcagtcaccgtcacaagctttcatctccacggatggcgtgataaatgcccgcgcaaatgtcctgggtggcggaacatgtatcaacgccggcttctacagccgggcgaaaccaagcttcgtgcancaagcaggctgggacgcagagctggtga

SEQ ID NO: 52173 - protein, 148 aa, Zea mays
  misc_feature: Ceres CLONE 1468310-F
  misc_feature: SWISSPROT Homolog: EC 4.1.2.10 Mandelonitrile lyase
  misc_feature (139)..(139): Xaa is any aa, unknown, or other
MDLLSRGAAVFKALVFLCFIRSSQGGDLNLPPLVKASRFQSEAYDYIIVGGGTAGCPLAATLSHKYKVLLLERGGSPYGNRNITLLENFHICLADVSPQSPSQAFISTDGVINARANVLGGGTCINAGFYSRAKPSFVXQAGWDAELV

SEQ ID NO: 52174 - DNA, 651 bp, Zea mays
  misc_feature: Ceres CLONE 1468315-F
  misc_feature: Encodes the peptide sequence at SEQ ID NO. 52175
cgcggtggcggccgctctagaactagtggatcccccgggctgcaggaattcgtctcacccctagaaaaagcggccaggctccctcctcctccctgcaaatcctgcagacaccaccgctcgtttttctctccgggacaggagaaaaggggagagagaggtgaggcgcggtgtccgcccgatctgctctgccccgacgcagctgttacgacctcctcagtctcagtcaggagcaagatgggtgccggcggcaggatgaccgagaaggagcgggagaagcaggagcagctcgcccgtgctaccggtggcgccgcgatgcagcggtcgccggtggagaagcctccgttcactctgggtcagatcaagaaggccatcccgccacactgcttcgagcgctcggtgctcaagtccttctcgtacttggtccacgacctggtgatcgccgcggcgctcctctacttcgcgctggccatcataccggcgctcccaagcccgctccgctacgcggcctggccgctgtactggatcgcgcaggggtgcgtgtgcaccggcgtgtgggtcatcgcgcacgagtgcggccaccacgccttctcggactactcgctcctggacgacgtggtcggcctggtgctgcactcgtcgctcatggtgccc

SEQ ID NO: 52175 - protein, 139 aa, Zea mays
  misc_feature: Ceres CLONE 1468315-F
  misc_feature: SWISSPROT Homolog: EC 1.14.99.33 Delta(12)-fatty acid dehydrogenase
MGAGGRMTEKEREKQEQLARATGGAAMQRSPVEKPPFTLGQIKKAIPPHCFERSVLKSFSYLVHDLVIAAALLYFALAIIPALPSPLRYAAWPLYWIAQGCVCTGVWVIAHECGHHAFSDYSLLDDVVGLVLHSSLMVP

SEQ ID NO: 52176 - DNA, 694 bp, Zea mays
  misc_feature: Ceres CLONE 1468325-F
  misc_feature: Encodes the peptide sequence at SEQ ID NO. 52177
  misc_feature (478)..(478): n is a, c, t, g, unknown, or other
  misc_feature (694)..(694): n is a, c, t, g, unknown, or other
ggagctccccgcggtggcggccgctctataactagtggatcccccgggctgcaggaattcgtctcacccctagaaaaagttataatccctgaatccccggactagatggtcgtcccttctccgtcctcccgcctggcgtcacgtggtcccggaccgactcgatttcgggaccggcgggagaagatgcatgggtcgttaccaactgcctgctgacatcgtctgcttgctcggctgatctcggttgcggttcacggccagcagcatccgcgccgccctgtggccggtggggttcgcgtcgcttgcatcgagatgggtccatacttgagcgagatgctgggaccatggccccctttgaccctggccaggtgtttgttcgtgatgatggtggacaggttgacttggatttggggaattatgagcgttccatacatgtcactcggacgtgggaaaccactttccccctggaccgctgtcccanccctgccttgatacggagagaaagggtggatatccatggacagactgtacacggttattcctccgggctcccgactgacatcaaaaccgtggataccggttaagtggtcttccggatccctgggggattgggacagaactccccccaagccgtccgggttttgggttacttggaaattggggtagggcccttgctgaggtggaatcttctcgattn

SEQ ID NO: 52177 - protein, 79 aa, Zea mays
  misc_feature: Ceres CLONE 1468325-F
  misc_feature: SWISSPROT Homolog: EC 6.3.4.2 CTP synthase
  misc_feature (46)..(46): Xaa is any aa, unknown, or other
MAPFDPGQVFVRDDGGQVDLDLGNYERSIHVTRTWETTFPLDRCPXPALIRRERVDIHGQTVHGYSSGLPTDIKTVDTG

SEQ ID NO: 52178 - DNA, 696 bp, Zea mays
  misc_feature: Ceres CLONE 1468326-F
  misc_feature: Encodes the peptide sequence at SEQ ID NO. 52179
  misc_feature (696)..(696): n is a, c, t, g, unknown, or other
ggagctccccgcggtggcggccgctctagaactagtggatcccccgggctgcaggaattcgtctcacccctagaaaaatcccaggagcgtggcctcactctcctcgtcgcatcccctctcctcatcttcaaagagcgggcggcggccatggcgatggcctccacctactcgccggacggaggcgcgggggcgctcgtacagggaagatgcatagtccgcggtcgacgtggggtgggcttcttcggcccctctaaggccgctggactcgcacgtcacctcggtcgcgacagtcggacgagcagcccaatcccgctggacgccatgctgccatttgcgcagccatcgacacgcgcggaggcgcggctcgacacggcgccacgcttcttccatccgagacaagaagtgttcagcctctagagcttcctctgattcctgcccaagcgcacaatcaaccccgagcactcgacgaaaaacttgttgcgacacgcgatatgaccttgtcgatctttttatatcgacaactaaaaggaaggaaacctgcagtggctccagagaccttcaggagggtcaaacgtgtacacacctcgtcctgcttcgaacaaagggagaacctgcttggcccattggcgaccagctcaccttcccccaatggccgggccacaaatgcgtggccccccatgggatggtcatccttgn

SEQ ID NO: 52179 - protein, 89 aa, Zea mays
  misc_feature: Ceres CLONE 1468326-F
MAMASTYSPDGGAGALVQGRCIVRGRRGVGFFGPSKAAGLARHLGRDSRTSSPIPLDAMLPFAQPSTRAEARLDTAPRFFHPRQEVFSL

SEQ ID NO: 52180 - DNA, 653 bp, Zea mays
  misc_feature: Ceres CLONE 1468332-F
  misc_feature: Encodes the peptide sequence at SEQ ID NO. 52181
  misc_feature (653)..(653): n is a, c, t, g, unknown, or other
ccccgcggtggcggccgctctagaactagtggatcccccgggctgcaggaattcgtctcacccctagaaaaaatagaagagtcgctccaactgtccaaccacagctccgcgccgccgccgaggacgacaaaggcgtcccgctgttcttgttgggcgcctcttcggaggttggataattgaacatgagaacctatagccatctttggtcgacgaccaagaggagtgcaatggcgtttgtaattggcgtctccatttctgaccgttgggcgaatttcacttgggtgactggcgaatccatgtatcctacgtttacggccgccaatagcttctggggagggtgttggaaccaggtgatttcgttttatcagaaaagaggtgccttgagcactgcaagttctcacatggtgatgtgattttgttcaagtgccctagcaatcataaggagatgcttgtgaagaggttgattgggcttcctggtgagaagatacagccccctgggtcccttaaccctactaagatcccagaatggcattgctgggttgaaggtgataactctactcgtagctgggattctagggcattcagtccggcaagtttcttcatgttgctatagctcatgcctagttggctgaatgatacttagtactgcatan

SEQ ID NO: 52181 - protein, 55 aa, Zea mays
  misc_feature: Ceres CLONE 1468332-F
  misc_feature: SWISSPROT Homolog: EC 3.4.21.89 Signal peptidase I
MLVKRLIGLPGEKIQPPGSLNPTKIPEWHCWVEGDNSTRSWDSRAFSPASFFMLL

SEQ ID NO: 52182 - DNA, 995 bp, Zea mays
  misc_feature: Ceres CLONE 1468340-R
  misc_feature: SWISSPROT Homolog: EC 5.4.99.8 Cycloartenol synthase
  misc_feature (1)..(1): n is a, c, t, g, unknown, or other
  misc_feature (746)..(746): n is a, c, t, g, unknown, or other
  misc_feature (995)..(995): n is a, c, t, g, unknown, or other
nccgaattgggtacctcgagcgtctcgtttttttttttttttttgcatgaaccgctttgagactgtaataatgaggagtacattactatcaccatcactattattactaggaccactagtagcgcaaccccctgaacgtaacgtagctacattattccaacttccacatgactcacaaaagctgatccatgacacacacacacacacctcccgttcaccgccaagacttgtcagcccccaagactcggcaccggtactcacccagagcccaaatcgggaagatgttcctgtactgggagtagcttatcatgcagttcttgttgaacactcctatgatctcttgctgaggaaattctccatcttctgattgtaagttgatcaaaaccttttgctgctcggtgtagaaggcgttggatctctctcggcctggcccgcaatcaatcagcgccagcatggccccaaactagtgtttcacccccatgaaggccgggttgccttttgagaattgggggtaaaaccctggtccttgaaaaataaacaaaaaaactttttccttcccccaaaccaccccggaaaaggaaaaatttcctttttggacaacaccaaaaaaaagcccccaatggccccttttcttaaaattaggccaagggaactggggttccctccaaaaatagttttctttacccccacgccaggccacaaatttaattctccccttttctccaccccccaaaaacaccaaaagngtgccccgctatttgttggaaaaaacaaaaaacggggcccccacagaaacgcccctacccccgggggaaaccccaccccggctttttttctggaaaaaaaaccccctctccagaaaaaaaaatattgggaaagaacttctttttccgaaataaaaaagttttattcacccccctctttttctcttgcgggggggccccccggggggaaaaaatttttttagtaaaaaaaaattctagagggcccccaan

SEQ ID NO: 52183 - DNA, 699 bp, Zea mays
  misc_feature: Ceres CLONE 1468341-F
  misc_feature: Encodes the peptide sequence at SEQ ID NO. 52184
ggagctccccgcggtggcggccgctctagaactagtggatcccccgggctgcaggaattcgtctcacccctagaaaaaaaactcgctactggcctcgggcccgcccgtcgtgaggtccgagctcgatgcagccgatccggcggcggcaccgaggctttgcactcctctgtctctccgccgccctcctcgctgccgccactctgctccccgtcgccgccgtcgccgaaggtgtcacgccctccgaggcgcgccggctccgcgacgaggtgaaagatatgttctatcatgcgtttgatggatacatgaagtatgctttcccactcaatgagctgcggcccttaagttgccaaggtgaagactccccttggtggttatgcgctcacctcttatccattccttggataccttggcctatacctggtgaataaggagaattttgggtgctgctgtgcaacgggttgggtaacaatgtccacttttgatatttaataaaacccgtctctgttttttgaaaccaacatccgttatcccttggggggcctgcctatccccttcccctgatttgcccgtgattattgccccctggtatggacaatcccatttttttggatgacccagttaccttctttttcccgggttgccttatcttttgaaggctgtttgccccccctttaaccctccccccgggatttccccttc

SEQ ID NO: 52184 - protein, 100 aa, Zea mays
  misc_feature: Ceres CLONE 1468341-F
  misc_feature: SWISSPROT Homolog: EC 3.2.1.113 Mannosyl-oligosaccharide 1,2-alpha-mannosidase
MQPIRRRHRGFALLCLSAALLAAATLLPVAAVAEGVTPSEARRLRDEVKDMFYHAFDGYMKYAFPLNELRPLSCQGEDSPWWLCAHLLSIPWIPWPIPGE

SEQ ID NO: 52185 - DNA, 561 bp, Zea mays
  misc_feature: Ceres CLONE 1468407-F
  misc_feature: Encodes the peptide sequence at SEQ ID NO. 52186
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (117)..(117): n is a, c, t, g, unknown, or other
  misc_feature (288)..(288): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactggaactccccncggtggcggccgctctaaaactagtggaatcccccgggctgcaggaaatcgtcctcacccctagaaaaacctgcgagtacatgaaccccatgttttactggaaggttgcaactgaagcagaccttggcttggcagatgcctacattaacggttatttctcatttgtagacnagaagagaggtcttctaaatcttttccctgaatctcattgccaaacagggacgccaaccagaatattacccaccgctgctggtaaaaggggttgggtggaacaccccctgctaattgaacaacttgggggtttccccccccccaaaaaaaatttcccgggggtaccaaaaaccacgggggagggaaaatttgggccccccaaaaaaccttcaaaaaaatttttttaaaaaatttttgaatcccgggaaaaaaggaaattttcttttctccttt

SEQ ID NO: 52186 - protein, 138 aa, Zea mays
  misc_feature: Ceres CLONE 1468407-F
  misc_feature (7)..(7): Xaa is any aa, unknown, or other
  misc_feature (64)..(64): Xaa is any aa, unknown, or other
PKLELPXVAAALKLVESPGLQEIVLTPRKTCEYMNPMFYWKVATEADLGLADAYINGYFSFVDXKRGLLNLFPESHCQTGTPTRILPTAAGKRGWVEHPLLIEQLGGFPPPKKNFPGVPKTTGEGKFGPPKKPSKKFF

SEQ ID NO: 52187 - DNA, 653 bp, Zea mays
  misc_feature: Ceres CLONE 1468421-F
  misc_feature: Encodes the peptide sequence at SEQ ID NO. 52188
  misc_feature (348)..(348): n is a, c, t, g, unknown, or other
  misc_feature (391)..(391): n is a, c, t, g, unknown, or other
  misc_feature (521)..(521): n is a, c, t, g, unknown, or other
  misc_feature (550)..(550): n is a, c, t, g, unknown, or other
aaagctggagctccccgcggtggcggccgctctagaactagtggatcccccgggctgcaggaattcgtctcacccctagaaaaaagacgcaccccttcctcgtttcgccgcctccgccgacaccgactgcctacctcagctgccgtcgccatgggcagaaggcctgctagatgctatcgccagatcaagaacaagccataccctaagtccaggtactgccgtggtgtccctgaccccaagatcaggatctacgatgttgggatgaagaggaagggtgttgatgagttcccctattgtgtgcaccttgtctcttgggagaaggagaatgtctccagtgaggcgcttgangctgcccgcattgcctggcacaagtacatgaccaagtctgcangaaaggatgctttccaccttaaggtccgggttcacccgttccatgtcctccgtatcacaagatgctttcgtgtgctggggctgataggctccagactggaatggagggtggcctttggcaagcctcaggncacctggtgctagggtggacattggtcangtccctccttttccgtgcgatgcaaggacaacaatgctgcccatgccagcgaagctctgcgtcgcgctaagttcaagttccctggccgccaaaagatcattga

SEQ ID NO: 52188 - protein, 127 aa, Zea mays
  misc_feature: Ceres CLONE 1468421-F
  misc_feature (5)..(121): Pfam Name: Ribosomal_L16 Pfam Description: Ribosomal protein L16
  misc_feature (66)..(66): Xaa is any aa, unknown, or other
  misc_feature (81)..(81): Xaa is any aa, unknown, or other
  misc_feature (124)..(124): Xaa is any aa, unknown, or other
MGRRPARCYRQIKNKPYPKSRYCRGVPDPKIRIYDVGMKRKGVDEFPYCVHLVSWEKENVSSEALXAARIAWHKYMTKSAXKDAFHLKVRVHPFHVLRITRCFRVLGLIGSRLEWRVAFGKPQXTWC

SEQ ID NO: 52189 - DNA, 610 bp, Zea mays
  misc_feature: Ceres CLONE 1468422-F
  misc_feature (212)..(212): n is a, c, t, g, unknown, or other
  misc_feature (266)..(266): n is a, c, t, g, unknown, or other
  misc_feature (269)..(269): n is a, c, t, g, unknown, or other
ctggagctccccgcggtggcggccgctctagaactagtggatcccccgggctgcaggaattcgtctcacccctagaaaaatcccatctctcactcgctagcactagcatagtcgtctctttcttttctgcttccagacattgtccacacgagctagtgcactggtgtcgctcgcaccaaattaaagacgtactgagccatggcatccaaggncgtccctctcctggctctcaacctccctggtctcacatgggccaagcctggggnagntgcccgaaccccacgcgcccggtgtggcaccggcgccgctccttttgttaaccaaccctttttcctccaatgggaaatgccccctgaaaaccctctacattcgcgtggtgggccaaatgggtccggcccctccaaaggaaaattggaaagaaacttccaaacaatcttgaacctcctttaaagggtttttaaaatttaaggggcctccttcctctcttctggccttaatggggactacctcccggggcgctttcataagaccccccaagtataaaggccgccccaacaacctagggaaaaaggtgccccacaagggaactggtggtgcgcaaaaccccccc

SEQ ID NO: 52190 - DNA, 676 bp, Zea mays
  misc_feature: Ceres CLONE 1468426-F
  misc_feature: Encodes the peptide sequence at SEQ ID NO. 52191
  misc_feature (397)..(397): n is a, c, t, g, unknown, or other
  misc_feature (633)..(633): n is a, c, t, g, unknown, or other
ggagctccccgcggtggcggccgctctagaactagtggatcccccgggctgcaggaattcgtctcacccctagaaaaaaacccacagaacagagagaaattactgaagcatgagcgcggagctgaagagggactacgagatcggcgaggagatcgggcgcggccgcttcggggtggtccaccgctgcacgtcccgcgccaccggggaggccttggccgtcaagtccgtggaccggtcgcggctgggcgacgacctggaccgcgagctcgcgcagctggagccgaagctggcgcagctcgccggcgcgggcaacccgggcgtggtgcaggtgcacgcggcgtacgaggacgaggcgtggacgcacgtggtcatggacctgtgcccgggcccgacgggnaaaaaaaggggtgtgcccccccttcaactgcttcacccagtgccgcagcccgtgggcagccgccatcgtcggcgcatgtcgcgcaggcgctcgcgctctgcgaccgcctcggcagtcgctcaccgcatacgtgaaatcccgagaacgtcctcatcgagaaccgaccacgacaacgaggagcgaacgagcaggaccaccgcccaggagacgacgcgtagcgctcctggcggacttcngcgtctgcggcttgggatcgtcaccgagtatattccgggtacg

SEQ ID NO: 52191 - protein, 189 aa, Zea mays
  misc_feature: Ceres CLONE 1468426-F
  misc_feature: SWISSPROT Homolog: EC 2.7.11.1 Non-specific serine/threonine protein kinase
  misc_feature (175)..(175): Xaa is any aa, unknown, or other
MSAELKRDYEIGEEIGRGRFGVVHRCTSRATGEALAVKSVDRSRLGDDLDRELAQLEPKLAQLAGAGNPGVVQVHAAYEDEAWTHVVMDLCPGPTGKKRGVPPLQLLHPVPQPVGSRHRRRMSRRRSRSATASAVAHRIREIPRTSSSRTDHDNEERTSRTTAQETTRSAPGGLXRLRLGIVTEYIPGT

SEQ ID NO: 52192 - DNA, 653 bp, Zea mays
  misc_feature: Ceres CLONE 1468431-F
  misc_feature: Encodes the peptide sequence at SEQ ID NO. 52193
tccccgcggtggcggccgctctagaactagtggatcccccgggctgcaggaattcgtctcacccctagaaaaaacgaggattcggccattcggatattccacctctcacactgccatatgcgcgacaactatgatcggcagcgacactgccccgggctccgtacaacaagcggacccgcccactatatacgaacggatggcgtacgacttctcattgccctcctcgtgcccgcccgcattctccgtcctggtctcgtagctggatgccgcgacctcgcgtcgcttccgcattgtcgtgcgaagcgatctgttggaaagacctctcgagattcatcttctgcatgcagaagacgatgctgatcgtgtctataaacagcgtcagaaactgccagcatacccatttctcatgcggggaatatctcttgtattcgcaggtccctagtccgttattctaaaacaacaacgtataatggtggatatacgtcttttatcaagcatgctggttaatcatggactgacatgaaaagacaatgggttggacatctggcaaaatttcggagaaccgcccctcaagaaccattgataatttcgtccacaacatatgatgatctcttggcaccaagtgaacgttttacactgcgaatcccactatt

SEQ ID NO: 52193 - protein, 44 aa, Zea mays
  misc_feature: Ceres CLONE 1468431-F
MKRQWVGHLAKFRRTAPQEPLIISSTTYDDLLAPSERFTLRIPL

SEQ ID NO: 52194 - DNA, 683 bp, Zea mays
  misc_feature: Ceres CLONE 1468436-F
  misc_feature: Encodes the peptide sequence at SEQ ID NO. 52195
  misc_feature (269)..(269): n is a, c, t, g, unknown, or other
  misc_feature (303)..(303): n is a, c, t, g, unknown, or other
  misc_feature (350)..(350): n is a, c, t, g, unknown, or other
  misc_feature (393)..(393): n is a, c, t, g, unknown, or other
  misc_feature (396)..(396): n is a, c, t, g, unknown, or other
  misc_feature (412)..(412): n is a, c, t, g, unknown, or other
  misc_feature (639)..(639): n is a, c, t, g, unknown, or other
  misc_feature (642)..(642): n is a, c, t, g, unknown, or other
  misc_feature (650)..(650): n is a, c, t, g, unknown, or other
  misc_feature (653)..(653): n is a, c, t, g, unknown, or other
  misc_feature (670)..(670): n is a, c, t, g, unknown, or other
acaagctggagctccccgcggtggcggccgctctagaactagtggatcccccgggctgcaggaattcgtctcacccctagaaaaatagccttatagccacataccggccagccgcagcaagtgcccagaaggccagaaccagaaccaagcagctcgttgcaacctcatatcatcccctgccacgcacctccgtccgccgcgccatggaatcgaggaggagggccgtgcccaccgtgacggcggttgcggtggcaaccctgctgctgacnatgatgacgtcgtcgggcgtggggggggacttcncggcggaccgggctgaatgctcctaacaattggcggggctggcgacntgcctgattttcccccccccacggggggggggggggggggccnaanccccaatttttccctnttcctcaaagaaagacatacaaaacaacccccaaggggcggggggtgggggtcccaggacccgaaaccaccccaaatctagggcctcagcctcaaggtgcgaataggggctcgggctcccccgccggtttgcgcgggcgcccccccaaaatctcgcgaatggcccccggagttcgtggggacgtggggcggcgggtgccaaggggcggccgcagcggggtcacaccntcnttcggggnggntgcccgcctgccgcggnggggcgcacatcg

SEQ ID NO: 52195 - protein, 41 aa, Zea mays
  misc_feature: Ceres CLONE 1468436-F
  misc_feature (34)..(34): Xaa is any aa, unknown, or other
MESRRRAVPTVTAVAVATLLLTMMTSSGVGGDFXADRAECS

SEQ ID NO: 52196 - DNA, 673 bp, Zea mays
  misc_feature: Ceres CLONE 1468440-F
  misc_feature: Encodes the peptide sequence at SEQ ID NO. 52197
aagctggagctccccgcggtggcggccgctctagaactagtggatcccccgggctgcaggaattcgtctcacccctagaaaaactccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaaagcgctctgtagaggttgtgaag

SEQ ID NO: 52197 - protein, 168 aa, Zea mays
  misc_feature: Ceres CLONE 1468440-F
  misc_feature (6)..(167): Pfam Name: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKRLAPTIGISVDHRRKNKSLEGLQANVQRLKTYKAKLVIFPRRARKVKAGDSTLEELTTATQVQGDYMPITRGEKALCRGCE

SEQ ID NO: 52198 - DNA, 670 bp, Zea mays
  misc_feature: Ceres CLONE 1468445-F
  misc_feature: Encodes the peptide sequence at SEQ ID NO. 52199
ccgcggtggcggccgctctagaactagtggatcccccgggctgcaggaattcgtctcacccctagaaaaaaaaccataagagcttctgaagagcgaaatacttcaatctagacactagatacagtaagccttagcgcaccaacagaggatacttcaaatatgtctgcctcgcggagctcctctcacaactccatgtcacagtggagccagaaagagaacaagatgtttgaagaggcactcgcctactatggcgagggcacacccaaccggtgggacaaggtgtccagcgccatgcgaggcatcaagtctgccgacgcagtgcgctgccactatgataatctcgattacgacgtcaagatgattgaatcacgcaatgtgccgtaccccaagtacaagacacagggattctggacacgaagttaaaaaaatgtttgatgctcaaagaagcaacaaaacaagctctacgaatcccagaaggacccaaagaaatccccctctgggttgcagaataaaatgatgaaccatgcgggcatatgtcaaaaagccgcaaagaaaattttacgaacaaggttaagtgccggccaccccgggggttgggggaaacccccggggccctagaaaatggaaccccccctgggttttctttgttccccctgaaaaaaaaattttg

SEQ ID NO: 52199 - protein, 76 aa, Zea mays
  misc_feature: Ceres CLONE 1468445-F
MSQWSQKENKMFEEALAYYGEGTPNRWDKVSSAMRGIKSADAVRCHYDNLDYDVKMIESRNVPYPKYKTQGFWTRS

SEQ ID NO: 52200 - DNA, 680 bp, Zea mays
  misc_feature: Ceres CLONE 1468451-F
  misc_feature: Encodes the peptide sequence at SEQ ID NO. 52201
  misc_feature (654)..(654): n is a, c, t, g, unknown, or other
ggagctccccgcggtggcggccgctctagaactagtggatcccccgggctgcaggaattcgtctcacccctagaaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcaccaacaagcttgctaggctccgcagccaggaggacgagtagtctggtttcttgtcttaacgacgaactggatgttgccattcctttctgtagggaactactttgcttgtgtcttgttagtactgangaccagaggcactcctacctttttgc

SEQ ID NO: 52201 - protein, 133 aa, Zea mays; identical to SEQ ID NO: 13146
  misc_feature: Ceres CLONE 1468451-F
  misc_feature (14)..(123): Pfam Name: Ribosomal_L32e Pfam Description: Ribosomal protein L32

SEQ ID NO: 52202 - DNA, 679 bp, Zea mays
  misc_feature: Ceres CLONE 1468458-F
  misc_feature: Encodes the peptide sequence at SEQ ID NO. 52203
  misc_feature (365)..(365): n is a, c, t, g, unknown, or other
  misc_feature (415)..(415): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (568)..(568): n is a, c, t, g, unknown, or other
ctggagctccccgcggtggcggccgctctagaactagtggatcccccgggctgcaggaattcgtctcacccctagaaaaagcagcccagccagattcgacccgagttcacgacgagagcacgagatggcgatgcgaaccgcgctgacctccctccccgcgcgcctgcgcgctcctgcgccccccgcggcgacgggcggccggcgcctcctcagcgacgggaaggggcgcgtgctcagcgaggaggagcgcgccaaggagagcgtctacatccagaagatggagagggagcggcaggagaagctcaagaagaggctcgagcaggagaaggccgactccgactagggcaagcccgccgacgccgacnagaaggccgagggatctacctagctaggattggcatggcgctgttggaanggcatcacttttcgcatgtatccaaatcccgatggtcagctttgtgaatgaataaattctgtaaaacgtcacggccactggaattgcctgtgcttccggtgcctgcctgtttgaatttgaaaaccccttccatttttttgnnnaaaccccccngggggggacaccccgagggggaaaaacccccgaaaaaaaaaaaaaaaaaaaagggggtctagggaacggggaaataattatttaaaaggggcccccggggccaccattccc

SEQ ID NO: 52203 - protein, 72 aa, Zea mays
  misc_feature: Ceres CLONE 1468458-F
MAMRTALTSLPARLRAPAPPAATGGRRLLSDGKGRVLSEEERAKESVYIQKMERERQEKLKKRLEQEKADSD

SEQ ID NO: 52204 - DNA, 657 bp, Zea mays
  misc_feature: Ceres CLONE 1468460-F
  misc_feature: Encodes the peptide sequence at SEQ ID NO. 52205
  misc_feature (522)..(522): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
ctggagctccccgcggtggcggccgctctagaactagtggatcccccgggctgcaggaattcgtctcacccctagaaaaagcatttgctcatgggcggaggttgtcggagtccatcaatgagcatttcagtaacagtgggaagtacgatcaagtgttcccgaagaaggatgacaggaacattagggctgatggagctattggctacggatccaaaggcagcaagatccaccactctgggcccctgacctgcccttcaggcagcaacgtcgacgagatgctgaaggagaacgaccggcaaatccaagaagtgttccggagaacccgggtggagaagtcgagagcgaggagggaccatggacatcaccagggcggtataaggcccggcgatttcggcgccatcccagtcttcccttccagccgctccagctatcaggctgtgcagcagtaaggccggagctcgaacaagaatcggttggcgttggaacctccgatgtgtttcggtcccacgctttttccggganggggatgtgtagcatacgctatgctatgctatgtacagggacagggaggcggcagcacagcagcaccggcatccctctnnnngggggggaggagaagggggaaaaaaaatttgttttattggcggcgattccagt

SEQ ID NO: 52205 - protein, 148 aa, Zea mays
  misc_feature: Ceres CLONE 1468460-F
GAPRGGGRSRTSGSPGLQEFVSPLEKAFAHGRRLSESINEHFSNSGKYDQVFPKKDDRNIRADGAIGYGSKGSKIHHSGPLTCPSGSNVDEMLKENDRQIQEVFRRTRVEKSRARRDHGHHQGGIRPGDFGAIPVFPSSRSSYQAVQQ

SEQ ID NO: 52206 - DNA, 679 bp, Zea mays
  misc_feature: Ceres CLONE 1468465-F
  misc_feature: Encodes the peptide sequence at SEQ ID NO. 52207
ggagctccccgcggtggcggccgctctagaactagtggatcccccgggctgcaggaattcgtctcacccctagaaaaaatctcttcttccactgcctcccaaccacttcgtcctcgccggctcgcaactccttgatggcggccacggcgagtctcactaccactgctccctcccctccagctctcctcaaagcatcagctcctttgcttatctcctttcgccccgtctcccgccactgcaagaacctgtgcatcaagaccaaggccacagaaaatgatcagtctgctaaaaagcatcagaaggtgaagagcattctttgccaggactgcgaaggaaatggggcaatcacatgcaccaaatgtgaaggaaatggggtaaattctgttgactattttgaaggccgatttaaagctggatctttatgctggttgtgcagaggcaagcgtgaaatcctatgtgggaactgtaatggtgctggcttcttgggtggatttctgagcactttcgatgaaactgcgcaatagtcatcggtttaatttatgtttaagttacattgagggacccattatatatgtatcgtgttccagggacacataatcatattatataaaataatatttttaatgaatactcctttcgtctaaaaaaaaaaaaaaaacgagacgctcgaggtacccaa

SEQ ID NO: 52207 - protein, 129 aa, Zea mays
  misc_feature: Ceres CLONE 1468465-F
MAATASLTTTAPSPPALLKASAPLLISFRPVSRHCKNLCIKTKATENDQSAKKHQKVKSILCQDCEGNGAITCTKCEGNGVNSVDYFEGRFKAGSLCWLCRGKREILCGNCNGAGFLGGFLSTFDETAQ

SEQ ID NO: 52208 - DNA, 747 bp, Zea mays
  misc_feature: Ceres CLONE 1468466-F
  misc_feature: Encodes the peptide sequence at SEQ ID NO. 52209
gggtgtcaccctcgcaaccttctggggggtgggttcgggttttggtcgcggggtgtagagggggggtccccgcgggggaggccgctctagaatagggggatcccccgggctgcgggagttcgtctcacccctagaagagagcggcgccacggcggcgacgagaagtggcgagccccgagagcggctttagttagaggctacgggcggtcgggcgcggcggcggcggcggccatgagcagcgggagcgagagcagtaccgccagcaggtggcccgagctggccacgctgcgcgccctggcgcgcgacgccgcggagcagctgcggctgccgcgggccggcacgtcggcgtcggcgtcggcgtcgtcgtcgccgtggctgcgggcgcgaggaccacctccacgggcacggcaagaccgccaaggtgatgcacctgctgctctggggacccaagtgaaggcggcgagaggccaccgaaccgccggcgttgctcggtttgctctgcctgcgatccgccccgcagggactggactgtactgtacctgtacgcctatgtagtacgacgtgcacgttgtacaagtctacgaggtgcatgctgtaccatagtaatagctagtgcgctgctgctccctttggccttcttgcgggcagggttgcaccaggccacttcccgcttttgttttggttcgaaacgagccaactgagcttcggtcgagggacgggggcacggggcccgtctcttccctttat

SEQ ID NO: 52209 - protein, 107 aa, Zea mays
  misc_feature: Ceres CLONE 1468466-F
MSSGSESSTASRWPELATLRALARDAAEQLRLPRAGTSASASASSSPWLRARGPPPRARQDRQGDAPAALGTQVKAARGHRTAGVARFALPAIRPAGTGLYCTCTPM

SEQ ID NO: 52210 - DNA, 637 bp, Zea mays
  misc_feature: Ceres CLONE 1468470-F
  misc_feature: Translation starting site: 214
aaagctggagctccccgcggtggcggccgctctagaactagtggatcccccgggctgcaggaattcgtctcacccctagaaaaaacgggagagagagataggcgtgccttcgtcgtccgtgccggtgcgtggcgtggtggccgtgccgaccgtccgtccaccccctctcctcttcccggcgccggcgacagcgggagggactccctgggaggaatggccgtggtgagggctccgctcggcgcggtggcggtggccgctctcgtcgtcgccatcttcatgccggccgccgcagcggcgcaggcaccggcgcccgcgcccaccatcgacggcacatctatcgagctgggggatcgcgtacatccttatgctggtggccatggtgctcacctactgatcacccgctgacgcgtcctcccctacagctcttttatctcgctcctttcgtgggcctgcggttggggcctatagaattttagtgccgaaaagtcaagtgaggttggaagtttacaagatgaagatcgcatccttgaccttggatgttaccagggccccaacccgtgggggcccaattggtttaaatttccccgatcccttatctttgccccccccccttttgcccaaaaaaaaaaaaaacccc

SEQ ID NO: 52211 - DNA, 666 bp, Zea mays
  misc_feature: Ceres CLONE 1468472-F
  misc_feature: Encodes the peptide sequence at SEQ ID NO. 52212
  misc_feature (445)..(445): n is a, c, t, g, unknown, or other
  misc_feature (450)..(450): n is a, c, t, g, unknown, or other
  misc_feature (464)..(464): n is a, c, t, g, unknown, or other
aagctggagctccccgcggtggcggccgctctagaactagtggatcccccgggctgcaggaattcgtctcacccctagaaaaaacccctatccgatccaaccctctctggctgctcctccgtccggccggcatcggcagtgcacgatggctctgaggatgtgggcgagctcagccgccaatgcgctcaagctctcggcgggcggcggcggagcccgggctgctgctgccggcccggccttctctatctccaggttcttctccactgttcacgatgggttgaagtacactcagtctcacgaatgggtcaagacgacgggcgacgtcgccaccgttggcatcacggaccatgctcacggccacctgagagaggtggtgttcgtggagctgccggaccccggcacgaaggtcgccgcgcgaggacccttcggcaacgtggagagtgtncaggncaccagcgacgtcnactccccgatctccggcgaggtcgtcgaagtcaatgccaaactgtcagagacgcccggcctgatcaacacaaacccgtacgaggaaggttgggatgattcagggggaaccgaagcaccccgggggtaagggggacgccctgcttggaccccggccaggtacccccgggccttggcaagaaggaaaaacctccccttaaccgc

SEQ ID NO: 52212 - protein, 148 aa, Zea mays
  misc_feature: Ceres CLONE 1468472-F
  misc_feature (45)..(147): Pfam Name: GCV_H Pfam Description: Glycine cleavage H-protein
  misc_feature: SWISSPROT Homolog: EC 3.5.2.3 Dihydroorotase
  misc_feature (102)..(102): Xaa is any aa, unknown, or other
  misc_feature (107)..(107): Xaa is any aa, unknown, or other
MALRMWASSAANALKLSAGGGGARAAAAGPAFSISRFFSTVHDGLKYTQSHEWVKTTGDVATVGITDHAHGHLREVVFVELPDPGTKVAARGPFGNVESVQXTSDVXSPISGEVVEVNAKLSETPGLINTNPYEEGWDDSGGTEAPRG

SEQ ID NO: 52213 - DNA, 689 bp, Zea mays
  misc_feature: Ceres CLONE 1468481-F
  misc_feature: Encodes the peptide sequence at SEQ ID NO. 52214
  misc_feature (458)..(458): n is a, c, t, g, unknown, or other
  misc_feature (535)..(535): n is a, c, t, g, unknown, or other
  misc_feature (545)..(545): n is a, c, t, g, unknown, or other
aagctggagctccccgcggtggcggccgctctagaactagtggatcccccgggctgcaggaattcgtctcacccctagaaaaaaaaccagcacccgccgccgacagggaacatcgccggccgagatcggctgcacatctgtgctgcttcagggcgccggagttcgcgtcgtcgttcggtaacttgcggggtcaatgggaggagggaaagacaagcatgacgagagcgacaaggggctcttctcgaacatgatgcacggcgttgccggtggtcatgggtacccccaccagggataccctccgcagggctacccaccgcaaccaggagcatacccgcctcccccaggggcgtatcctcctcctccaggggcatatcctcctccacctggggcatacccaccacaatatgggtaccctcagccaggtggctacccacctcaaggtggatatcctcctgcangctaccccggctcatctcaccagggttatgggagcagccacggcgggggccacgggggccacatggggacgggggcnatgctagcangaagtgcttgccgcggccgctgccgcttatggagcacaccaagctttctcagggccatagccgaacacgggggaaatgggggcctttggaaagttatggtccccggtggttacgggccccggggtattggggcccccggcaaat

SEQ ID NO: 52214 - protein, 165 aa, Zea mays
  misc_feature: Ceres CLONE 1468481-F
  misc_feature (89)..(89): Xaa is any aa, unknown, or other
  misc_feature (118)..(118): Xaa is any aa, unknown, or other
MGGGKDKHDESDKGLFSNMMHGVAGGHGYPHQGYPPQGYPPQPGAYPPPPGAYPPPPGAYPPPPGAYPPQYGYPQPGGYPPQGGYPPAXYPGSSHQGYGSSHGGGHGGHMGTGAMLAXSACRGRCRLWSTPSFLRAIAEHGGNGGLWKVMVPGGYGPRGIGAPGK

SEQ ID NO: 52215 - DNA, 745 bp, Zea mays
  misc_feature: Ceres CLONE 1468482-F
  misc_feature: Encodes the peptide sequence at SEQ ID NO. 52216
  misc_feature (331)..(331): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (433)..(433): n is a, c, t, g, unknown, or other
  misc_feature (455)..(455): n is a, c, t, g, unknown, or other
aagctggagctccccgcggtggcggccgctctagaactagtggatcccccgggctgcaggaattcgtctcacccctagaaaaagatcaccggcgcatagcattctcttcccttccctgagcaaagagaagtagccacaagcatgtctggcatcatcgacaagatccaggagacgctccacatcgggggcgaccacaaggaggagcacgagcacaagaagggcgaggagcaccacaagaagggcgaggagcaccactagaaggacgacggggagcacaaggagggcatcgtggagaagatcaaggacaagatcaccggcgagcacggcgacnagtccggcgaccacaaggacaaagaccttatggagaagaannngatcagatgaagaagaaggacgacaagcccgggggagggcccatgaccatggtgatggntgacgggacacagcatcagcancagcgaacggcgactgatcttcggcctcgccccaagcgccgtggcgccacattttgcccccgcccagggttaaaaaacgggctgggccggccaaaacccctggggcttattttaaaacggtacccccccaaaattgggtgtcccgggaaccccccgggaaaaaaaagggtcctttttttgggttcccctttggccggggggtttccccccttggcgggagggggcctagaaaaaaaaaatttttttttgggttttccaaaaaaaaaaaaaaaacaaaaaccccgcggggc

SEQ ID NO: 52216 - protein, 38 aa, Zea mays
  misc_feature: Ceres CLONE 1468482-F
MSGIIDKIQETLHIGGDHKEEHEHKKGEEHHKKGEEHH

SEQ ID NO: 52217 - DNA, 668 bp, Zea mays
  misc_feature: Ceres CLONE 1468486-F
  misc_feature: Encodes the peptide sequence at SEQ ID NO. 52218
aagctggagctccccgcggtggcggccgctctagaactagtggatcccccgggctgcaggaattcgtctcacccctagaaaaactgtgacctgtccaccactctcatagcaaagaccatatccttccacttgctatggcggcggcggcgacggcgaccacgacctctccggcgagggcttcgtggcggcctacggttcccgcgacctcggcatcggcagcaggagtctgcttccgtgttggagcgaagcgctttccagggctccgaacggcaagcacctgtcggcaccgacaccgaggcaccacaaggctcacaaccgctcacgtgaagagcggggaagccgaggggcgtccaagcacggaggagagcgcaaccggcagcggcggcccggacgaggactccctgcggcgcgagctcgaaaccgcgatcgaggaggaggactacgcgcgcgccgcggcgctccgggacgagctccgcgtgctccaggaggacggccgggccgcggtgctggcggcgaacgcgcggttctacgccgcgttcaaggacggtgacctcgcggcgatgcgccgggcctgggccaggggcgaccacgtctacgtggtgcacccgtcggcggggaggatctccgggtacgagatggtgatgcagagctgggagatggtgtgcgac

SEQ ID NO: 52218 - protein, 178 aa, Zea mays
  misc_feature: Ceres CLONE 1468486-F
MAAAATATTTSPARASWRPTVPATSASAAGVCFRVGAKRFPGLRTASTCRHRHRGTTRLTTAHVKSGEAEGRPSTEESATGSGGPDEDSLRRELETAIEEEDYARAAALRDELRVLQEDGRAAVLAANARFYAAFKDGDLAAMRRAWARGDHVYVVHPSAGRISGYEMVMQSWEMVCD

SEQ ID NO: 52219 - DNA, 652 bp, Zea mays
  misc_feature: Ceres CLONE 1468494-F
  misc_feature: Translation starting site: 155
  misc_feature (101)..(101): n is a, c, t, g, unknown, or other
ccccgcggtggcggccgctctctaatagtggatcccccgggctgcaggaattcgtctcacccctagaaaaatgcccgcggtgctactgacggttgctctanatccgttcatcctggtggttttgtgaggtcgaaagcggcgagcgaattagaagatgctggacaagctgtgggacgacgtggtggccgggcctcgcccggagacgggcctcgagaagctccgcaaggccaccaccgcccgcccgctcgtcatcaacaaagacgcggacggcggctgctaccagcgggcgcaggcaatgccgtcgaccccgactacgccggtgacgcggtcttcgtcgtcgtcgtctattatccccccccccgcgggggggggggggcgcatcttcttccacccctgaaacacacccgccgccaaggggaatgggggcccacctgttcgggcgggggcggggcattcccctcacgggtgatgacaggcttgacggctcccattgccccggccagcccgggtttgagggggcggggagggtccggaattctggattgcgaaggttccggcggggccagggcaagccaaacctgcaaggatgcccctcttatgctctggccgctcggggggggacctggcgttctgagatggggacgcccccggg

SEQ ID NO: 52220 - DNA, 663 bp, Zea mays
  misc_feature: Ceres CLONE 1468496-F
  misc_feature: Encodes the peptide sequence at SEQ ID NO. 52221
ggagctccccgcggtggcggccgctctagaactagtggatcccccgggctgcaggaattcgtctcacccctagaaaaactccctcccttcttcgattgccgtcttctctggcttccattttcgcgaggaggcgaggtggacagagacgccgccgccgcttccgcttcgacctcgacctcggcttcggcttccacgagaattctagcaagtcttctggagaatataatccacatctgtttattttgctgcattttggtatggacgaatctgcctgtagatccactgccccagttgggtttcttagaagaggttcgggcatttccttgagaaatcaaagcaatgaggataggtcaaatcagtacaacaagcagccagggaagagttcaaatcccaatcctgtaaaattacggttcactgaaaataaagagaaaccaaggtattttcaagggacatttcattcatcaggctccagggcctcatctgtaagctcttcaaaagctcctgctagaaaatactgcgacgagagacagaaacagccctttttggcagagacagacattgctgacagcagtaacagaagaactgaggttagacgcctacaaagtggcaagaaagcttctgtatttggtgatgggcatccatacacacagaagagtatctcaa

SEQ ID NO: 52221 - protein, 135 aa, Zea mays
  misc_feature: Ceres CLONE 1468496-F
MDESACRSTAPVGFLRRGSGISLRNQSNEDRSNQYNKQPGKSSNPNPVKLRFTENKEKPRYFQGTFHSSGSRASSVSSSKAPARKYCDERQKQPFLAETDIADSSNRRTEVRRLQSGKKASVFGDGHPYTQKSIS

SEQ ID NO: 52222 - DNA, 630 bp, Zea mays
  misc_feature: Ceres CLONE 1468502-F
  misc_feature: Encodes the peptide sequence at SEQ ID NO. 52223
tccccgcggtggcggccgctctagaactagtggatcccccgggctgcaggaattcgtctcacccctagaaaaaacccgtagctgttcctgctgttgtcgtagccatagcatcccactcctccctcctcggtagattcgcctcatcgccttcctcctcctcctcctctctttctgctctccccgccctgcatggagccaggcgcgccgtggcgcggtccgcgccaggggtacgcctacggggtcggatcggcgacggcgatgcagatgcagctgcaggagcgggccgacgcggccgccggtggaggggtgctgaagaggagcctcggcgagctggagaggtggcagcaccagcagcagcacgtggcggcgcagcaggcgctgtacctgcgcgccgtgaggcagcgcacggctgcggcggttgatatcgccgccttgctgggagggatcccgtctcaggttgtccccgggtccagctttggaggggggctagcgtcgccttcgtcgacgttatcgtcgctcaccaccgcgtccagggcggcggtgccgctgatgcagccgcagccgcagaggcaggggccgctcatgacgtcctcaccgcagacgcaggccttcgggttatcgagggcgccg

SEQ ID NO: 52223 - protein, 147 aa, Zea mays
  misc_feature: Ceres CLONE 1468502-F
MEPGAPWRGPRQGYAYGVGSATAMQMQLQERADAAAGGGVLKRSLGELERWQHQQQHVAAQQALYLRAVRQRTAAAVDIAALLGGIPSQVVPGSSFGGGLASPSSTLSSLTTASRAAVPLMQPQPQRQGPLMTSSPQTQAFGLSRAP

SEQ ID NO: 52224 - DNA, 668 bp, Zea mays
  misc_feature: Ceres CLONE 1468516-F
  misc_feature: Encodes the peptide sequence at SEQ ID NO. 52225
  misc_feature (637)..(637): n is a, c, t, g, unknown, or other
tccccgcggtggcggccgctctagaactagtggatcccccgggctgcaggaattcgtctcacccctagaaaaaaagacgcgtgagcacttcctttcaccccctcgaccccgatcgaatcgctcgaacaattcactgtgcatcgatctaggcttgcgcgaggatccaattccatccgctctcctttgaggtcgtgatcctcggagttggaggagttcttcgcgagcctctttttgccccgatttctttttggcttatttgtgcgagctttctcaggagcagaagaggcagtttgcaattccgatgcacccaggcctcaagatccaactctgaggccttctccgaggcatccgcatcgatctgcgcaagaagatgggtaacgcgggaagcaacggtggaggccccgccactggtcaccgccgtcggagctccggccacggccatcaccagcaggcgccgccgcctccccagccgcaggagactgcgcccaaccgctacgtgttcgcggccgccacgccgtacccgccccagtaccctaaccccaatccgccgcagtactacccgcagtacgggaactactacccgccgccgccaccatccgtgccggtgccccttccggcgccgtacgaacacccacanaggccacccaccgccgcccctggcgagttcc

SEQ ID NO: 52225 - protein, 99 aa, Zea mays
  misc_feature: Ceres CLONE 1468516-F
  misc_feature (89)..(89): Xaa is any aa, unknown, or other
MGNAGSNGGGPATGHRRRSSGHGHHQQAPPPPQPQETAPNRYVFAAATPYPPQYPNPNPPQYYPQYGNYYPPPPPSVPVPLPAPYEHPXRPPTAAPGEF

SEQ ID NO: 52226 - DNA, 655 bp, Zea mays
  misc_feature: Ceres CLONE 1468526-F
ccccgcggtggcggccgctctagaactagtggatcccccgggctgcaggaattcgtctcacccctagaaaaaaatttgaacgttgttttctttagtctttgggtttcaagcggggaaccgcccctccttttggttcctgggccggcctcgccgggacgatccgggcggaatacattgtcaggtggcgagtttggctggtgcgtcacatctggtagccgataacgcaggagtgctactatgagctctaccagatcacaggtctcctgtgcaacaaaccgttaaaagctggtttgattctgatttcccttacgaatacgatgcgtgaaagcgtggcctatcgatctgtttagaccttcggagtttgaagctggaggtgtcacagatgttcccacagggataactggcttgtggcacccgaccgttcatagcgacgttgctttttgatccttcgatgtcggctcttcctatcgttgtgaatgacacttcaccaagtgtcggattgttcaccacacaatagggaacgtgagctgcgtttggaccgtcctgagacaggttacctttaccctactgatgaccacgccgcgatagtaagtcagtggctgccgaagccggcactcgcagcaggcaccggcatggacgtctcgtcttgtttcct

SEQ ID NO: 52227 - DNA, 671 bp, Zea mays
  misc_feature: Ceres CLONE 1468531-F
  misc_feature: Encodes the peptide sequence at SEQ ID NO. 52228
taaagctggagctccccgcggtggcggccgctctagaactagtggatcccccgggctgcaggaattcgtctcacccctagaaaaagagctagctagctgctctctctctctctcttttcacccaagcaagaacagagcccaagaggcctcaaaagaaccactgctcttcctccgcatagctcgtcgccctctctctcctatcagtcctcccagctccagctaccacagcagccctctcgcttaaaggaggagggagaagggggcgaggcgagcaatgtctgagcagcagcagccattgccgcagcctcggagcagcatgcgggaggcgctggagaaggaggacaaggagaaggcggctgcggcggcggcggccaaggagaaggcggcagtccccaagaacggcaacggcaacggcggcaagaatggcggcggcgccggcagcggcaacggcggagcgcccccgcagtccggggaggagacggcccgcgagatccaggtggtcagggaggcgtaccgccgcgagacggccgcgccggcctacgtcatacccgaggagccgccggccgtggtcgagctcgtcggctggtacatctacggcttctgctcctacttcatcacccacctgctgctgccggtcctcttcccggccatcatcacgcaggtcgccttcc

SEQ ID NO: 52228 - protein, 132 aa, Zea mays
  misc_feature: Ceres CLONE 1468531-F
MSEQQQPLPQPRSSMREALEKEDKEKAAAAAAAKEKAAVPKNGNGNGGKNGGGAGSGNGGAPPQSGEETAREIQVVREAYRRETAAPAYVIPEEPPAVVELVGWYIYGFCSYFITHLLLPVLFPAIITQVAF

SEQ ID NO: 52229 - DNA, 674 bp, Zea mays
  misc_feature: Ceres CLONE 1468533-F
  misc_feature: Encodes the peptide sequence at SEQ ID NO. 52230
  misc_feature (359)..(359): n is a, c, t, g, unknown, or other
  misc_feature (360)..(360): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
tggagctccccgcggtggcggccgctctagaactagtggatcccccgggctgcaggaattcgtctcacccctagaaaaatctcaacgcaaacccaactgtcttggttgcgcaagcaccaagcaggtggaagatgatggaggtggcgggggctcaggcccgcgcggttcccctcctgctccgcaacaccgcctccctgcggacctccgtctccgtctcctgcacgggctcccgccggagctgggtggcggcggccacggcggagggggacgagacccgcggcttcgacaaggtgcccatggacacccccggcgcgtaccgcctggtagaccgggacaccggccgcagcgtcatcgtgtgnngcggcaccgacgacagcgacgaagcctccatgccgtccccggcggtgctctcccgggacacgaccgccgccacagcccaagtgttgggggaggtacaggtatcgggaaatttcgcaggttcaaggcgcagaaaataaaatctttggtcacgaggtcagcttcacggaagaggaacagttctaatccctcaagcactgcctggtctgatgaatcttctttcgatggctctgatgatgaagaggaaagctattttgagagaagaagcggggnnnnnnnnnnnnnnnnnnnnnnnnnnnnnnnnnnnnnnnnnnnnn

SEQ ID NO: 52230 - protein, 120 aa, Zea mays
  misc_feature: Ceres CLONE 1468533-F
  misc_feature (75)..(75): Xaa is any aa, unknown, or other
  misc_feature (76)..(76): Xaa is any aa, unknown, or other
MEVAGAQARAVPLLLRNTASLRTSVSVSCTGSRRSWVAAATAEGDETRGFDKVPMDTPGAYRLVDRDTGRSVIVXXGTDDSDEASMPSPAVLSRDTTAATAQVLGEVQVSGNFAGSRRRK

SEQ ID NO: 52231 - DNA, 621 bp, Zea mays
  misc_feature: Ceres CLONE 1468577-F
  misc_feature: Encodes the peptide sequence at SEQ ID NO. 52232
  misc_feature (588)..(588): n is a, c, t, g, unknown, or other
  misc_feature (614)..(614): n is a, c, t, g, unknown, or other
ggagctccccgcggtggcggccgctctagaatagtggatcccccgggctgcaggaattcgtctcacccctagaaaaaagacataagacagcccgtcagcccctctcgtttttcatccgccttcgcctccaaccgcgtgcgctccacgcctcctccaggaaagcgagagcttctgcataagaacaacaaatcaaaagcttgatcagctcggtgccaacaaaacctcaacaaccaagtttcatgtctgatctcgacgtccagcttccatctgcctttggtatggctacttttcaatccatgatgacatgtttttttatattgtggttttacataatacatagtatcctccagcttcctgaagagtattactgaatagattgataacatcacacacacgaagttcatcttgaacatgcttattagtattttgtttgcatctgatggtatggcatcatctttgatagatccgtttgctgaggcaaatgctgaggactctggtgctggtcctggaacgaaggattatgtgcatgtgcgcatccagcagcgcaacggcagaaagagtctgactacagtccagggtctgaagaangagttcagctataacaagatcctcanggatctg

SEQ ID NO: 52232 - protein, 70 aa, Zea mays
  misc_feature: Ceres CLONE 1468577-F
  misc_feature (59)..(59): Xaa is any aa, unknown, or other
  misc_feature (68)..(68): Xaa is any aa, unknown, or other
MLISILFASDGMASSLIDPFAEANAEDSGAGPGTKDYVHVRIQQRNGRKSLTTVQGLKXEFSYNKILXDL

SEQ ID NO: 52233 - DNA, 645 bp, Zea mays
  misc_feature: Ceres CLONE 1468583-F
  misc_feature: Encodes the peptide sequence at SEQ ID NO. 52234
ctggagctccccgcggtggcggccgctctagaactagtggatcccccgggctgcaggaattcgtctcacccctagaaaaattcgtcatcattctctttctctgcctcgagatagtggggttcgttccacacactcgcctgcccgtgcttcgctcgctcccacggctttcttgcgctccacctacgattctgtgcgagaacgatcataatttcccatgctctatctacctgatcagagaaccttttgctcttctcaccggctactacgcccctcctcccgattactgtgacgtccactgctgtgtcctcgatcattacgggagaacgtctcttcagtatcagactcatttgcattctactcacttcgcataagacaaggaccacccctcggtacgtgtctatgatcctggaaacacccatgagctccagctctaaacctcatatgtgcacccatctatgtcctctcctgacactagtggtgacggctgctttgaaatggaggaggatctatgtcagaggttgtacctcatgttaccagttcgccttgtggccacccttgtcgtataactcccgtccatagatgaagccactatggaccatgaaccgatgacggcatggttcaggctgtatgatctggatgcatgca

SEQ ID NO: 52234 - protein, 122 aa, Zea mays
  misc_feature: Ceres CLONE 1468583-F
GAPRGGGRSRTSGSPGLQEFVSPLEKFVIILFLCLEIVGFVPHTRLPVLRSLPRLSCAPPTILCENDHNFPCSIYLIREPFALLTGYYAPPPDYCDVHCCVLDHYGRTSLQYQTHLHSTHFA

SEQ ID NO: 52235 - DNA, 1558 bp, Zea mays
  misc_feature: Ceres CLONE 1468594
  misc_feature: Encodes the peptide sequence at SEQ ID NO. 52236
aaacgctttccctttcttctccgttccatcgcctcctcccacttctctctgccgccccccacaccccagccgcgccattgcccactgcattgcagactgtaagccgggaatccacttggattggatcaatccatcggaaggcgccagatgaacggccggctgtcggcagagtaccagggcctggaggtgaaggtgcccggcctcttccggtgccccatctcgctggacgtgatgcgctcgcccgtgagcctctgcaccggcgtcacctacgagcgcgcctccatccagcgctggctcgactccggcaacaccacatgcccggccaccatgctctcgctcccctccaccgacctcgtcccaaacctcaccctgcgccgcctcatcgcgctctgggcgtccacggccgctccctcctcctcctcatcgcccgcggcggcgtccgccgtcggccccacgccggccgccgcggcggccgagctcctccgccgggtcgctgaccccgccgcggacccctgccccccgctccggaagctcgcggctttcctctccgacgacgacgtggacgagttcgacaagaacgcgctggctcgggccggcggggccgcggagaccgtggcgtccgtgctgcggcgagcgggcagggaggccgcggaggccgccgtgcgggtgctcgcggccatcgcggcgtccgactgcatcgaggaggagagcaagaggcgcgtggccgcggcgctggccgccgacgcgccgtccgcggccgcggccctggcgcgcgtgctgcggagcgccacctcgctcgaggcgcgggtggacgcggcgaggctggtggagtcgctgctccgcaatgcggcgccgggcgcgcgggcgacggtggcggactccgaggagctgctcggcgagctcatccgcctcgtcggccccgcggacgacaagggcggcctcgacaggcaggccgtggcggcggggctgtcgtgcctggcggccatcgcggcgacgcggcgggcccgcgccgagatggtccgcctgggcgccgtgcccgccgcggtgcgcatcctggaggccgacgccggttccccgagccaggcgctccgcgtgctggaggcggcggtcgggtgcgccgagggccgcgccgcggtgtgcgagtccgcggggtcggcggtgcccgcggtggtgtccaagatgatgaagggcgggatggccggcgcggaggcggctgtgtcggtgctgtgggcggtgtgccaccggtaccgtgaccggcgcgctgtggcggcggcggcggcgtgcgagagtgggctcaccaagctgctgctgctcatgcagagcggctgctcgccggcggtgcggcagatgacgtcggagctgctaaagatcttcagggtgaacggcaagagctgcgtcgcagggtacgactccaagaccagccacatcatgcccttctgatcctcactgctatcggtgatacaacagtggaaccagcatttgtctgttacccttttccagtttcgaatttttttgattcgttggaagtgcatacagtaggcaaaaaaaaaaaaaaaaa

SEQ ID NO: 52236 - protein, 430 aa, Zea mays
  misc_feature: Ceres CLONE 1468594
  misc_feature (15)..(89): Pfam Name: U-box Pfam Description: U-box domain
MNGRLSAEYQGLEVKVPGLFRCPISLDVMRSPVSLCTGVTYERASIQRWLDSGNTTCPATMLSLPSTDLVPNLTLRRLIALWASTAAPSSSSSPAAASAVGPTPAAAAAELLRRVADPAADPCPPLRKLAAFLSDDDVDEFDKNALARAGGAAETVASVLRRAGREAAEAAVRVLAAIAASDCIEEESKRRVAAALAADAPSAAAALARVLRSATSLEARVDAARLVESLLRNAAPGARATVADSEELLGELIRLVGPADDKGGLDRQAVAAGLSCLAAIAATRRARAEMVRLGAVPAAVRILEADAGSPSQALRVLEAAVGCAEGRAAVCESAGSAVPAVVSKMMKGGMAGAEAAVSVLWAVCHRYRDRRAVAAAAACESGLTKLLLLMQSGCSPAVRQMTSELLKIFRVNGKSCVAGYDSKTSHIMPF

SEQ ID NO: 52237 - DNA, 673 bp, Zea mays
  misc_feature: Ceres CLONE 1468603-F
  misc_feature: Encodes the peptide sequence at SEQ ID NO. 52238
  misc_feature (398)..(398): n is a, c, t, g, unknown, or other
  misc_feature (458)..(458): n is a, c, t, g, unknown, or other
  misc_feature (466)..(466): n is a, c, t, g, unknown, or other
  misc_feature (469)..(469): n is a, c, t, g, unknown, or other
  misc_feature (475)..(475): n is a, c, t, g, unknown, or other
  misc_feature (486)..(486): n is a, c, t, g, unknown, or other
  misc_feature (569)..(569): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (577)..(577): n is a, c, t, g, unknown, or other
  misc_feature (642)..(642): n is a, c, t, g, unknown, or other
aaagctggagctccccgcggtggcggccgctctagaactagtggatcccccgggctgcaggaattcgtctcacccctagaaaaaatcctgtccccctcccacctttcccttccccgccgctctcgcttcgcttgcccgcacaccgagatttcctgcccgctcgttccgctgctctcatcgactcctcctgcgtgcctgccgaccggtccgaggcacgccgcggcggaggctctgccggccgggtcgtcggattcggccttaggttggttggttgggttgggtcgcatgtccacggcggtggcgcggccggcgcacggcggattccggcggtcggggagcgggaagccggatccggacgaggcggacaggatgacgcggagcgccaacgggtattgggntccaagaagaggaggaggaagagcatggcgaaaaggcggcggcgaggaaagatttagggnaccaaggnaanaagaanaaggaggaggncggaggcggtgtcggaggcctcgtcgatcgggggcggcgtcgtccgacagctcctcctccatcggggagaatcgcggtccganannngggnagaagaagaaagaagaaggtttaaaattaaaggcgcaggggctttggcatggatggggctggccnacgctcgaatcccttggatgatgccctgccc

SEQ ID NO: 52238 - protein, 125 aa, Zea mays
  misc_feature: Ceres CLONE 1468603-F
  misc_feature (38)..(38): Xaa is any aa, unknown, or other
  misc_feature (58)..(58): Xaa is any aa, unknown, or other
  misc_feature (61)..(61): Xaa is any aa, unknown, or other
  misc_feature (62)..(62): Xaa is any aa, unknown, or other
  misc_feature (64)..(64): Xaa is any aa, unknown, or other
  misc_feature (95)..(95): Xaa is any aa, unknown, or other
  misc_feature (96)..(96): Xaa is any aa, unknown, or other
  misc_feature (98)..(98): Xaa is any aa, unknown, or other
MSTAVARPAHGGFRRSGSGKPDPDEADRMTRSANGYWXPRRGGGRAWRKGGGEERFRXPRXXEXGGGRRRCRRPRRSGAASSDSSSSIGENRGPXXGXKKKEEGLKLKAQGLWHGWGWPTLESLG

SEQ ID NO: 52239 - DNA, 661 bp, Zea mays
  misc_feature: Ceres CLONE 1468605-F
  misc_feature: Encodes the peptide sequence at SEQ ID NO. 52240
ggagctccccgcggtggcggccgctctagaactagtggatcccccgggctgcaggaattcgtctcacccctagaaaaagcctccgctgctatcccgctctctctcctctacctcctatcctcccagtcccagccagagcagttctgctggttctctgcgtctgctgcgctcccgccgctgctgctcgtgaagttattgcttcggagaggcagtgtgtttggatcgttttggtcagcctcctcggagttgtttgacttgaccggatcggacactgtttggtggctcaaccggccgcgatgccggactccgacaacgacgagtccggcgggccgagcaacgcggacttctcgtcgccgcgggagcaggaccggttcctgccgatcgcgaacgtgagccggatcatgaagaaggcgctcccggccaacgccaagatatccaaggacggcaaggagacggtgcaggagtgcgtgtccgagttcatctccttcatcaccggcgaggcctccgacaagtgccagcgcgagaagcgtaagaccatcaacggcgacgacctcctctgggccatgaccacgctcggcttcgaggactacgtcgagccgctcaagctctacctccacaagttccgcgagctcgagggcgacaaggcggccgcgggctcgca

SEQ ID NO: 52240 - protein, 121 aa, Zea mays
  misc_feature: Ceres CLONE 1468605-F
  misc_feature (25)..(90): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
MPDSDNDESGGPSNADFSSPREQDRFLPIANVSRIMKKALPANAKISKDGKETVQECVSEFISFITGEASDKCQREKRKTINGDDLLWAMTTLGFEDYVEPLKLYLHKFRELEGDKAAAGS

SEQ ID NO: 52241 - DNA, 656 bp, Zea mays
  misc_feature: Ceres CLONE 1468607-F
  misc_feature: Encodes the peptide sequence at SEQ ID NO. 52242
  misc_feature (656)..(656): n is a, c, t, g, unknown, or other
ggagctccccgcggtggcggccgctctagaatagtggatcccccgggctgcaggaattcgtctcacccctagaaaaaagcttcttacgtcgaatacacaccaaaacctacctagcttgccgcatgtgcttggggctgtccactaaaagtagtaagttacagaagcaaagcaaagctccgatccaatcctctccaccgcgaggattatgtctctggtaaggctcctgtacacactggttctgtactcgtgggtgcggaacccgttcaccatcttcggcacggcggtggccgacgacgcgtggctggtaagctgactcatcggagttcgccaacacgcacatcgagagtcgggacacgagcgtcagcctacgtgttcatcaccacactcccaccgggacgtctagtaagatgatgtcacggtgtatctagactaggagcaacgtgctggtcatcccctgtgagcgcagcgtgtgacgtcatgagcgcagccacggtcgccaccacatagatggcagccgcgccatcttcttcgtctggttacacatgcactaagacgacgtcgtcgacggcgtcatggacgccttggacgctgcagaatctcctctacatgcctacggtcgaggcctgcgccgcctcatctgaccgaaatgactcccn

SEQ ID NO: 52242 - protein, 35 aa, Zea mays
  misc_feature: Ceres CLONE 1468607-F
MSLVRLLYTLVLYSWVRNPFTIFGTAVADDAWLVS

SEQ ID NO: 52243 - DNA, 611 bp, Zea mays
  misc_feature: Ceres CLONE 1468610-F
  misc_feature: Encodes the peptide sequence at SEQ ID NO. 52244
  misc_feature (385)..(385): n is a, c, t, g, unknown, or other
  misc_feature (579)..(579): n is a, c, t, g, unknown, or other
  misc_feature (589)..(589): n is a, c, t, g, unknown, or other
  misc_feature (607)..(607): n is a, c, t, g, unknown, or other
aagctggagctccccgcggtggcggccgctctagaactagtggatcccccgggctgcaggaattcgtctcacccctagaaaaaccctaaggatgatcactacgactggagaggggtggcgcctcgggaaaaatacataaacaatctgctcaaggatttggacggggccatcaagagatcgactgcggcgtggaaggttgccgtgggccaccataccatgaggagtgtcagtgatcatggtgacaccaaggagctactgcagctactgcttccagtcctccaggccaacggcgtcgatttctacatcaacgggcatgaacactgcctggaacacatcagcagcagagacagcccaatccagtacttcacaagcggaagcggttccnaagcatgggagagagtgcagaacccccacgaagatgacctccagttcctctacgaacggcaaaggcttcatgtcccttcggctagaccgtagcccagcccagttcacctttttaccatgtccacgggaaagcgcctgaacggtacacaccggtcgaaagcttgatgaaacaaggcaacaccttcaaagcctccnggctacgtcnaacgaagaaatgaagccngggc

SEQ ID NO: 52244 - protein, 86 aa, Zea mays
  misc_feature: Ceres CLONE 1468610-F
  misc_feature (57)..(57): Xaa is any aa, unknown, or other
MRSVSDHGDTKELLQLLLPVLQANGVDFYINGHEHCLEHISSRDSPIQYFTSGSGSXAWERVQNPHEDDLQFLYERQRLHVPSARP

SEQ ID NO: 52245 - DNA, 675 bp, Zea mays
  misc_feature: Ceres CLONE 1468626-F
  misc_feature: Encodes the peptide sequence at SEQ ID NO. 52246
  misc_feature (616)..(616): n is a, c, t, g, unknown, or other
aagctggagctccccgcggtggcggccgctctagaactagtggatcccccgggctgcaggaattcgtctcacccctagaaaaaacagtcctcttcacaccacgaaatcagcagcaaagtcttcatcaacccacgatcggtcgatcgatcaggtacctgctaacgaattctatcgatcgggtacctgctgctaacgatttcctcaccagccagcagatcccgtcgtcacccgcacgatggccagcccgtcctcgtcgtcgtcgtcagctctggacgtcctcatggtggttctaacctcggcggtggcgtgctccccgacacgtcccttccccgcgcggcagacgtcgtcagccgcgaatgatgaggtcagaccgtcggacacgctgtaccagggcactgtgctgatcccggcgatggcgcgctacaatatcggcagccactacatcccggacatcggcgggctgtaccagagcgtctcccgcgccacccacgggtagtacatcccccctgcgtccaacaacacctcgtgtgcccacagccccggacctccaagagcccatcccttcgcccggatgggcactcctcgttccccgacgagtaccaccccccacggtcgnataaatccatcgatgtcttatcgtctcccccccccttgaaaaagcttaatgtaaggccg

SEQ ID NO: 52246 - protein, 86 aa, Zea mays
  misc_feature: Ceres CLONE 1468626-F
MASPSSSSSSALDVLMVVLTSAVACSPTRPFPARQTSSAANDEVRPSDTLYQGTVLIPAMARYNIGSHYIPDIGGLYQSVSRATHG

SEQ ID NO: 52247 - DNA, 555 bp, Zea mays
  misc_feature: Ceres CLONE 1468628-F
  misc_feature: Translation starting site: 168
  misc_feature (131)..(131): n is a, c, t, g, unknown, or other
ccccgcggtggcggccgctctagaactagtggatcccccgggctgcaggaattcgtctcacccctagaaaaaagcctccacccctcacccgccgcagccaatccctccccagcagccgtcgtcgccaccgnctgcagcgcggaggcgacccccccatcgccgccaagatgcagatcttcgtgaagaccctgacgggggaaaacgatcacgttggaggtggaggtctcggacaccatcgaccacgtgaaagcccaaatacaggaaaagggagggatcccgccggaaccagaaggggtttaatctttccccgggaaaaaaacttcggaaagggccgcccccctgcccgaaattaaaaattcccaaaaaaggggtcccccccccccccgacgggggggccccccccccccaaaagggggcccccacaacacccctataatagaaaaatttccccccccccccccaaaaaaatcttcccccccacccccaaaaaagggtaaaaaccccccggggggggtgtgttttccccccagggggggaaaaaaaccccccccggga

SEQ ID NO: 52248 - DNA, 656 bp, Zea mays
  misc_feature: Ceres CLONE 1468632-F
  misc_feature (656)..(656): n is a, c, t, g, unknown, or other
tcgtccaaagtgagaggccccgggctgcaggatgtcatcactcagcctagaaaaatttctcgagcctgagccttacgccttcgatctttgccaccaccaacaccgccgctacgccaagtacatcgacatcattactagacagccagaagacgcagcgcacttagaaggcaggaattgtcgccaaatatgaaaccaggtatggcgctacattgcgtaagaaaatccctaacatggacctatgtcagccctccgagtacccttccgcactctgtgggaagaaaagcagagaatttcatgctttttcgaatttcggggcgcgaggactgagggaatgtgatatatgaccgagactaaaccatgaacactgctgaaggaaccaccttttccaccccgaggcgccacctgggggacctgactgaagcatgacatagctctatatattattcgtgtttaatggagttcggcggatggagcatgctacggcgggtcttatctagtgaaaatgtcgaatcgctgcactgaattagtttccccagacaaggcggcttatgtttgcgataggcgcctcgatcctcagaaaataaatcgaaaatcgacgaggcttcgagagtacgccacttccccccttcggggtgagggatgacttacctcgccgn

SEQ ID NO: 52249 - DNA, 628 bp, Zea mays
  misc_feature: Ceres CLONE 1468635-F
  misc_feature: Encodes the peptide sequence at SEQ ID NO. 52250
  misc_feature (628)..(628): n is a, c, t, g, unknown, or other
ctagaactagtggatcccccgggctgcaggaattcgtctcacccctagaaaaatccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaaggaccgcaaggcgctcctggaccgcaaaggccggggccgcgcccccgacaaagctaaagcaaagtttactgccgaagacgtccctgccgccgccgctgttggcgccgccaccggggcctctctccagaaaatcaactaggctctccacggtcn

SEQ ID NO: 52250 - protein, 157 aa, Zea mays
  misc_feature: Ceres CLONE 1468635-F
  misc_feature (51)..(82): Pfam Name: KOW Pfam Description: KOW motif
MKRNPRVTSSRRKCRKAHFTAPSSVRRVLMSAGLSTELRHKYNVRSIPIRKDDEVQVVRGTYKGREGKVVQVYRRRWVIHVERITREKVNGSTVNVGIHPSKVIVTKLKLDKDRKALLDRKGRGRAPDKAKAKFTAEDVPAAAAVGAATGASLQKIN

SEQ ID NO: 52251 - DNA, 659 bp, Zea mays
  misc_feature: Ceres CLONE 1468638-F
  misc_feature: Translation starting site: 248
  misc_feature: SWISSPROT Homolog: EC 3.6.3.14 H(+)-transporting two-sector ATPase
ctggagctccccgcggtggcggccgctctagaactagtggatcccccgggctgcaggaattcgtctcacccctagaaaaagaccgacttcctcccagcccaagtggatgtgcaggaccgcgaacaccaagaggcaggggagcagcatccacaaccactagccatggcggggaggaccaacatccccgctaaaaactccgccctcatcgtaatcatcgccgacgaggacgccgtcactggcttctgtgatggccggcgttggctatgttgatctgcgcaagaaaaccaattacctcctcgtcgacaaacagacgacagataaacaaatcgaggacgcgttcaaacaatttactacaagggaggatattgctattgtgctcatcagtcagtatattgccaacatgataagatttcatggtggataactacgacaagccagtccctgctattctggagatcccatccaaggaccatccatatgatccagcgcacgactcggtgctgtctcgagtgaagtatctcttctctgcggaatcgatggcgtctgataggcgatgaaggcatccttgtgtagcagtacaccttggtgcatctgttttgttatgcaatggatagaagtggcatgcgtccgaacgagacacctacattaataatggctgc

SEQ ID NO: 52252 - DNA, 648 bp, Zea mays
  misc_feature: Ceres CLONE 1468643-F
  misc_feature: Translation starting site: 141
  misc_feature (480)..(480): n is a, c, t, g, unknown, or other
  misc_feature (481)..(481): n is a, c, t, g, unknown, or other
ctccccgcggtggcggccgctctagaactagtggatcccccgggctgcaggaattcgtctcacccctagaaaaagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccacagcaccgccgcctccggtgaggaccctcagaactgggatgcggactccgtcaaggtcgaccaggccccggnnctttcactcatcttggctgcaactatctgaacatcaggggtctgctcgacctgacctgtcagactggtgctgacatgatcagggggcagacaccagaagagattcgcaagacctcaacatcaagaatgactccccccctgaggaggaagaggagatccgcagggaaa

SEQ ID NO: 52253 - DNA, 658 bp, Zea mays
  misc_feature: Ceres CLONE 1468644-F
  misc_feature: Encodes the peptide sequence at SEQ ID NO. 52254
tggagctccccgcggtggcggccgctctagaactagtggatcccccgggctgcaggaattcgtctcacccctagaaaaaaagatttctttcccaatctcttcttgcgcctctcgcaccgggtagcatcacgcttccccatcccattcctagtccatcttcttcccctcctcaaggaagaaaagaagctgaaccatggggaagagaaagtctgctgctaagcctcctcctaagaagcggatggacaagcttgacactgtcttttcctgcccattctgcaaccacgggagtaatgttgagtgccaaattgacatgaagaatctgattggctaagcatcttgcacaatctgtcaggaaaacttcatcacaactgttaatcgcactcactgagcctattgatatatatagggaatggattgatgagtgtgagcgtgtctaccctgttgaacgcgaagatgatgcctgagcgtgagcttgccccctgcgatgaaactgttacctacaatcgcaatgtactgtgctggtattctcgattgccatatgccatagtctgccatggcttggaataacatagtggctgaccgatatgccactacgcaccttatctagtacttaccgaactacactacgtttgtactatacatatatggacaaccttat

SEQ ID NO: 52254 - protein, 45 aa, Zea mays
  misc_feature: Ceres CLONE 1468644-F
MGKRKSAAKPPPKKRMDKLDTVFSCPFCNHGSNVECQIDMKNLIG

SEQ ID NO: 52255 - DNA, 654 bp, Zea mays
  misc_feature: Ceres CLONE 1468645-F
  misc_feature: Encodes the peptide sequence at SEQ ID NO. 52256
  misc_feature (567)..(567): n is a, c, t, g, unknown, or other
  misc_feature (568)..(568): n is a, c, t, g, unknown, or other
  misc_feature (626)..(626): n is a, c, t, g, unknown, or other
ggagctccccgcggtggcggccgctctagaactagtggatcccccgggctgcaggaattcgtctcacccctagaaaaagtcgaaggcccgaccgcaacaaatcacaccgaatcaccctctcgcccaccaggccaccaccacaccacaccacaccacaccaccggcggcggcggcgacccagtcgagaacacgaaggcgatggcgacagcgctgaaccgcgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttatcttgagcgacatttttttgaagttaaagcttggacttcatcctatcttgggtgnntgctgatactgcattttcataccatagtttgtacctcgtttcttgccgtttggtgtangacacgacttttctggtaatatggtggg

SEQ ID NO: 52256 - protein, 92 aa, Zea mays; identical to SEQ ID NO: 6147
  misc_feature: Ceres CLONE 1468645-F

SEQ ID NO: 52257 - DNA, 627 bp, Zea mays
  misc_feature: Ceres CLONE 1468646-F
  misc_feature (174)..(174): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (591)..(591): n is a, c, t, g, unknown, or other
  misc_feature (620)..(620): n is a, c, t, g, unknown, or other
tggagctccccgcggtggcggccgctctagaatagtggatcccccgggctgcaggaattcgtctcacccctagaaaaagccgccccaacggcccttgcgatcgccaccacgtcagcgcggaggatgcacggccaccagcagcagccgtacccatacgggctgcgggcagacccnctgccgcggatgcaaggtcctgaacgtgaaatcggggctccaaggcaacccccgccaggttccggggggcccaggggggaatttggttcccccttgggggcccccctttttttcccccccggaaaaaacctttggggaaaaaaaataaaattttttttttttttttccaccccccccccttttttttttttttccggggggggtttattttccctttgggggggggggggggggtattataagaggggccccccccccccggggggggcgccctttttaaagaggggggttttttttcttctcaaaaaggggggggccccccccctnnnnnnaaaaaaaaaaaaaaaaaaaaaaagaagggggcgctcctctccttttttgtggggggcccgccgcccccccccccccccaaaaaanaaaaaccccctttttgttttttgtttttnctccccc

SEQ ID NO: 52258 - DNA, 703 bp, Zea mays
  misc_feature: Ceres CLONE 1468652-F
  misc_feature: Encodes the peptide sequence at SEQ ID NO. 52259
  misc_feature (473)..(473): n is a, c, t, g, unknown, or other
  misc_feature (540)..(540): n is a, c, t, g, unknown, or other
aagctggagctccccgcggtggcggccgctctagaactagtggatcccccgggctgcaggaattcctctcacccctagaaaaagctagaaagtgatttaaatctgaaaagaatgcggcactatgaagtagtttatctaattcatgaggaccgtgttgaagaagttgaaaatgttgtatcaaaagtacaagattttatcagggagaagaaaggaaggatatggaggcttaacaattgggggctgcgcaggcttgcttacaaaataaagaaagcaacacatgccaattacattttaatgaactttgagatagagtccaagatacatcaatgacttcaagaccctgctagacaaggatgagaggatcatcagacatctggttatgaaacgggatgaggcaattactgaagattgccctccccccaccagtatttcccacctcctgcgagctcaacaatatttttgatgaaatattngaaaaatgaagggggaaaaggaagaggatgaggatgcctaggagtgagccaaagtcctgccaattantgatgaggatgatgttgaagctgatgatgaccctgaaattatttatgtcgatgaagctgatgacgataattacgaagacactacaagaaggaacacaaagctaaaggtgaagaagttacatcagagaaggtattgaggcagccattactgtatggttttccac

SEQ ID NO: 52259 - protein, 72 aa, Zea mays
  misc_feature: Ceres CLONE 1468652-F
  misc_feature (2)..(72): Pfam Name: Ribosomal_S6 Pfam Description: Ribosomal protein S6
MRHYEVVYLIHEDRVEEVENVVSKVQDFIREKKGRIWRLNNWGLRRLAYKIKKATHANYILMNFEIESKIHQ

SEQ ID NO: 52260 - DNA, 672 bp, Zea mays
  misc_feature: Ceres CLONE 1468653-F
  misc_feature: Encodes the peptide sequence at SEQ ID NO. 52261
ctccccgcggtggcggccgctctagactagtggatcccccgggctgcaggaattcgtctcacccctagaaaaaactctgactctcatctgaagcgcgcgagagaaacgcgtatacccaggcggcggttgaggaagaggaggacaagaacaagaagatggcttcctccgcatacgcctcatggtccaagcggtggatccgtcccgaggtgtacccgctgttcgtgccgatggccgtggccttgggcatctgctcgtaccagcttgtgcgcaacatcacgggcaaccccgaggtgcggctgaccaaggagaagagggcggccggcgtcctgtacaaccacgacgagggcgagaggtacgctatgcacggcctctcgaagttcgtccgcgggaagaagcccgagatcatggcctccatcaactccttcttcgccgaccctcccaaggacgattaagctagattccgtcatggatggatggatggatggattcccgattcccgatcgtccatagtatgttttaccattcgttagctgccggcggcgcgccttgattcgtacccgtcgtccgtgcatttttttttgtttctaaaattctaattctcccatataaatggaacatcgtgcatttgtcgtgtttgcttgcaaaacacaaaaagaaacgagacgctcgagg

SEQ ID NO: 52261 - protein, 98 aa, Zea mays
  misc_feature: Ceres CLONE 1468653-F
  misc_feature (10)..(96): Pfam Name: B12D Pfam Description: B12D protein
MASSAYASWSKRWIRPEVYPLFVPMAVALGICSYQLVRNITGNPEVRLTKEKRAAGVLYNHDEGERYAMHGLSKFVRGKKPEIMASINSFFADPPKDD

SEQ ID NO: 52262 - DNA, 693 bp, Zea mays
  misc_feature: Ceres CLONE 1468654-F
  misc_feature: Translation starting site: 267
  misc_feature: Pfam Name: DUF605 Pfam Description: Vta1 like
ggagctccccgcggtggcggccgctctagaactagtggatcccccgggctgcaggaattcgtctcacccctagaaaaatttccaggacaacacgtcagcttctgttctgacgcatcagtcttcattctatcctgaaagtgatgatcccgcagctacatcacacactcctgcctcaaattcttctgtcccaacgcactaccacccaaccgctgactgttcacctcaagtcactcctccagctgcgccaccagctagccagtatagatatgatagcagttaccagcctgaagttgagaagattgctgaggcccacaaggcagccagatttgcggttggtgctcttgcgttcgatgacgtatctgttgctgtggatcacctgaaacgtgcactggatcttctgacgaacccatctgctgaaccccattagctctttgcacccccgagctcttgtcagaagcatcatctgtacaaatacaagattggtataccaccatgaatattttgccaggtcccgtacttatgaaaagggctacccccccaatctaggaaataatagccaaccctgggggccttttaaacccccccttaaagaaacttttttgggaaaaattcattttcttatttcaaaattcggttcccccaaaaccccgtggattcctttgaaaatccctgaggcccggaaaggaattttgt

SEQ ID NO: 52263 - DNA, 689 bp, Zea mays
  misc_feature: Ceres CLONE 1468656-F
  misc_feature: Encodes the peptide sequence at SEQ ID NO. 52264
aagctggagctccccgcggtggcggccgctctagaactagtggatcccccgggctgcaggaattcgtctcacccctagaaaaaattagaagctataaaccctacctctggccacctccccgagtctctcgcccctctctcccaccccgcagccgccctagcacccgcgacgagcaggatctgcccagttgctcttgcggtagttcccccaactgtcaccatgcagaacgaggagggtaagactgtggacctctatgtccccaggaagtgctcggccacgaacaggatcatcactgccaaggaccatgcctctgtccagatcaacattggccacttgaatgcgaatggcctgtatgatggtcacttcacaacgtttgctctctctgggtttgtccgtgctcacggtgacgcagacagctccttggacaggctgtggcaaaagaacaaggctgatatcaagcagtacattttacatctagtttaccaagaattggacaccgccttagctatgttttgaattcatgtcactatatgcaatgctgtgatttcaactggtaccttaaatctgaagatttagtatcaaaaaaaaaaaaaaaacgagacgctcagagtacccaattcgccctattgtgagtcatattacgcgcgctcactggccgtcgttgtacgacctcgtgactggcgaaaccc

SEQ ID NO: 52264 - protein, 98 aa, Zea mays
  misc_feature: Ceres CLONE 1468656-F
  misc_feature (1)..(81): Pfam Name: Ribosomal_S21e Pfam Description: Ribosomal protein S21e
MQNEEGKTVDLYVPRKCSATNRIITAKDHASVQINIGHLNANGLYDGHFTTFALSGFVRAHGDADSSLDRLWQKNKADIKQYILHLVYQELDTALAMF

SEQ ID NO: 52265 - DNA, 713 bp, Zea mays
  misc_feature: Ceres CLONE 1468657-F
tccccgcggtggcggccgctctagaactagtggatcccccgggctgcaggaattcgtctcacccctagaaaaaatcgaatccccgccaccaccagtccatcatgctccagatccagatcggcacacctccaagaacaagagctggtcctcctggtcataaccgagagacagagagaggccaatggcacccaagtggtggctcggcgcctccctgctgctctgcctctgcgtcacatcagcggaggaaagatcataatgccccgctactgcgacactgctgcccccttcccatcagcgacgccagtgcctgggctgtgaactacgacgactcagagccatctaccgcgaaatatcagggtgcggaccgtctggagggccccttcgcggaggccgcgaacccctttggcgaaaattccttgagtaccgccaccttggcggttcggctccccgggggtcccgctccagggaccaaaaagcctttgaggcccctttatttaaaaattaaaaaaaaaaggccccgaaaaaaaaaaaatatttgcccaccccccttttttttttaagaaaagacaccttttctttttttttacccgtgccccaatttttttcccaaatggcccccctttttttggggggggggtttgggtctcccccccacacctccttttataaaagaaaaatttgttgcacaaaaaaaaaattttgtgtggggaaag

SEQ ID NO: 52266 - DNA, 683 bp, Zea mays
  misc_feature: Ceres CLONE 1468674-F
  misc_feature: Encodes the peptide sequence at SEQ ID NO. 52267
tggagctccccgcggtggcggccgctctagaactagtggatcccacgggctgcaggaattcgtctcacccctagaaaaatcccacccctcgcccaatgcgtagttgtatctgcatctccaacaccaccagcagaggttccagttagttttttttagattagaaaaatcgagtccaacagactcgccgcactgcgcgggatcgacctcgtcgcaactcccgtgtgcgccgccaataatggagacccgggacacggatgcgacgccgctcccctactcgtacacgccgctgccggccgccgacgccgcgtcggccgaggtctccggcaccggcaggacgcggagcaggcggcggcccctctgcgcggcggcgctcgtgctctccgccgcgctgctcctagccgtggccgcgctcgtcggcgtcggtagccggcccggcgcggtggggatgacagagtcggcggcctcgtcgccgacgccgagcaggagcaggggccccgaggccggcgtgtcctaaaagacgtcccggcgcgtctgacgacggcggccggcatcgttgaagccggcggggaacgccttcccaggggagcaatgcgatgcttgcaggggcaccccaccgttatccccctcccacgcgcaaaaaaaactggagaaaccacccccatggcccccgtgtactaaaaggg

SEQ ID NO: 52267 - protein, 92 aa, Zea mays
  misc_feature: Ceres CLONE 1468674-F
METRDTDATPLPYSYTPLPAADAASAEVSGTGRTRSRRRPLCAAALVLSAALLLAVAALVGVGSRPGAVGMTESAASSPTPSRSRGPEAGVS

SEQ ID NO: 52268 - DNA, 664 bp, Zea mays
  misc_feature: Ceres CLONE 1468676-F
  misc_feature: Encodes the peptide sequence at SEQ ID NO. 52269
tccccgcggtggcggccgctctagaactagtggatcccccgggctgcaggaattcgtctcacccctagaaaaaactcgacacctcccgcgccaccttcttctcttctcccccccgcccgcctccagagaagaagcggggatctcctcctctgtcttgcactcatcctcacacaacctagaagagcggacgaggcacctagcttcacgttcttggtctccgttcatccactcctcccacccagaagaccccgctcggcctcttctctcttgcctcgagagagagagggagagagatacaggggagccagctacctccggccgccggcaggcaggcagagagggagggcgcgcccggcattatggcggcggggcagcagcaagcgagcggcggcggcgccaagcacgggtgcgtgtgcgggttccccgtgtgcgcgtgcgccggcgccgcggcggtggcgtccgccgcgtcctccgccgacatggaccgcgtggccgtggccgccaccgagggccagatcggcgccgtcaacgacgagagctggatcgccgtcgacctcagcgacaacggcctgtctgccgacggcggcggacccgggcgtcgcgctcgaggaccgccccggcttccgccacgagaagatcaggggcgtcctcttccaccctaacg

SEQ ID NO: 52269 - protein, 100 aa, Zea mays
  misc_feature: Ceres CLONE 1468676-F
MAAGQQQASGGGAKHGCVCGFPVCACAGAAAVASAASSADMDRVAVAATEGQIGAVNDESWIAVDLSDNGLSADGGGPGRRARGPPRLPPREDQGRPLPP

SEQ ID NO: 52270 - DNA, 758 bp, Zea mays
  misc_feature: Ceres CLONE 1468691-F
  misc_feature: Encodes the peptide sequence at SEQ ID NO. 52271
  misc_feature (417)..(417): n is a, c, t, g, unknown, or other
  misc_feature (418)..(418): n is a, c, t, g, unknown, or other
  misc_feature (457)..(457): n is a, c, t, g, unknown, or other
  misc_feature (573)..(573): n is a, c, t, g, unknown, or other
  misc_feature (630)..(630): n is a, c, t, g, unknown, or other
  misc_feature (718)..(718): n is a, c, t, g, unknown, or other
  misc_feature (721)..(721): n is a, c, t, g, unknown, or other
ggagctccccgcggtggcggccgctctagaactagtggatcccccgggctgcaggaattcgtctcacccctagaaaaaatccgacaccacaggctgcacaagatgaaccagctctctcttctccaccgcgccttccacctgcatctcctctctcccgaacgcggtcatggcctcacagccgccgtcatccgagtcggactgtcctcctctcaacacaccccacgacagcacgcaaagcgcctcctcgcagtagcacctcacgaaagcatcgcggcagccacggaggagagcagccgtccgcgtcaagagctcgcggcggcgggcaataagaacaacggcggcggcggcggcggcaggacctgcgcgctgccgacgtgggcgctcatcggcggcatcacggcggggggtggcccccgnntttgggacttgtccccgggggcccggcccccgccctggnccctggggcccgcgagggcccccctggtgggaggagttcctggggacaacatggcggcggtttacccgccttgtacgttggtgaaagggggaacaaaaaggggggggccgtaatancgggggtttggcacccccaaaaatgggaaactgggctcgaaaaaaaccccaattcanagggcgccttggctccatcccgggggggcctgttcctttccgccggcgaaaggcggcctttccccctcgatttctcaaccaagggggnctncccaatggccccctggggtctccgggaacacccctca

SEQ ID NO: 52271 - protein, 155 aa, Zea mays
  misc_feature: Ceres CLONE 1468691-F
  misc_feature (106)..(106): Xaa is any aa, unknown, or other
  misc_feature (119)..(119): Xaa is any aa, unknown, or other
MNQLSLLHRAFHLHLLSPERGHGLTAAVIRVGLSSSQHTPRQHAKRLLAVAPHESIAAATEESSRPRQELAAAGNKNNGGGGGGRTCALPTWALIGGITAGGGPRXWDLSPGARPPPWXLGPARAPLVGGVPGDNMAAVYPPCTLVKGGTKRGGP

SEQ ID NO: 52272 - DNA, 533 bp, Zea mays
  misc_feature: Ceres CLONE 1468702-F
  misc_feature: Encodes the peptide sequence at SEQ ID NO. 52273
  misc_feature (359)..(359): n is a, c, t, g, unknown, or other
  misc_feature (388)..(388): n is a, c, t, g, unknown, or other
  misc_feature (389)..(389): n is a, c, t, g, unknown, or other
  misc_feature (411)..(411): n is a, c, t, g, unknown, or other
  misc_feature (421)..(421): n is a, c, t, g, unknown, or other
cgcggtggcggccgctctagaactagtggatcccccgggctgcaggaattcgtctcacccctagaaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaagggcgacattggccgcctcttcatcngcggcttcggtttcctccatgctctttcnngcaccatcgtcggatccctcgncgaataacanggggcgaagaaggcgtgtgtcacgtactgcatcacctacatctcagctgcatcacaagcactctccccagtacaaagttcttatgatgggcctggtcttggtggcattgccc

SEQ ID NO: 52273 - protein, 98 aa, Zea mays
  misc_feature: Ceres CLONE 1468702-F
  misc_feature (80)..(80): Xaa is any aa, unknown, or other
  misc_feature (90)..(90): Xaa is any aa, unknown, or other
  misc_feature (97)..(97): Xaa is any aa, unknown, or other
MEVFYYLVFGALAAIVAALELAKSGKDRVATSPAFNSFKNNYILVYSLMMSGDWLQGPYVYYLYSQYGFDKGDIGRLFIXGFGFLHALSXTIVGSLXE

SEQ ID NO: 52274 - DNA, 686 bp, Zea mays
  misc_feature: Ceres CLONE 1468704-F
gctctagaactagtggatcccccgggctgcaggaattcgtctcacccctagaaaaaaagttaaactgggcatcatatagtgtgggcgaaaaacgctcggaaatttcgtctgataactcgatatttgttgtcgatttgactgttgatgttactgatgagatgttgctggaacttttttgtaccagtaccgatcggtgaaaggagctacagttattattgatgcaaacccagggcgttctcgaggctacggctttgttaggtttgcagatgataatgacaaaattcatgccatgattcgacatgagtggtgtttactgttccacaagaccgattcgtgtaagcccctgccactcctagaggatctcaaggtgattctggcacttcaccaccaaggcaatcccatgttgactctactaccaccacggtatatgatcgccggctttgtccccaatgttagccaaagaagacctggaggaaaccctttgccaaaatatggtggatctttgcctctgtccaaatttcctttttgggaaaaaagagggggtttggttcccatttcgtcacccacagttcgatgcttaaaagaaaccaatgccagggggcttgcattgggatcaaattatattggttaaagacagccccgtttgcggacttttccctgggggccccccaaacccatggcaccgg

SEQ ID NO: 52275 - DNA, 628 bp, Zea mays
  misc_feature: Ceres CLONE 1468705-F
  misc_feature: Translation starting site: 163
  misc_feature: SWISSPROT Homolog: EC 2.4.1.210 Limonoid glucosyltransferase
tccccgcggtggcggccgctctagaactagtggatcccccgggctgcaggaattcgtctcacccctagaaaaagtgatccacgcttccacgggcgcacagggctttttgccggccattacagaggagaggaggccgacaaaggcgtggcagaggtcccatccatgggagaggaagcggccgcggccacggccacggccaccgtggcggcagggaacgcacctccgcacctgctcctggtatgcttcccggggcagggtcacgtgaacccgatggtccgcctggccaagcgcatcgcggccaagggcccccttgtgaccttctcctcgctctccagcatcggggcgaagctcaccgcgtccgcgggcgtatcggccggcggcgacggcgtgccggtgggccggggccgcgtccggttcgagttcatggacgacgaggaccccgggcctgacctggacgacctcatgcgccacatcgccaaggacggcccgccggcgctggccgagctgctgggggcgcaggcacgggcccggcgccccgtggcgtgcgtggtggtgaacccgttcatgccgtgggcggtcgacgtggccgccgacgccgggatccccctcggcgtgctgtgggtgcagt

SEQ ID NO: 52276 - DNA, 662 bp, Zea mays
  misc_feature: Ceres CLONE 1468706-F
  misc_feature: Encodes the peptide sequence at SEQ ID NO. 52277
tccccgcggtggcggccgctctagaactagtggatcccccgggctgcaggaattcgtctcacccctagaaaaacccgtctcgtcctccttcctctcaagagtcgagacccaggcagccaggcttccagttccagccccacctcgcctctaccctcctcaaaccctacaccacgccccccggcccccagcccccggccttcgcccaacccgatagcgtagcgccggcgcagaaccggaccctgccgtgcggttgtccaccccgctcggcgccgcccgccgccgccgccgcctttgatgtctcctacctgcgacctcggcttcctctgcccccggtcgcagaagagctcccaagaggtcccccgagccaccgcttccggcgcccagcgattggcttccccaccgcagccgagatgagcagcggcggcgagaagatgttgttgtttgggtcctttacggaggacgagactaagttgttacagggtcagcccctcaaaagtccaactaaaagtgtcagcaaagaatgtgaacggacggagatccagtttggcaccctgaacttgtcagtgctgaatttagagaaatatctacttcaagtgttgttcttcctgcaaaatcagcaaaaggggaaaccagtgccatcacgaaggagaatgcatgcaata

SEQ ID NO: 52277 - protein, 84 aa, Zea mays
  misc_feature: Ceres CLONE 1468706-F
  misc_feature: SWISSPROT Homolog: EC 3.1.2.15 Ubiquitin thiolesterase
MSSGGEKMLLFGSFTEDETKLLQGQPLKSPTKSVSKECERTEIQFGTLNLSVLNLEKYLLQVLFFLQNQQKGKPVPSRRRMHAI

SEQ ID NO: 52278 - DNA, 638 bp, Zea mays
  misc_feature: Ceres CLONE 1468714-F
  misc_feature: Encodes the peptide sequence at SEQ ID NO. 52279
ggagctccccgcggtggcggccgctctagaactagtggatcccccgggctgcaggaattcgtctcacccctagaaaaaacgatacaaatgactccactagacctgcaaatctcgagcatcatcagaacagtttgcagacagacaggcaggcagcggcagttaccaccgccacctccaccctgtgctccaccgtgtcgcttccctcccgttggccgtcatgtgctcctgcctctcctccgaggcccccgccgccggcgatggcccagcggcgtggcggaagcggcgccacgggagccaggagggcgcggccgccggcgccggcgccgccggcggcggtgggaagaagctgcccggaggagcgggggagatgacggaggacgagctcgcgcgggtccccgggaggttgtgcggcaaaggcgccagcgcggtggcgtgcctccacacgcagcatggccggaagggcaccaaccaggacgccatggtcgtgtgggagagttttaattcaagcgacagcatcttctgtggtgtgtttgatggccatgggccatacggtcattttgttgcaaagaaagttagagattcacttcctgtcaagttgcgcacacaatgtcaaactagtgctaatgggggctctagtc

SEQ ID NO: 52279 - protein, 140 aa, Zea mays
  misc_feature: Ceres CLONE 1468714-F
MCSCLSSEAPAAGDGPAAWRKRRHGSQEGAAAGAGAAGGGGKKLPGGAGEMTEDELARVPGRLCGKGASAVACLHTQHGRKGTNQDAMVVWESFNSSDSIFCGVFDGHGPYGHFVAKKVRDSLPVKLRTQCQTSANGGSS

SEQ ID NO: 52280 - DNA, 661 bp, Zea mays
  misc_feature: Ceres CLONE 1468773-F
  misc_feature: Encodes the peptide sequence at SEQ ID NO. 52281
  misc_feature (397)..(397): n is a, c, t, g, unknown, or other
  misc_feature (513)..(513): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (546)..(546): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (571)..(571): n is a, c, t, g, unknown, or other
  misc_feature (572)..(572): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (595)..(595): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (656)..(656): n is a, c, t, g, unknown, or other
  misc_feature (657)..(657): n is a, c, t, g, unknown, or other
aaagctggagctcaccgcggtggcggccgctctagaactagtggatcccccgggctgcaggaattcgtctcacccctagaaaaaagaggcacatccttattggaagggcagctaataaggtaataaggggcgacgaaaatggctccaacgaccgccaccaaggacgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgcctctgccgccgtcgtcgtcgccctccgccgccgccatcccggtggtggacctctcggtgacgcgccgcgaggacctantcgagcaggtgaggcacgcggccgggacggtgggcttcttctggctggtgaacacggcgtggcggaggagctgatgggcggcatgctcccgcgggtgcgccagttcaacgaggggncccnnnnnnnnnnnnnnnnnnnnnnnnnnnngnggnnnnngnnnnnnnngngnnnngnngnnnnnnnnnnnnnnnnnngggnggggggggggggggggggnnnggnnnnnnnnnnnccgggggggggggaccccccccccccnncaac

SEQ ID NO: 52281 - protein, 110 aa, Zea mays
  misc_feature: Ceres CLONE 1468773-F
  misc_feature: SWISSPROT Homolog: EC 1.14.11.20 Desacetoxyvindoline 4-hydroxylase
  misc_feature (87)..(87): Xaa is any aa, unknown, or other
MAPTTATKDDSGYGDERRRELQAFDDTKLGVKGLVDSGVKSIPSIFHHPPEALSDIISPAPLPPSSSPSAAAIPVVDLSVTRREDLXEQVRHAAGTVGFFWLVNTAWRRS

SEQ ID NO: 52282 - DNA, 648 bp, Zea mays
  misc_feature: Ceres CLONE 1468788-F
  misc_feature: Encodes the peptide sequence at SEQ ID NO. 52283
  misc_feature (617)..(617): n is a, c, t, g, unknown, or other
caaagctggagctccccgcggtggcggccgctctagaactagtggatcccccgggctgcaggaattcgtctcacccctagaaaaaaggacgacccaagcaagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcaacaccaggagcctcggcaacgtcagcaacggcggaaggatccggtgcatgcacgtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatgtggaagctgcccatgttcggctgcaccgacgccacgcatgtgtacaaggagctgcaggaggccatcgccgcgtacccggacgccttccaccgcgtcatcggctccnacacgtcaggcagaaagcagtgcgtcagctt

SEQ ID NO: 52283 - protein, 160 aa, Zea mays
  misc_feature: Ceres CLONE 1468788-F
  misc_feature (58)..(160): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
  misc_feature (151)..(151): Xaa is any aa, unknown, or other
MAPTVMMASSATAVAPFQGLKSAASLPVARRNTRSLGNVSNGGRIRCMHVWPAYGNKKFETLSYLPPLSTDDLLKQVDYLLRNGWIPCLEFSKLGFVYRENSTSPCYYDGRYWTMWKLPMFGCTDATHVYKELQEAIAAYPDAFHRVIGSXTSGRKQCVS

SEQ ID NO: 52284 - DNA, 447 bp, Zea mays
  misc_feature: Ceres CLONE 1468789-F
  misc_feature: Translation starting site: 161
tggagtccccgcggtggcggccgctctgaatagtggatcccccgggctgcaggattcgtctcacccctagaaaagagcacgagactgctcggccgacgaaataataaagcgcgcgcgcgcacgcggagaggctcggagagctgagtgagatgcacaaaccatggcgtccatgaccggcctctcgcagggcgttctgcccagcaggcgcgccgccaacagggccaggacggccgccgtcgtcagggcgtccgccgagggcgcaggcgggccggcgcgcccgtgctcggggctggtgggccactggcttcggtccggcggggcccttgtccccaggggggggtggcacccccaaaaacccgtccaagaaccttcccaatttggggaggcccccgggggggggccggccctttgggggggggggaaatccccccccggggggaaaatttt

SEQ ID NO: 52285 - DNA, 620 bp, Zea mays
  misc_feature: Ceres CLONE 1468792-F
  misc_feature: Translation starting site: 155
  misc_feature (559)..(559): n is a, c, t, g, unknown, or other
  misc_feature (565)..(565): n is a, c, t, g, unknown, or other
  misc_feature (571)..(571): n is a, c, t, g, unknown, or other
aaagctggagctcaccgcggtggcggccgctcctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaacccgggagctggaggtgatccactcccgctggggcatgctgggcgcgctcggctgcgtcttccccgagctgctcgcccgcaaacgcgtcaagttcggcgaaggccgtgtggttcaaggccngctccnagatcntcaacgagggcgggctggactacctcgggaaccgaagcctcatcacgcc

SEQ ID NO: 52286 - DNA, 654 bp, Zea mays
  misc_feature: Ceres CLONE 1468806-F
  misc_feature: Encodes the peptide sequence at SEQ ID NO. 52287
  misc_feature (407)..(407): n is a, c, t, g, unknown, or other
  misc_feature (444)..(444): n is a, c, t, g, unknown, or other
  misc_feature (528)..(528): n is a, c, t, g, unknown, or other
ggagctccccgcggtggcggccgctctagaactagtggatcccccgggctgcaggaattcgtctcacccctagaaaaatcgccctctcgccatcggcaggctacggtggctgcttccccgagcctgcaggtagaccaccttgtgttgattcctcgagtcttcacctggtgcttccgtttgcagcttcatttttaactaagtctgtaatttattggctgtttatctgagtgacactacactctctgttttttcttattagatgtcacaagccaaggaagtgaggtacactgcacggtctattacacctcctgctgatagaaatggcacttcaaggtcgcctcccctcaagagacgcagccctttcagggtcactccaccaaagagtgcttcacggtccccacgtccanggagtccaaagaacgcagcacttcaggtctcctcctngaaacttggtaaatcaagttcaaggaaaagaaatcggtccaggaacccaaaataataaaaatcccgggaaaaaccctttagtgnaccggggaattggcccaccgcggggaaacgaaaaagaatttttaaaaaatctcttttttaaaaaaagaaaggttaaaaactggcttgtttttttcccacccccagaaaaaaaaaaccccggggttt

SEQ ID NO: 52287 - protein, 79 aa, Zea mays
  misc_feature: Ceres CLONE 1468806-F
  misc_feature (50)..(50): Xaa is any aa, unknown, or other
  misc_feature (62)..(62): Xaa is any aa, unknown, or other
MSQAKEVRYTARSITPPADRNGTSRSPPLKRRSPFRVTPPKSASRSPRPXSPKNAALQVSSXKLGKSSSRKRNRSRNPK

SEQ ID NO: 52288 - DNA, 661 bp, Zea mays
  misc_feature: Ceres CLONE 1468819-F
  misc_feature: Encodes the peptide sequence at SEQ ID NO. 52289
  misc_feature (458)..(458): n is a, c, t, g, unknown, or other
  misc_feature (567)..(567): n is a, c, t, g, unknown, or other
  misc_feature (568)..(568): n is a, c, t, g, unknown, or other
  misc_feature (577)..(577): n is a, c, t, g, unknown, or other
  misc_feature (578)..(578): n is a, c, t, g, unknown, or other
  misc_feature (581)..(581): n is a, c, t, g, unknown, or other
  misc_feature (583)..(583): n is a, c, t, g, unknown, or other
  misc_feature (584)..(584): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (599)..(599): n is a, c, t, g, unknown, or other
  misc_feature (601)..(601): n is a, c, t, g, unknown, or other
  misc_feature (602)..(602): n is a, c, t, g, unknown, or other
  misc_feature (607)..(607): n is a, c, t, g, unknown, or other
  misc_feature (608)..(608): n is a, c, t, g, unknown, or other
aagctggagctccccgcggtggcggccgctctagaactagtggatcccccgggctgcaggaattcgtctcacccctagaaaaagccaggccacacgcacaccaagagatagagattgctggtcgagaagaagagatgttacatatataataactactgtaggcagcggcatctcctgctgggacgaaggttcaagaagctagctaagagagaagggcataacgagataataagcagcgcgcgaagatgcaagactgggcgccggtgttcgtctcgctggtgctcttcatcctgctgtcgccgggcctgctgttccagatgccgggcaagtgccggatcatcgagttcggcaacttccagaccagcgccatctccatcctcgtccacgccatcctcttcttcgccctcgccgccatcttcctcgtcgccgtcggggtgcacatgtacctcggctcctangcggcggcgcggggcgcccgtacttctctctctcagcgcgcgcgccatcgttctcctcttttatggtctctctctataaatatagcctgtatgaatgaatgatatcatnnatatatgtnnaanannccnnnnnnnnnnncntnnaaaannatggaaaaaaattaaaataccgaggacgctcgaggtacccaattccccccaaa

SEQ ID NO: 52289 - protein, 104 aa, Zea mays
  misc_feature: Ceres CLONE 1468819-F
  misc_feature (71)..(71): Xaa is any aa, unknown, or other
MQDWAPVFVSLVLFILLSPGLLFQMPGKCRIIEFGNFQTSAISILVHAILFFALAAIFLVAVGVHMYLGSXAAARGARTSLSQRARHRSPLLWSLSINIACMNE

SEQ ID NO: 52290 - DNA, 531 bp, Zea mays
  misc_feature: Ceres CLONE 1468823-F
  misc_feature: Encodes the peptide sequence at SEQ ID NO. 52291
  misc_feature (316)..(316): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (388)..(388): n is a, c, t, g, unknown, or other
  misc_feature (421)..(421): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (451)..(451): n is a, c, t, g, unknown, or other
  misc_feature (454)..(454): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (513)..(513): n is a, c, t, g, unknown, or other
  misc_feature (516)..(516): n is a, c, t, g, unknown, or other
cggccgctctagaactagtggatcccccgggctgcaggaattcgtctcacccctagaaaaaatgccgccgccgccgccggtgaatccacagcggctttcgccggcagagtcccgagagcggacgctgtacttcttccatggtctgggcgtggacgtgcccctcccggtctcggccgagcggcccgacgcctacacctcgctcgtccgcgccatcgtctcctccgccgcagtcacctcctcgcgcgtctcctgcaccctcaccgtctctcccgccgtcgcgaaccagtacaacacgctccacggcggcgcggtggcnggcgtggctgagccgtcgggatggcgtgcgcgccgcccccccggcttggggggnnncnnngggggggggggnttctcccctccccccccccgcggggggcggggngggccgcccnnnnccccccccccccccccnggnccccaccacccccccccggggggggggggnnnncggnnnnngcgggcgcgcccccgccnccncccccccccccaaca

SEQ ID NO: 52291 - protein, 156 aa, Zea mays
  misc_feature: Ceres CLONE 1468823-F
  misc_feature (104)..(104): Xaa is any aa, unknown, or other
  misc_feature (105)..(105): Xaa is any aa, unknown, or other
  misc_feature (124)..(124): Xaa is any aa, unknown, or other
  misc_feature (125)..(125): Xaa is any aa, unknown, or other
  misc_feature (142)..(142): Xaa is any aa, unknown, or other
  misc_feature (144)..(144): Xaa is any aa, unknown, or other
  misc_feature (145)..(145): Xaa is any aa, unknown, or other
  misc_feature (151)..(151): Xaa is any aa, unknown, or other
  misc_feature (152)..(152): Xaa is any aa, unknown, or other
MPPPPPVNPQRLSPAESRERTLYFFHGLGVDVPLPVSAERPDAYTSLVRAIVSSAAVTSSRVSCTLTVSPAVANQYNTLHGGAVAGVAEPSGWRARRPPGLGGXXGGGGFSPPPPRGGRGGPPXXPPPPPGPHHPPPGGGGXRXXRARPRXXPPPQ

SEQ ID NO: 52292 - DNA, 674 bp, Zea mays
  misc_feature: Ceres CLONE 1468827-F
  misc_feature: Translation starting site: 144
  misc_feature (476)..(476): n is a, c, t, g, unknown, or other
  misc_feature (665)..(665): n is a, c, t, g, unknown, or other
ctccccgcggtggcggccgctctctaactagtggatcccccgggctgcaggaatgtcgctcacccctacataaaatacagagctccctcctcttgcgattcgctcgctcgatcctagcttcccttccaagaagcgcaacgcccatggccatgggcacgcaaggctccgccgccacgcgccacctggtgggcgccgcctgggcgcccgcggcgaaaacgcggcagctgaaatgcaactcgcgctggcgtcgtcgtcctcccgcggggcggccccgctccgcgcgttcaaccgaagaagcggtggaagcgcccccaaggggttcgtggcccccgcactggatacccaacacccccctcccccgatatttcggcggggaagaacggggcgggctgcttccccaaggggcaagggtggaaggagtctaactcaatcacctggacgtccccaagggagcaggtgtcgagatgcccacccgncgcgccgccatcatgccgaaggccccaaccctcttgaaactggcgcgcaaggagcaatggctggcgctccggaccaagttgcgctcccagtacaagatcacctaccagtttctaacgcgtctcccccaacggggaagtgcagtacctccaccccaaagaacggcgtctacccgaaaaagtcaaccccgncagggaagg

SEQ ID NO: 52293 - DNA, 670 bp, Zea mays
  misc_feature: Ceres CLONE 1468829-F
  misc_feature: Encodes the peptide sequence at SEQ ID NO. 52294
  misc_feature (401)..(401): n is a, c, t, g, unknown, or other
  misc_feature (402)..(402): n is a, c, t, g, unknown, or other
  misc_feature (450)..(450): n is a, c, t, g, unknown, or other
  misc_feature (484)..(484): n is a, c, t, g, unknown, or other
  misc_feature (502)..(502): n is a, c, t, g, unknown, or other
ctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgctttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggnncgcacatcaccgtcaacgaggcccagtcccgcggcggccgtgtaggcngccgctgtgggtacagtggtgggccgtggaagcngcggctaccgcggtggcnggccaccttgttgtgcgcgtcggctacggcagtgggcgtccgcggctaacgtgggcgccggcggcttcgggggttgtgggcggcgggtttccggcggtggcaaaccgtgggggtgggtttcgggaacttcccaaggggaattggaggaaactggaccgggggggcccc

SEQ ID NO: 52294 - protein, 125 aa, Zea mays
  misc_feature: Ceres CLONE 1468829-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (77)..(77): Xaa is any aa, unknown, or other
  misc_feature (93)..(93): Xaa is any aa, unknown, or other
  misc_feature (104)..(104): Xaa is any aa, unknown, or other
  misc_feature (110)..(110): Xaa is any aa, unknown, or other
MAASDVEYRCFVGGLAWATDDHSLHNAFSTYGEVLESKIILDRETQRSRGFGFVTFSTEEAMRNAIEGMNGKELDGXHITVNEAQSRGGRVGXRCGYSGGPWKXRLPRWXATLLCASATAVGVRG

SEQ ID NO: 52295 - DNA, 654 bp, Zea mays
  misc_feature: Ceres CLONE 1468831-F
  misc_feature: Encodes the peptide sequence at SEQ ID NO. 52296
aaactggagctccccgcggtggcggccgctctagaactagtggatcccccgggctgcaggaattcgtctcacccctagaaaaaacccgtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctggtgatggatgcctaaaaaaaaaaaaaaaacgagacgctcgaggtacccaattcgc

SEQ ID NO: 52296 - protein, 62 aa, Zea mays; identical to SEQ ID NO: 5990
  misc_feature: Ceres CLONE 1468831-F
  misc_feature (1)..(62): Pfam Name: TMA7 Pfam Description: Translation machinery associated TMA7

SEQ ID NO: 52297 - DNA, 664 bp, Zea mays
  misc_feature: Ceres CLONE 1468832-F
  misc_feature: Encodes the peptide sequence at SEQ ID NO. 52298
ggagctccccgcggtggcggccgctctagaactagtggatcccccgggctgcaggaattcgtctcacccctagaaaaagctcgctccctccctccctccctccagcgcggatcacagaatggctcagggtcacgggcggactcccaattcgaaacctcgactccgcctctactcctaccccctccgaaaagcaagctccggccgggccgccaccaccaccaccgcgggcgcgtgaactcgctcccacacacagacagacagacatacagacatactgagagacgcacggtggttcggggtctcccttctgccatgcgcacgaggagtcatggtgcaccgcgacaagaacgaggagcccacggagctccgggagccggatatcacgctgtgagccaacgactgcgggctcccgggtaaccacggccacgcataaactgtgacagagctgcttctcggcgtcgaggtctgcggcttccgctacctcctcctcctcttcactggagtacgcggtggcacatgcgaggccagcatcgctcgtacgatacgcagcatcgatggaggcgctggccgctccgggggccgcggtcgcgggccagggccaggctaccgaagccgcggcgagggcgtccgcaagcccgtgctccatctgccggaagcacatgaa

SEQ ID NO: 52298 - protein, 36 aa, Zea mays
  misc_feature: Ceres CLONE 1468832-F
MEALAAPGAAVAGQGQATEAAARASASPCSICRKHM

SEQ ID NO: 52299 - DNA, 668 bp, Zea mays
  misc_feature: Ceres CLONE 1468838-F
  misc_feature: Encodes the peptide sequence at SEQ ID NO. 52300
ctccccgcggtggcggccgctctagaactagtggatcccccgggctgcaggaattcgtctcacccctagaaaaagcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaacaagctcaagctcgagtacaacaaggccatcgctgcctacaacaagggcgagagcactgcagctaagaaggctcctgccaagaaggagcgcagggagaggaggagaacaaaagaaagagaataaaaaaaaaaaaaacgagacgctc

SEQ ID NO: 52300 - protein, 136 aa, Zea mays
  misc_feature: Ceres CLONE 1468838-F
  misc_feature (41)..(110): Pfam Name: HMG_box Pfam Description: HMG (high mobility group) box
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAKKAPAKKERRERRRTKERE

SEQ ID NO: 52301 - DNA, 681 bp, Zea mays
  misc_feature: Ceres CLONE 1468840-F
  misc_feature: Encodes the peptide sequence at SEQ ID NO. 52302
  misc_feature (402)..(402): n is a, c, t, g, unknown, or other
  misc_feature (505)..(505): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (581)..(581): n is a, c, t, g, unknown, or other
  misc_feature (582)..(582): n is a, c, t, g, unknown, or other
  misc_feature (588)..(588): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
tctctggagctccccgcggtggcggccgctctagaactagtggatcccccgggctgcaggaattcgtctcacccctagaaaaaagaaaaagctccagttccaactccaacctacgcagcagaggccagccacctccccgtcgctctcacgctcttcgtgcccgccgcctcccctccgtctctccctctcccctcccgtctgacgcacatggcctccatcgccggatcttccgccctctccttcgccaggcccgtcaaggcaatcaacacaaattctctagctttctcaccgttgaggaagggcaacacattcctccgcctgcaaccaatgcctatgagatctgtttcctgcgctgccaagaaggatacaacacacaaggtttgtgagagtgtgaagaagcancttgctcttcctcaccatactgaagtttgcggtgaatcgaaattctctgaactcggggcaaattccctggacacggttgaaattgtgatgagtctccaggaanacttcaatattagcgttgaggagtccaccccacaaacaatcgcccnnntggagaacgccgctgacctcatcaacannctagtngctgagaaaggagagttctgaccaccccatacgttggcctannnnccgaggcctacccctgaacaaaggtgcgtgggactgaaaattttggat

SEQ ID NO: 52302 - protein, 133 aa, Zea mays
  misc_feature: Ceres CLONE 1468840-F
  misc_feature (56)..(123): Pfam Name: PP-binding Pfam Description: Phosphopantetheine attachment site
  misc_feature (65)..(65): Xaa is any aa, unknown, or other
  misc_feature (100)..(100): Xaa is any aa, unknown, or other
  misc_feature (115)..(115): Xaa is any aa, unknown, or other
  misc_feature (116)..(116): Xaa is any aa, unknown, or other
  misc_feature (125)..(125): Xaa is any aa, unknown, or other
MASIAGSSALSFARPVKAINTNSLAFSPLRKGNTFLRLQPMPMRSVSCAAKKDTTHKVCESVKKXLALPHHTEVCGESKFSELGANSLDTVEIVMSLQEXFNISVEESTPQTIAXXENAADLINXLVAEKGEF

SEQ ID NO: 52303 - DNA, 675 bp, Zea mays
  misc_feature: Ceres CLONE 1468841-F
  misc_feature: Encodes the peptide sequence at SEQ ID NO. 52304
  misc_feature (544)..(544): n is a, c, t, g, unknown, or other
ggagctccccgcggtggcggccgctctagaactagtggatcccccgggctgcaggaattcgtctcacccctagaaaaacccaagtccaagcaccttcccaaaaaaatcccccattttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtatgctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcatgcgccaggggcgatccctctactgcttcggagggctagctggatgcctcttctccttgctgtcgtggatgccctgttgttgttagggttacttcgttaaatacctgnctgggacggggtggaccatggttagtacaatccttgaattggggtttcaatggaacccaattcttatcttccaaaattgaatggattccggggcaactttttgcagggaaaaaaaaaaaaaaaaaaaaaaa

SEQ ID NO: 52304 - protein, 119 aa, Zea mays
  misc_feature: Ceres CLONE 1468841-F
  misc_feature (25)..(94): Pfam Name: Histone Pfam Description: Core histone H2A/H2B/H3/H4
MSGRGKGGKGLGKGGAKRHRKVLRDNIQGITKPAIRMLARRGGVKRISGLIYEETRGVLKIFLENVIRDAVTYTEHARRKTVTAMDVVYALMRQGRSLYCFGGLAGCLFSLLSWMPCCC

SEQ ID NO: 52305 - DNA, 632 bp, Zea mays
  misc_feature: Ceres CLONE 1468843-F
  misc_feature: Encodes the peptide sequence at SEQ ID NO. 52306
  misc_feature (561)..(561): n is a, c, t, g, unknown, or other
aagctggagctccccgcggtggcggccgctctagaactagtggatcccccgggctgcaggaattcgtctcacccctagaaaaaacaagcagcatccgcacactcccaattcccctcgagcgccgcagcgagcccaagaagccgaccgccgagccccctctccagtccagtccgcggtctcggtttcttgcttacccggcgcccaatcttcagggagctccttctcgtcgtctgtctccatggccgcctcgaccaagaccgtcgccgtcctcctcgccgcggtgctcctcgcgctggtcgcgtccgcggcagccagcaggaagctggaggaggaggacgcactcctgggaagcctggccccagcccccgcgccggccgttgggcgttccgcgggggctgcctggcgccaggccggggggcgggggcccgtccccccccccttggtttttcttcggggcccttttccctggagaaaagagggggggggggggggatctttggtggtggcccccccggggggggaagggggggggggggaaaaaaacccccccgcccctcgcgntgttgtcccgctcccaaaaaaaaaaaggggggttttttttttttttccccccctgtggttttttgaggggc

SEQ ID NO: 52306 - protein, 131 aa, Zea mays
  misc_feature: Ceres CLONE 1468843-F
  misc_feature (108)..(108): Xaa is any aa, unknown, or other
MAASTKTVAVLLAAVLLALVASAAASRKLEEEDALLGSLAPAPAPAVGRSAGAAWRQAGGRGPVPPPLVFLRGPFPWRKEGGGGGSLVVAPPGGEGGGGEKNPPAPRXVVPLPKKKRGVFFFFPPLWFFEG

SEQ ID NO: 52307 - DNA, 699 bp, Zea mays
  misc_feature: Ceres CLONE 1468850-F
  misc_feature: Encodes the peptide sequence at SEQ ID NO. 52308
  misc_feature (262)..(262): n is a, c, t, g, unknown, or other
  misc_feature (393)..(393): n is a, c, t, g, unknown, or other
  misc_feature (395)..(395): n is a, c, t, g, unknown, or other
  misc_feature (405)..(405): n is a, c, t, g, unknown, or other
  misc_feature (426)..(426): n is a, c, t, g, unknown, or other
  misc_feature (436)..(436): n is a, c, t, g, unknown, or other
  misc_feature (467)..(467): n is a, c, t, g, unknown, or other
  misc_feature (542)..(542): n is a, c, t, g, unknown, or other
  misc_feature (567)..(567): n is a, c, t, g, unknown, or other
  misc_feature (589)..(589): n is a, c, t, g, unknown, or other
  misc_feature (602)..(602): n is a, c, t, g, unknown, or other
  misc_feature (618)..(618): n is a, c, t, g, unknown, or other
aaactggagctccccgcggtggcggccgctctagaactagtggatcccccgggctgcaggaattcgtctcacccctagaaaaaaaaaccaccgacgcgtacgtagcacagtccattattgccgtctcccttttgcgtgagcaaagaaagagagcgagaagcagtccccatgtctggcatcatccacaagatcgaggagaagctccacatggggggcgaccacaagaataaggaggaggagcaccacaagaaggccgaggcanccccccaagaagggaggaggggggagcaccacaaagagtgacggcgggggagcacaagggaaggcatcgtggaagaagatcaagggactagatcaccgggcgagcacggcggaccagtccgggcgaccacnanggagaagaangggccagaagaagaaggattnagaagaagcnccggcggagggcccacgaccaacgacgggcngcccacagtagcagccagcagccgacagccgactgaaaatcctggtgtcccacaatgtccgatgcctggcttatnatggcagcacaaggtgccaacacanttatgccttgcctggatggaangattccataccanctgatgctgaatgtantgttccacctgttgtcatgcatgcctgtatcgggcctattatacccaaaaaaaaaaaaaaaacgaacccttcaaggtaccc

SEQ ID NO: 52308 - protein, 44 aa, Zea mays
  misc_feature: Ceres CLONE 1468850-F
  misc_feature (32)..(32): Xaa is any aa, unknown, or other
MSGIIHKIEEKLHMGGDHKNKEEEHHKKAEAXPQEGRRGEHHKE

SEQ ID NO: 52309 - DNA, 665 bp, Zea mays
  misc_feature: Ceres CLONE 1468854-F
  misc_feature (602)..(602): n is a, c, t, g, unknown, or other
ggagctccccgcggtggcggccgctctagaactagtggatcccccgggctgcaggaattcgtctcacccctagaaaaaacactctgctattcctatccttgggtaggaagtctgactcctcctctgttcccggcttctcgatcgcaagggtgctactccgtccgctattggtctggtctcctccttcaagaggccgcggagcagcttggagaacataatcccgatcgccttgctcacgattgctaaggtcatcaaggcccccaggcaaattaacgtggtcagcatcgtcacctacgtgatcctcggcgtcgtgctcgagtactccgtttatgatgtcttcgagctctgctggaacggcacgagagacacccagacgacgggcgttgtgcggaactgatctcccgtccgactgcgcggctgatatcgattgagttgtatcatccggtgtgggctacaatctctaggttgatgcgtttttactaaaatgccatccttgtcagctgcacaggatggatgcctcctccgtggccccggtccacaagaaaatacaacttgaaactgcttccctgtttaatagcctctgccgcccgacttgattttgnacgaaaacgcctgaaggttcccctttttccgccgaaagaggaggcgtattacggcccccctca

SEQ ID NO: 52310 - DNA, 657 bp, Zea mays
  misc_feature: Ceres CLONE 1468861-F
  misc_feature: Encodes the peptide sequence at SEQ ID NO. 52311
tccccgcggtggcggccgctctagaactagtggatcccccgggctgcaggaattcgtctcacccctagaaaaaaacccacgcaccaactctcgccattgccagtcaagctcgctataagcagccagatattcaggaccaccgatcacgatcccaaaaacagcggctctgtgtcgcgacgtcgacggcgatggacgctccggccatgttcgcgcgcaagcaagtccccgatgacttcggcctccggaacatcggcgaagctgaggacgaaggagccggggcccaggcccaggcccagctgcaccgcgacgagaagcagcacaagccggccgtgctgaagaaggtgaaggagaaggtgaagaagatcaagaacaccctcgccggccacggccacggccacgacggtgagcacggcggcggcgagcgcatgggagacgcggacgccggcagcgacagcagcgaggaggcggaggaggacgcggcggagagggaggccgcgctggagaagggcggctacatggaagatgtcgaggacaagcccctcgtcatggagccggagcccaaccccgagctgcacggcgcgccgatgtacgagtcggcgagggcacccgccgtgcaggacctcatcggcgagtacgatcagccggcgtggacaccgg

SEQ ID NO: 52311 - protein, 156 aa, Zea mays
  misc_feature: Ceres CLONE 1468861-F
MDAPAMFARKQVPDDFGLRNIGEAEDEGAGAQAQAQLHRDEKQHKPAVLKKVKEKVKKIKNTLAGHGHGHDGEHGGGERMGDADAGSDSSEEAEEDAAEREAALEKGGYMEDVEDKPLVMEPEPNPELHGAPMYESARAPAVQDLIGEYDQPAWTP

SEQ ID NO: 52312 - DNA, 652 bp, Zea mays
  misc_feature: Ceres CLONE 1468863-F
  misc_feature: Encodes the peptide sequence at SEQ ID NO. 52313
  misc_feature (642)..(642): n is a, c, t, g, unknown, or other
tggagctccccgcggtggcggccgctctagaactagtggatcccccgggctgcaggaattcgtctcacccctagaaaaaagtcccagcacgcccaaccccgtcgccgccttctcgaaccttccgaagatgagccccccggccccggccgccgcggcggcggcggcgccgcgaacggtcgcctcggcggtgctccgcgtccagatggcgctcctcgacggcgccgcggtgtccagcgaggccctcatccacgcggccgcctccgcgctcctctcccgcgccgactacgacgacgtcgtcaccgagcgcaccatctcggacgcctgcggcaaccccgcgtgccccaaccctctctcctcctcctccgccgccgccacggggccccgcttccacatcgccctcagcgagcaccgcgtctacgacctcgaggaggcgcgcaagttctgctccgagcgctgcctcgtcgcctccaaggccttggccgcctcgctcccgcacgaccggccctacggggtcccgctcgaccgcctcgccgcggtcgtcgcgctcgttgagggcgccgccgcaggagacgggagcgggttacggttccaggactggatgggaatgggaaggtgggagacgggggaaggaagggtgagatncaggagaaca

SEQ ID NO: 52313 - protein, 175 aa, Zea mays
  misc_feature: Ceres CLONE 1468863-F
  misc_feature (1)..(175): Pfam Name: DUF408 Pfam Description: Domain of Unknown Function (DUF408)
  misc_feature (172)..(172): Xaa is any aa, unknown, or other
MSPPAPAAAAAAAPRTVASAVLRVQMALLDGAAVSSEALIHAAASALLSRADYDDVVTERTISDACGNPACPNPLSSSSAAATGPRFHIALSEHRVYDLEEARKFCSERCLVASKALAASLPHDRPYGVPLDRLAAVVALVEGAAAGDGSGLRFQDWMGMGRWETGEGRVRXRRT

SEQ ID NO: 52314 - DNA, 659 bp, Zea mays
  misc_feature: Ceres CLONE 1468870-F
  misc_feature (548)..(548): n is a, c, t, g, unknown, or other
tccccgcggtggcggccgctctagaactagtggatcccccgggctgcaggaattcgtctcacccctagaaaaagacttgtgggcccagaagccaaagcgcgcactgtccatcaccgtctcctgaatctcagaatcttatcccctcctttgctccatccctctcctctcttcctcggcgacctccacgccggtctagagccggcagcgctgcggcggagcaccaaccgagctccgatcccaccccgctcccaaccgcgcagccctgtccatggcgcgcgcggtgcggcggcgagcccccatgcattcccgccgccggagcgcggcctgctaagcgacgaccattcctctccgcgcgcccacctccctctctccctctcgtaaatccactcccccacgtgtcttcatgggccctccgtcctacaccgcctccccctgcacggggtctgccctcttctccaacacccgagagccgccgccgccaccgcggcttcttatcagatggggcccggggccgccgtcggccgtggagaggcacagaggccgcgtanctacgtcgcaggagatgcgcggccccgccccgtcgcaggagatgcgccgacccagcccgtctcaggagaggcgccgacccgctccgtctcaggagaggccgctgcccctcc

SEQ ID NO: 52315 - DNA, 671 bp, Zea mays
  misc_feature: Ceres CLONE 1468874-F
  misc_feature: Encodes the peptide sequence at SEQ ID NO. 52316
  misc_feature (590)..(590): n is a, c, t, g, unknown, or other
ggagctccccgcggtggcggccgctctagaactagtggatcccccgggctgcaggaattcgtctcacccctagaaaaaacggcatattcccccgaggccccgaaccaaaccaaaccaaaccaaaccaaaccagcccagatcagcgaaacacactccgctctcccgagaccggacacatggcggcggcggcggtgacgtccaacggcggcgcagtggccgcaaatgggccggcgcccggccggctggcctccgtgtacagcgaggtgcagacgaaccggctcctgcacgcccttcccctcccctccgtcctccgctccaacttctcggtcgtcgtcggccccgccagctccgccgcgggcaaccccgatgagatcgccaagctcttccccaacctgttcggccagccctcggcgtcgctggtgccgtcggccgagcccgcggcgaccaggccgctcaagatcggcgttgtgctctccggtggacaggcgccgggcggccacaatgtcatctgcggcatctttgactatctacaggagcgtgcaaaaggcagcaccttgtatggatttaagggaggcccagctgggatcatngaagtgcagtatgtagaactcacttcagactttgtgtatccctacagaaatcaggttgggatttgatatgatctgcagtgg

SEQ ID NO: 52316 - protein, 159 aa, Zea mays
  misc_feature: Ceres CLONE 1468874-F
  misc_feature: SWISSPROT Homolog: EC 2.7.1.90 Diphosphate--fructose-6-phosphate 1-phosphotransferase
  misc_feature (138)..(138): Xaa is any aa, unknown, or other
MAAAAVTSNGGAVAANGPAPGRLASVYSEVQTNRLLHALPLPSVLRSNFSVVVGPASSAAGNPDEIAKLFPNLFGQPSASLVPSAEPAATRPLKIGVVLSGGQAPGGHNVICGIFDYLQERAKGSTLYGFKGGPAGIXEVQYVELTSDFVYPYRNQVGI

SEQ ID NO: 52317 - DNA, 947 bp, Zea mays
  misc_feature: Ceres CLONE 1468878-R
  misc_feature: Encodes the peptide sequence at SEQ ID NO. 52318
  misc_feature (1)..(1): n is a, c, t, g, unknown, or other
nccaattgggtacctcgagcgtctcgtttttttttttttttttcttttttttttttttttttttttttttttttttttttttttttttttttttttttttaaatcaaacaaaaccaagcacgaacttcaacatggtttaggcatttccataaactatcagcactaacatggcttgcaaaataatatatatttcttttaaaaaaaggaaaaagaaaaaccagcgctcctcagccggaaaaaacctactctactgctctcggacctcggttctttcttttggtagctggcaccacacgtgtaacttctccagcacaaacaaatcgtgctgcacaatggccatatgaattccttcatgaccatgggaaacttctcttcctatcctggacttacacacactccagcagctcctaaattctccgtttatgccgcgcgccccctacaaaggccccccaaaaaaccccaatggaaacttttccagccctcaaaaatcctacctttgatgacccaatttgccgggcttatgggaaaaccccctctggaaattttcctttccccccggaaaggggaaataaagggccccccccaacaaaccgtttattccccgggggccccccccccgaaaattcccaaacccaaaaaagaatcccttccaaagaacaaaaacccccctcgaaaccccaaagggggggggttgggaaaccccccccctttctcccccgggaaatttgtggtgaaccacacgggaaatttggggctccccccccaaggttcaaccgggtaagggggaaaaaccttggccccttggctttccacccccccctttattcttggggggcccccacaaaaaaacccaaccccctttttttctccccacaagggtggggccttaacacaacacaaaataaaacaagctcttggggaaaacctggccaaattctcccccacat

SEQ ID NO: 52318 - protein, 32 aa, Zea mays
  misc_feature: Ceres CLONE 1468878-R
NWVPRASRFFFFFSFFFFFFFFFFFFFFFFFF

SEQ ID NO: 52319 - DNA, 725 bp, Zea mays
  misc_feature: Ceres CLONE 1468881-F
  misc_feature: Encodes the peptide sequence at SEQ ID NO. 52320
  misc_feature (374)..(374): n is a, c, t, g, unknown, or other
  misc_feature (378)..(378): n is a, c, t, g, unknown, or other
  misc_feature (385)..(385): n is a, c, t, g, unknown, or other
  misc_feature (399)..(399): n is a, c, t, g, unknown, or other
  misc_feature (725)..(725): n is a, c, t, g, unknown, or other
tccccgcggtggcggccgctctagaactagtggatcccccgggctgcaggaattcgtctcacccctagaaaaagccgtcttctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgttaggatctcggggtctctccacatgaccatccatatttttttcccccctccagagggggancgangggggcnccaacccccccccntttctcctgcaactgttttcttccacgcaggacaacgcccgtccgtgtccatcgcggcgcgaattagcccggtctttataccccctggacgggtgtcgaacctccctaggcagcactgcgtgggcgccaagaagccccttcccccctactggggtcaaagcgcgcgccccccctcttacacctttatcgctcggacgaagggcggtaaaaaatccgccgccgggccatactccaacaggggggtgcccccggcccaattaaccgatttgtcgacgaccaacgcgcgcgccctcgcctcttctacctggaatttattctctgccccn

SEQ ID NO: 52320 - protein, 192 aa, Zea mays
  misc_feature: Ceres CLONE 1468881-F
  misc_feature (12)..(179): Pfam Name: AdoHcyase Pfam Description: S-adenosyl-L-homocysteine hydrolase
  misc_feature: SWISSPROT Homolog: EC 3.3.1.1 Adenosylhomocysteinase
  misc_feature (75)..(75): Xaa is any aa, unknown, or other
  misc_feature (77)..(77): Xaa is any aa, unknown, or other
  misc_feature (79)..(79): Xaa is any aa, unknown, or other
  misc_feature (84)..(84): Xaa is any aa, unknown, or other
MALSVEKTSSGREYKVKDLSQADFGRLEIELAEVEMPGLMACRAEFGPSKPFAGVRISGSLHMTIHIFFPPPEGXRXGXQPPPXSPATVFFHAGQRPSVSIAARISPVFIPPGRVSNLPRQHCVGAKKPLPPYWGQSARPPSYTFIARTKGGKKSAAGPYSNRGVPPAQLTDLSTTNARALASSTWNLFSAP

SEQ ID NO: 52321 - DNA, 630 bp, Zea mays
  misc_feature: Ceres CLONE 1468888-F
  misc_feature: Translation starting site: 321
  misc_feature (471)..(471): n is a, c, t, g, unknown, or other
ggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctgggggcacgcaactttcgggcggtgcacgcggcgcgggacctgcgcacgggccgcagcgtcgcggtcaaaggtgtggcccaangacaagctggagcgcgcgggcatggcggaacaaatccaggcggagatcgccgtcatgaagatggtgccaacccccacatcctggaactgcacgaggtgatgggccacccgctccagatcctacctcgggctcaagctcgtccgcggcgggggaattctt

SEQ ID NO: 52322 - DNA, 673 bp, Zea mays
  misc_feature: Ceres CLONE 1468889-F
acccgcggtggcggccgctctagaactagtggatcccccgggctgcaggaattcgtctcacccctagaaaaaatggagctccattcgcctccaccatggtgccactgcgagcagctccgccccctgcccccccggtcggcggatcccccaccccgccaggtgctctgctaaggcccaccacagtgccagcaactccaccacccccttcctccgctgttggcggttcccccaccccgctaggagcaccgcccaggcggacggcttcaccttcaaagcccatgccacgcagccagcgtcgggatcacccccacctacacccctcgccagaggaccgcccccttgatgccagacagccaacggattcacccccacgccctccacgagcctgataaaggatgctaaaggtcgcggcaagtggctctactgccactccactccgcggcggtgcccagcgtgatgaccacctctcggcctactgctacttcttctccagcatgggcctaatccatgtcgcgataccgggttttggacattttgggctaggttgttcaacattgggtcttggtgaatgaaagcttctactttgaggaagggaaacctaaaagatcgggcaaaccaatttcttttgccgtgacaaaaaccttttttttttattaaacctggggttaaaacc

SEQ ID NO: 52323 - DNA, 684 bp, Zea mays
  misc_feature: Ceres CLONE 1468891-F
  misc_feature: Encodes the peptide sequence at SEQ ID NO. 52324
  misc_feature (417)..(417): n is a, c, t, g, unknown, or other
aagctggagctccccgcggtggcggccgctctagaactagtggatcccccgggctgcaggaattcgtctcacccctagaaaaaaccatcacagtacgcacgcacgcaccagcccagcagcagaagcgcccctcggccctcgctcccacaacaagctcaagccagccttctctctctctctgctccaatggcgcgcttccagctcgcagccgtggccatggccatgctcttcgccgcggcggcggcgcaggccccgaccgccacccagacgccggctcacaaggcatcccccccgccggagactccaccacgaaccccgacgcggcagtcgcaacccgtgcaacctccgacgtggtgactccaagacgccttcacttgtggggaagaggctggcatctgtcgttaagaaacaaggaanataccccatgttgtttatgggagaggctcagccaaacagtatccacgaggaaaacaatcgacggtgtcccatgaaatagaaaagggatgctgcatcatctgagagggagggcgccaagagacgggcgttttcgcctgttgcacggaaaagaggtttgcacagttgtgcagcatcatgttagtgccggacaaggactcctccacaagaagaaaaattgtttcaacatgccagatcccccaacgccctgccggacctccccttgataaa

SEQ ID NO: 52324 - protein, 56 aa, Zea mays
  misc_feature: Ceres CLONE 1468891-F
MARFQLAAVAMAMLFAAAAAQAPTATQTPAHKASPPPETPPRTPTRQSQPVQPPTW

SEQ ID NO: 52325 - DNA, 697 bp, Zea mays
  misc_feature: Ceres CLONE 1468892-F
  misc_feature: Translation starting site: 311
  misc_feature (1)..(1): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (412)..(412): n is a, c, t, g, unknown, or other
  misc_feature (413)..(413): n is a, c, t, g, unknown, or other
  misc_feature (415)..(415): n is a, c, t, g, unknown, or other
  misc_feature (473)..(473): n is a, c, t, g, unknown, or other
natattgtggagctccccgcggtggcggccgctctagaactagtggatcccccgggctgcaggaattcgtctcacccctagaaaaactcttccgcggttccgccatcgcgtcgcgaacggcggccagaaaaaagaaaaagaaaaaaaaaaaacagctcgccgcaccaatctccgctaccatatcgatcgaccctgcaaggtttaatccaacagaattccaccggaaatttggtgaagtgctaatcgcttgcggcttgcctgcccggtctcgtggctttgtgctgctcccgctgtggtgaggaaccctaggatggcgggggtttctatggcggcggcgcctgagggggtgctgcaccgcctttatgacccccccctgggggggaaagcaaagggggtctnnnncnnnnnnncnncnccccccccccgatgaagacactgaaacccggcgccccctgggagggggggccccccgnaaagcagtccgaaaccacctagcggaatgccaggaacccccaaaaagggaacaagtgggccgggatctatccggaccttcgcgtccccaaggatctaccccggcgaaaaattggggctgggtttggaaaactcttgggaaaaaccgtggttatcgcaaaaccatattccaacgaaagttggaacagcacccagcgccccttacttcgcccttatcttcgccaag

SEQ ID NO: 52326 - DNA, 667 bp, Zea mays
  misc_feature: Ceres CLONE 1468898-F
  misc_feature (464)..(464): n is a, c, t, g, unknown, or other
ggctccccgcggtggcggccgctctagaactagtggatcccccgggctgcaggaattcgtctcacccctagaaaaagtgcgcatgctttggcttggcaaacccgattggatcttcagaaaaatcgccatcccctctccctcttctcgtgtccatcgctcctctacccattcttacttgaatcttttctgaagaggaaatctgacttcgggagcggctcctccgcgttgcctggatcgcccgggatcagtattttgcttccagtcagaggtccaaaatatcaaagggatgcagaaagatgtggttgcatgatggagtaccttgcctggaaattggcaggatacacaaacataattgtactttacttgatctcgatgacattggagtgcaaatatatgcacaacgattgcctcatgcacacacacataatggggccgcgagttgtagctcaaccatcatctctggnttctttctaggtggagatggttaaaattgctggtcacttataattaccagcatcttatacggtcattgctggttcctccgccacttattccaagtttgaaagtagaaccctgagaagatggctgagaaaagaaaatattcctatgcagagaatatgaaatggggaatttacttggaaaaagggagtttttgccaaaatttacc

SEQ ID NO: 52327 - DNA, 657 bp, Zea mays
  misc_feature: Ceres CLONE 1468900-F
  misc_feature: Encodes the peptide sequence at SEQ ID NO. 52328
aagctggagctccccgcggtggcggccgctctagaactagtggatcccccgggctgcaggaattcgtctcacccctagaaaaacccaccatttctcctcctctttccgtcgggtctactgcaccttgccctcccccatgaacctgtggacggacgacaacgcctccatgatggaggccttcatggcttctgccgacctccccaccttcccctggggagcgccggccgggggcggctcccgacgaggccgtcaaggaggaggtcaccgataccgagtggttcttcctcgtctccatgacgcactcgtttctcaacggttcgggcctccccgggcaggcgctcttcgccgggcagcccacatggatcgcctctggcctctcctccgcgccgtgcgagcgcgcgcgtcaggcctacaacttcggcctccgcaccatggtctgcttccccgtcggcaccggggtgctcgagctcggctccaccgacgtcgtgttcaagaccgccgagagcatggctaagatccgctcgctctttgggggcggagcaagttgtggctcgtggctgcccgtgcagtctcaggcgccgtcgtcacatcagcccgcccgcaggagccaacacgcggagacggacccgtccatgctatggctcgccgacgcgtcgg

SEQ ID NO: 52328 - protein, 121 aa, Zea mays
  misc_feature: Ceres CLONE 1468900-F
  misc_feature: The sequence is a functional homolog of SEQ ID NO 1238 in the 10/412,699 US patent application
  misc_feature: The sequence is a functional homolog of SEQ ID NO 943 in the 10/374,780 US patent application
MTHSFLNGSGLPGQALFAGQPTWIASGLSSAPCERARQAYNFGLRTMVCFPVGTGVLELGSTDVVFKTAESMAKIRSLFGGGASCGSWLPVQSQAPSSHQPARRSQHAETDPSMLWLADAS

SEQ ID NO: 52329 - DNA, 668 bp, Zea mays
  misc_feature: Ceres CLONE 1468901-F
  misc_feature: Encodes the peptide sequence at SEQ ID NO. 52330
ggagctccccgcggtggcggccgctctagaactagtggatcccccgggctgcaggaattcgtctcacccctagaaaagtcactgtaccatgccactccaccgttccgacatccaaggctccaagtataaaccccgcggctgcaaaccctagccgcccgatgctcttcgtcccgcgccaagtcgtactcgccgcctcatcacagccccgcgccgccgcctcttccgccatggccaaggaggaatccaagaaggagaagaagaaggccaaggccaaggtggccaatggagccgccgccgccgccgccgccccggtccctggcgcgagggccgcggtggtcgcctccgtcgccgccttcctcgagtccgctgggctctcgcgcacgctcgtcgccctccaatccgaggccggcctcgaggccggtgcgtgggggtcgtcacaggtgaacttggaggagctggttgccagattcttagagtcgagcaattcaactcgggcggctgccattctgggaagcgatgagcaagacaaggaaaatgatgatatagcaggagaagttggcaaggaaaaaaagaggagcggcacagaagccggtgagcctgagagcaaggcgatcgagcctttagctgaggaaaagccgactgacaatatggacggtgaggctaaagag

SEQ ID NO: 52330 - protein, 147 aa, Zea mays
  misc_feature: Ceres CLONE 1468901-F
MAKEESKKEKKKAKAKVANGAAAAAAAPVPGARAAVVASVAAFLESAGLSRTLVALQSEAGLEAGAWGSSQVNLEELVARFLESSNSTRAAAILGSDEQDKENDDIAGEVGKEKKRSGTEAGEPESKAIEPLAEEKPTDNMDGEAKE

SEQ ID NO: 52331 - DNA, 701 bp, Zea mays
  misc_feature: Ceres CLONE 1468903-F
  misc_feature (201)..(201): n is a, c, t, g, unknown, or other
  misc_feature (202)..(202): n is a, c, t, g, unknown, or other
  misc_feature (233)..(233): n is a, c, t, g, unknown, or other
  misc_feature (422)..(422): n is a, c, t, g, unknown, or other
  misc_feature (423)..(423): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (537)..(537): n is a, c, t, g, unknown, or other
  misc_feature (545)..(545): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (580)..(580): n is a, c, t, g, unknown, or other
  misc_feature (593)..(593): n is a, c, t, g, unknown, or other
  misc_feature (596)..(596): n is a, c, t, g, unknown, or other
ccccgcggtggcggccgctctagaactagtggatcccccgggctgcaggaattcgtctcacccctcttaatgcgcccgctacctggcgcgtcacgtgtgctctttctcggaaatgctcccgtaacccctatctgtttatttttctacatacattcaaaaatgtttcccctcatgacacaatagccctgataaatgcttcanntaaatatcttgtaaaaaaaggccccaagtantcgatgtattaaacctttttccagtgtccccccttataccttttttgccggaatttacctccccggttttttcccccccccccccataccccggtgttaaaccaaaaaaatcccccttaaacaatctctccggggggatcccccccaaaaaagcgcatctttaatcaccaccctccaataattattttnnctagtggggggagaaccctttccacatttttacccaacaaaaaaaaaaactcttctcccccatataaaaaaaaccccccttcnnnccccccnnnnnnnnnnnnnnnnnattttnccctgccncctagnnnnnnnnntaatgtcccggcatgcccaancctccgtgtcccnttnccgcccctttaacattttttcccccctaaggcccctattcccttaataaatacctccccctaattattccccctttttcccccgtcccaccgcgattctccccca

SEQ ID NO: 52332 - DNA, 734 bp, Zea mays
  misc_feature: Ceres CLONE 1468964-F
  misc_feature: Encodes the peptide sequence at SEQ ID NO. 52333
  misc_feature (13)..(13): n is a, c, t, g, unknown, or other
  misc_feature (39)..(39): n is a, c, t, g, unknown, or other
  misc_feature (40)..(40): n is a, c, t, g, unknown, or other
atgggggatgggnttcttcccctctctcccgaggccaanntttggtaagttggagcgggatcgagctccacgcggtggcgggggctctaagactagtggatcccccgggctgcaggaatgcgtctcacccctagaaaaaatggcgcccacgggaaactgacaagccgtcgatctcctcctcgtcgtacggctcccgccgtctctctggcggagagctgagccgatctacctcgggagggaggtggaagacctggatggcttcccgaaaatgaacgaggagttctacagccgcaccctctggggcgggtgggatcgcaatcctctgctacctcgccgtcggactcctcttcttctccgagatccaactttatctatatcctgcccgggaaagtaagctcactgttgagagatcgagagtgaaaagactacgtgggggaaaacgaaaacacattccctgcccttccttgatggctacaaccccccccaacaataaacctcgagctgaaagcaaagttatgatataacgcatgacttaataaacataacaattgataagcttgggcaagtagaaattgtctcaggaaaaaaagggaatatggaggggcctaaaattgacaagaccggtatcagaaccatgggtcggaggctttgaggataaagaggcgatactgcgcgaataatgaaaaggggggctgaaaaatgcggatagaaccaagggagaggcaactgcctgg

SEQ ID NO: 52333 - protein, 41 aa, Zea mays
  misc_feature: Ceres CLONE 1468964-F
MNEEFYSRTLWGGWDRNPLLPRRRTPLLLRDPTLSISCPGK

SEQ ID NO: 52334 - DNA, 662 bp, Zea mays
  misc_feature: Ceres CLONE 1468966-F
  misc_feature: Encodes the peptide sequence at SEQ ID NO. 52335
  misc_feature (397)..(397): n is a, c, t, g, unknown, or other
aaagctggagctccccgcggtggcggccgctctagaactagtggatcccccgggctgcaggaattcgtctcacccctagaaaacttcgtttgcccatcctcgtgacggctcctcgccagtcgcctcgtctctccctgccgcgtcgcctccagttccgcctccgccgcgcctcccgcctccgccgcgcctgacgaacgcagtataggactgtgcaggtagagaggaggagggtccggcgagatggggatgcgagataagaagcggaaccagaagcgagtgctcgcgcgccgtaccgcggcaccgcgcccaggcgagggcaaggatttcctgccgctggaaggaggccccggtaagaagcatctgaaggtgcagcagcctggagagcccgaaaacacanccacaatcgtctacattgggcatatcccccatggtttctacgaggacgagatgaaagggttctttaagcagtttggggatattaagaggcttaggatcgctcgtacccgcaagacaggaaaatcaagcactatgggattcttggagttgagaaccctgctggggcaaaggtcctaacaaaatgaatgataactatctcctgttggagcgccccttgaagttgcctttgttaaccccaaaaaattcatcctaattatgggaagggg

SEQ ID NO: 52335 - protein, 110 aa, Zea mays
  misc_feature: Ceres CLONE 1468966-F
  misc_feature (53)..(53): Xaa is any aa, unknown, or other
MGMRDKKRNQKRVLARRTAAPRPGEGKDFLPLEGGPGKKHLKVQQPGEPENTXTIVYIGHIPHGFYEDEMKGFFKQFGDIKRLRIARTRKTGKSSTMGFLELRTLLGQRS

SEQ ID NO: 52336 - DNA, 655 bp, Zea mays
  misc_feature: Ceres CLONE 1468975-F
  misc_feature: Encodes the peptide sequence at SEQ ID NO. 52337
aaaactggagctcaccgcggtggcggccgctctagaactagtggatcccccgggctgcaggaattcgtctcacccctagaaaaaatccatcaaacacataccgctcagtttggatagataactggaagcagctgccatctcgattcattgactgcatctacaatggttatcagatcaggcgcgctcgttcttcaaccggcagcatggaaccaagtacttcttccgtcagagccatatcaccaagcttaaaagcgtcgccaaaccaaatcctgctccctcgggcacgccatggcacggcggagaccgcggcctgcacctgcgtccactatcaggatcaccacctagctacgtgaccggcgagttcctgcggcaactactgctgggacatgctgggactgtcgccggacccggagaccttcgccaagaacctccagctggaggtgatccacagccactgggccatgttcggcacgctcgggtgagtgttcccggaactgctcgccagcaactgcttcaagttcggccaggcgatgaggttcaaggcgggctcccagatcttcaccgagagcagcctgaactacctatgcaacccgagcctggtcatgtcgcagagcattctgaccatctgagcgtgccagatgatgctcatgcgccc

SEQ ID NO: 52337 - protein, 31 aa, Zea mays
  misc_feature: Ceres CLONE 1468975-F
MLGLSPDPETFAKNLQLEVIHSHWAMFGTLG

SEQ ID NO: 52338 - DNA, 669 bp, Zea mays
  misc_feature: Ceres CLONE 1468992-F
  misc_feature: Encodes the peptide sequence at SEQ ID NO. 52339
aaagctggagctccccgcggtggcggccgctctagaactagtggatcccccgggctgcaggaattcgtctcacccctagaaaaattccattccattccattccagtactcgctcatcttgctccgccttctgcttctgcgcatcctccaaggatcgtgatggccatggccacgcaagactccgcggccacgcgccacctggtggccgccgccgcttcagcctgagcgccgtcagcgaatccgcggcagctaagatcacagctcgcgctgccgccgtcatcctccctcgtgccggacccactccgcgcgaccgccggggaggcggatgaccgaggatgcgcccaatgggtatcgtggccccgcagctggaccccagcacgccgtccccgatcttcggtcgcaccacggacgggctgctccgcaaggcgcatgtggaggagttctacctcatcacgcgggtgtcccccaaagagcaggtgttctagatgcccacaggcggcgccgccatcgtgcgagaggggcccaacctcctgaagctggcgcacaatgaacaatgcctctcgctcggcaccatgctgcgctccaagtacatgatcacctaccagttctaccgcgtcttccccaaatgctaggtgcagtacctccacaccatggactgcgtctacccaga

SEQ ID NO: 52339 - protein, 48 aa, Zea mays
  misc_feature: Ceres CLONE 1468992-F
MPTGGAAIVREGPNLLKLAHNEQCLSLGTMLRSKYMITYQFYRVFPKC

SEQ ID NO: 52340 - DNA, 689 bp, Zea mays
  misc_feature: Ceres CLONE 1468995-F
  misc_feature: Encodes the peptide sequence at SEQ ID NO. 52341
  misc_feature (435)..(435): n is a, c, t, g, unknown, or other
  misc_feature (445)..(445): n is a, c, t, g, unknown, or other
ctggagctccccgcggtggcggccgctctagaactagtggatcccccgggctgcaggaattcgtctcacccctagaaaaaaagacaaacttgaagctctgcaaaatttggtttgatatgggcgaatatggtcgcatgagcaagatattgaaggagctgcataaatcttgccaaagggaagatggttctgatgatcaaaagaaaggcacacagctctttggaagtctatgctattgaaatccaaatgtacactgaaacaaagaataataaaaagcttaaggaattgtatcagagggctctttccatcaaatcggcgataccacatccaagaatcatgcgtataattcgtgagtgtggtgcgcagatgcatatggctgagaagcagtgggatgaagctgccactgatttctttgaagctttcagaactatgatgaancatgcatccngcgagaatcaatggctaaataatctgtccttgcaatatgtgatggatcttgaaaatgatcctttgaaggacaaaagggcaaacccgtaaaaaacaaaaggggaatctctggcggggacaaacctgatttggcgggacccaaaaaaaggaccccgggattttaaaaaacccccaagaaaataaaaaaaaacaagggggggagccctttttctcccacattttttgggggtgtttggaaaaaaaaa

SEQ ID NO: 52341 - protein, 117 aa, Zea mays
  misc_feature: Ceres CLONE 1468995-F
  misc_feature (85)..(85): Xaa is any aa, unknown, or other
  misc_feature (89)..(89): Xaa is any aa, unknown, or other
MVLMIKRKAHSSLEVYAIEIQMYTETKNNKKLKELYQRALSIKSAIPHPRIMRIIRECGAQMHMAEKQWDEAATDFFEAFRTMMXHASXENQWLNNLSLQYVMDLENDPLKDKRANP

SEQ ID NO: 52342 - DNA, 579 bp, Zea mays
  misc_feature: Ceres CLONE 1469001-F
  misc_feature: Translation starting site: 150
  misc_feature (46)..(46): n is a, c, t, g, unknown, or other
ggagctccccgcggtggcggccgctctagaactagtggatcccccngggctgcaggaattcgtctcacccctagaaaaagcatgtaacgtaccgcgcgcagctgaactcggccgagcaatttctgctctgagtttgtcaggtccgtgagatgggatcactcagtagtatggctgaaaaagctcccggtgctgcgctgccagagtcttcatgtgcatacttgcttcaagaactcaagatgatatgggatgaagttgggcaagagcagagcgaaagggagagaatactcgaagagctcgagcaggagtgccaggaagtttaccgaagaaaagtaaacagtgccaacatgtccaggatccagctgcaccaagccttagctgaatccgacgctgaatttaccacctgctgctatccctcagagaagatcgttcccggcacgacccgagaaaatggcaggcaccctgcaggagcagctgaattccatcacgcccgcccctacagaaatgcacatgaagaaggacgccagagctaagcaggtcgtggtagttcagactgaaacacacaggatcgcttctgaaatc

SEQ ID NO: 52343 - DNA, 615 bp, Zea mays
  misc_feature: Ceres CLONE 1469011-F
  misc_feature: Encodes the peptide sequence at SEQ ID NO. 52344
  misc_feature (386)..(386): n is a, c, t, g, unknown, or other
  misc_feature (392)..(392): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (406)..(406): n is a, c, t, g, unknown, or other
  misc_feature (407)..(407): n is a, c, t, g, unknown, or other
ggagctccccgcggtggcggccgctctagaactagtggatcccccgggctgcaggaattcgtctcacccctagaaaaatcagaaacatagaaaaccaacctaaatatccacttccgtcgtcctggactcgtagttcatccacgacgcaccgaaccgcaatggccacgttcctgggaagctcaccggcgctcctcgcccgtcccatcgccaagccccacatctcctgcgcgcagacaccgcgcccgccaagcgcccagaaccagccgccgtccagcgagcaaccgcaagcacaaacacagcagcagtccgtgcaagcgcagccacagcaggcgacggcgaagccgaaacgcgcatgcggcgccgcactcacggagtgggggggctcntccctnaacacgnnnttccnnatcagcccgaggctggccatggccccgctttctgggcggcggggtcgtgtcccaccaactcaaaaccgcttcaaggccgcgcaccaccggccacccccagggacgggaacaggaaccgggaggtctcctggcccaacgggttccggaatattaaatgtgccctccccccggagaaacccccggggggggggaaacggcgggggaaacg

SEQ ID NO: 52344 - protein, 87 aa, Zea mays
  misc_feature: Ceres CLONE 1469011-F
  misc_feature (12)..(12): Xaa is any aa, unknown, or other
  misc_feature (14)..(14): Xaa is any aa, unknown, or other
  misc_feature (16)..(16): Xaa is any aa, unknown, or other
  misc_feature (17)..(17): Xaa is any aa, unknown, or other
  misc_feature (19)..(19): Xaa is any aa, unknown, or other
MRRRTHGVGGLXPXHXXPXQPEAGHGPAFWAAGSCPTNSKPLQGRAPPATPRDGNRNREVSWPNGFRNIKCALPPEKPPGGGKRRGK

SEQ ID NO: 52345 - DNA, 649 bp, Zea mays
  misc_feature: Ceres CLONE 1469012-F
  misc_feature: Encodes the peptide sequence at SEQ ID NO. 52346
  misc_feature (212)..(212): n is a, c, t, g, unknown, or other
  misc_feature (214)..(214): n is a, c, t, g, unknown, or other
  misc_feature (217)..(217): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (224)..(224): n is a, c, t, g, unknown, or other
  misc_feature (227)..(227): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
tggagctccccgcggtggcggccgctctagaactagtggatcccccgggctgcaggaattcgtctcacccctagaaaaaactttagcccaaggaggccggcctcgcctcgcttcatacgcccgcccctgccgatccatccacccaataaagcgcctgtacagatccaacccttaggatccggatcgccttaccccgccccccccccccaaangnttngnnnngngangatttgcgcgattccattcgattatcctcccattttccccggtttttgtaggtttcctctctttttcgatccgtgtgctagggtttgggcgcccggaggcgtcgcattccagggtaatcattggttcgacgggctagggtgctttctcacccggggaacggaatcgaatcccgacgatggatagaacaacaaagacaagggcgccaaggagaagacgaccgatcccgtgaagctcaaagcagagctggataaggtggacaccaagctgcaagacctacatgccaagagagaacataccctgaggcagctgaaaaagctggaactggaagatggcggcagggaaaaggccaacgaaggagagcctgcacatggaccgatccctgccccacccaacctcggnnnnnnnaagaaaaaagtcatgt

SEQ ID NO: 52346 - protein, 31 aa, Zea mays
  misc_feature: Ceres CLONE 1469012-F
  misc_feature (24)..(24): Xaa is any aa, unknown, or other
  misc_feature (25)..(25): Xaa is any aa, unknown, or other
  misc_feature (26)..(26): Xaa is any aa, unknown, or other
MAAGKRPTKESLHMDRSLPHPTSXXXRKKSC

SEQ ID NO: 52347 - DNA, 652 bp, Zea mays
  misc_feature: Ceres CLONE 1469019-F
  misc_feature: Translation starting site: 436
ggagctccccgcggtggcggccgctctagaactagtggatcccccgggctgcaggaattcgtctcacccctagaaaaaatcccatctctcactcgctagcactagcatagtcgtctctttcttttctgcttccagacattgtccacacgagctagtgcactggtgtcgctcgcaaccaaattaaggacgtactgagccatggcatccaagggcgtcctcttcttggctctcaacctcctgttcttcacagtggccaacgcctgcggcagctgcccgaaccccacgccgccggtcgtgccaccgccgcccgctccttctgctaccccaccccttcatcctccagtgggaagtgcccgctgaacgcctcaagttcggcgtgggcgtcaatgtgctcggcctccctcaaagccaagctgggaaggtaactgccaagccatgctggacctcatcaaaagccttggagaaatccagggccgcctctggctctggacgggcataaaagggaagtcctcggggtcctccttcaagtccccataaaagtcaaggccccccgcaactaacgtggggcagggcctggccaagggctacactggtggcgtaaactccccgcgggttaactccccctataccgttccccgtggtaaattaacag

SEQ ID NO: 52348 - DNA, 657 bp, Zea mays
  misc_feature: Ceres CLONE 1469021-F
  misc_feature (197)..(197): n is a, c, t, g, unknown, or other
  misc_feature (198)..(198): n is a, c, t, g, unknown, or other
  misc_feature (206)..(206): n is a, c, t, g, unknown, or other
  misc_feature (207)..(207): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (328)..(328): n is a, c, t, g, unknown, or other
  misc_feature (332)..(332): n is a, c, t, g, unknown, or other
  misc_feature (333)..(333): n is a, c, t, g, unknown, or other
  misc_feature (336)..(336): n is a, c, t, g, unknown, or other
  misc_feature (338)..(338): n is a, c, t, g, unknown, or other
  misc_feature (340)..(340): n is a, c, t, g, unknown, or other
  misc_feature (352)..(352): n is a, c, t, g, unknown, or other
  misc_feature (368)..(368): n is a, c, t, g, unknown, or other
  misc_feature (386)..(386): n is a, c, t, g, unknown, or other
  misc_feature (400)..(400): n is a, c, t, g, unknown, or other
  misc_feature (401)..(401): n is a, c, t, g, unknown, or other
  misc_feature (419)..(419): n is a, c, t, g, unknown, or other
  misc_feature (420)..(420): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (428)..(428): n is a, c, t, g, unknown, or other
  misc_feature (432)..(432): n is a, c, t, g, unknown, or other
  misc_feature (433)..(433): n is a, c, t, g, unknown, or other
  misc_feature (441)..(441): n is a, c, t, g, unknown, or other
  misc_feature (446)..(446): n is a, c, t, g, unknown, or other
  misc_feature (462)..(462): n is a, c, t, g, unknown, or other
  misc_feature (464)..(464): n is a, c, t, g, unknown, or other
  misc_feature (467)..(467): n is a, c, t, g, unknown, or other
  misc_feature (468)..(468): n is a, c, t, g, unknown, or other
  misc_feature (484)..(484): n is a, c, t, g, unknown, or other
  misc_feature (488)..(488): n is a, c, t, g, unknown, or other
  misc_feature (522)..(522): n is a, c, t, g, unknown, or other
  misc_feature (524)..(524): n is a, c, t, g, unknown, or other
  misc_feature (651)..(651): n is a, c, t, g, unknown, or other
acccgcggtggcggccgctctagaactagtggatcccccgggctgcaggaattcgtctcacccctagaaaaagcgagggacccggggcggaagaagagagagaagacgtctctctcctctcggcgtccccgttccccaacctctcgtctgctgcctgcctgcctgcctgcctgcaaaaaggagtttgtcatgggcgnntctaagcnncgcatcccctccaaggggaaaacctggaaagaaaccttgccaaaaaaggaacccccccccccaaatccatggcaaagtggcaagggtcccccgggcgtggggnnnnnnnnnnnnnnnnnanaaannaanananaaaaaaaaaaanaaaaaaaaaaaaaaanaataaaataaaaaaaaanaaaaaaaaaaaaannaaaaaaaaacgggaaaannannnnaanaaannataaaaanaaaanatattattggggtttntntannaaaatctatatttaanaaanattaattaatcttcttttaaaaaaaaaaaataananaaaaaaaaaatatatattttttatattaatatataacatccaaaataattatcaaaaattattaaaattatctatacacacacacaaaacacaaacatttaaaactacataattaatatcatttatntttaat

SEQ ID NO: 52349 - DNA, 656 bp, Zea mays
  misc_feature: Ceres CLONE 1469023-F
  misc_feature: Encodes the peptide sequence at SEQ ID NO. 52350
aagctggagctccccgcggtggcggccgctctagaactagtggatcccccgggctgcaggaattcgtctcacccctagaaaaagcatcgcattgcccggacgcctaaacctagctcctgaattctcctcggctcctcgcccacctctcgctagccgttcccgctctgcagtctccgtggccggacgccgcggcgacatggcctcgacctgtttccgcgccgccgcacgcgtggcctccgccgccggccgctcggcggcggccacccgatcggctccctccgcggcccgtgctgccgccgccgccgcccaccgcgcctcgtccttctccagaatgccggtggagctcgggtgctgcgcgggattgtcgctgctgccgctgcacagagcggtggctgctgccaagctaacgtcgcggctgagcacggcatctagctgccgtgctctctctcaggagatgggtctatccgttcgaacgtgataaatcagctggaagacttgctcatgtcatgctgtgggactgaaatcatttctatagattagttatctgaatgaacatctggagcactacacttcatcaccccttcgacaatcttgactatcttacatctgtaccccaacgttgtgagtgcatgccttgtgatatcatctgatgaaaa

SEQ ID NO: 52350 - protein, 48 aa, Zea mays
  misc_feature: Ceres CLONE 1469023-F
MPVELGCCAGLSLLPLHRAVAAAKLTSRLSTASSCRALSQEMGLSVRT

SEQ ID NO: 52351 - DNA, 668 bp, Zea mays
  misc_feature: Ceres CLONE 1469028-F
  misc_feature: Encodes the peptide sequence at SEQ ID NO. 52352
ggagctccccgcggtggcggccgctctagaactagtggatcccccgggctgcaggaattcgtctcacccctagaaaaactagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaacaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaatactcttggcgagtgggctgggctttgcaagattgactccgagggcaaggcaaggaaggttgtatgctgctcctgtgtcgttgtcaaggactacggcgaagaatctgagggccttaacatagtgcaggagtatgtcaagtcgcactatatgtaacacgtttcagtaatactctacatttggatctgggcttaatattatgcttgcgtcttgggcttgctaggagattaggacaatttact

SEQ ID NO: 52352 - protein, 142 aa, Zea mays
  misc_feature: Ceres CLONE 1469028-F
  misc_feature (25)..(120): Pfam Name: Ribosomal_L7Ae Pfam Description: Ribosomal protein L7Ae/L30e/S12e/Gadd45 family
MADQEAPVAVEAPTPVLGEPMDLMTALQLVMNKSSAHDGLVKGLREAAKAIEKHAAQLCVLAEDCDQPDYVKLVKALCAEHNVHLVTVPAANTLGEWAGLCKIDSEGKARKVVCCSCVVVKDYGEESEGLNIVQEYVKSHYM

SEQ ID NO: 52353 - DNA, 729 bp, Zea mays
  misc_feature: Ceres CLONE 1469035-F
  misc_feature: Encodes the peptide sequence at SEQ ID NO. 52354
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (560)..(560): n is a, c, t, g, unknown, or other
aaagctggagctccccgcggtggcggccgctcctagaactagtggatcccccgggctgcaggaattcctctcacccctagaaaaacagccaagcagaagcgaggacactacacagcgcgcgactgacatgtcgatgctcaccagcatactgggccgcaagcatcagccgccgccgccgcagcagcagcagaagggcggcggcgcgcgcactggcaccggcgccggcacggaggcggcggcagtggagcccggtgagcatccgacctcgcggagcaggggccgctagtggacggcgccctcacgcctggcggcgttcgcggcgcccgcactaggcctgccgccgttccccgaccggccagcatggacctggaaggagacccccaacggcgcacgtgttccatggccgaacctcccccggctgccccccacaggaannnnggggggagaaggtggaaaaaaaaaaagcctgcctccggatccaccgggcagcggcagccccgcgccgaaggagaaggggcgacggcttggcaccgcgtcgaagcgcagctccgaaccgcttncgtgcgcaccggtgccccctcccgcccaaccccaacacgaaagggccgcaagccccccctccaagacaggcttgctccaccgtcccccgtccccaaggacaacaaccccaaagccctacgggggggctcctcccctcccccaattattttatttttaaccccatatttt

SEQ ID NO: 52354 - protein, 110 aa, Zea mays
  misc_feature: Ceres CLONE 1469035-F
  misc_feature (12)..(12): Xaa is any aa, unknown, or other
  misc_feature (13)..(13): Xaa is any aa, unknown, or other
  misc_feature (54)..(54): Xaa is any aa, unknown, or other
MAEPPPAAPHRXXGGRRWKKKKPASGSTGQRQPRAEGEGATAWHRVEAQLRTAXVRTGAPSRPTPTRKGRKPPLQDRLAPPSPVPKDNNPKALRGGSSPPPIILFLTPYF

SEQ ID NO: 52355 - DNA, 664 bp, Zea mays
  misc_feature: Ceres CLONE 1469036-F
  misc_feature: Encodes the peptide sequence at SEQ ID NO. 52356
ctccccgcggtggcggccgctctagaactagtggatcccccgggctgcaggaattcgtctcacccctagaaaaactgtgacctgtccaccactctcatagcaaagaccatatccttccacttgctatggcggcggcggcgacggcgaccacgacctctccggcgagggcttcgtggcggcctacggttcccgcgacctcggcatcggcagcaggagtctgcttccgtgttggagcgaagcgctttccagggctccgaacggcaagcacctgtcggcaccgacaccgaggcaccacaaggctcacaaccggtcacgtgaagagcggggaagccgaggggcgtccaagcacggaggagagcgcaaccggcagcggcggcccggacgaggactccctgcggcgcgagctcgaaaccgcgatcgaggaggaggactacgcgcgcgccgcggcgctccgggacgagctccgcgtgctccaggaggacggccgggccgcggtgctggcggcgaacgcgcggttctacgccgcgttcaaggacggtgacctcgcggcgatgcgccgggcctgggccaggggcgaccacgtctacgtggtgcacccgtcggcggggaggatctccgggtacgagatggtgatgcagagctgggagatggtgtgcgacgccgg

SEQ ID NO: 52356 - protein, 179 aa, Zea mays
  misc_feature: Ceres CLONE 1469036-F
MAAAATATTTSPARASWRPTVPATSASAAGVCFRVGAKRFPGLRTASTCRHRHRGTTRLTTGHVKSGEAEGRPSTEESATGSGGPDEDSLRRELETAIEEEDYARAAALRDELRVLQEDGRAAVLAANARFYAAFKDGDLAAMRRAWARGDHVYVVHPSAGRISGYEMVMQSWEMVCDA

SEQ ID NO: 52357 - DNA, 656 bp, Zea mays
  misc_feature: Ceres CLONE 1469042-F
  misc_feature: Encodes the peptide sequence at SEQ ID NO. 52358
ggagctccccgcggtggcggccgctctagaactagtggatcccccgggctgcaggaattcgtctcacccctagaaaaaatcgagcccccgccaccaccagtccagcagctccaggccagacaggcacacctccaagaacaagagctggtcctcctggtaataaccgagagacagagagaggccaatggcacccaagtggtggctcggcgcctccctgctgctctgcctctgcgtcacatcagcggaggacaagacaataatgccccgctactgcgacactgctgccgccttccccatcggcgacggcagtgccggcgccgtggactacgacgactcacgtcgccatcacccccgacatgttcagggcgccgacccgtctgagcgacccctcccccagaggccactgacctccttgaccaggacgtacttgagttacgcccgctcgcgggattcgtctacccgtgcgttgccgcctccgaggactcagacgtctatgagctctcctacttcgacattgatcaagaggagcgcgagtcaccagatgagagtgcactgcgctgctgtttaggaccgaagctgttgcattcgatcactgtacccctgtttccgaactgtccactgtacgtcggggcatgttcattccaaaaatcctttag

SEQ ID NO: 52358 - protein, 127 aa, Zea mays
  misc_feature: Ceres CLONE 1469042-F
MAPKWWLGASLLLCLCVTSAEDKTIMPRYCDTAAAFPIGDGSAGAVDYDDSRRHHPRHVQGADPSERPLPQRPLTSLTRTYLSYARSRDSSTRALPPPRTQTSMSSPTSTLIKRSASHQMRVHCAAV

SEQ ID NO: 52359 - DNA, 661 bp, Zea mays
  misc_feature: Ceres CLONE 1469043-F
  misc_feature: Encodes the peptide sequence at SEQ ID NO. 52360
ctccccgcggtggcggccgctctagaactagtggatcccccgggctgcaggaattcgtctcacccctagaaaaaagcaccacactccaaagtccaaagtcgcgtctcccagcctccctccactgtcccacaccccaacactgttccagaccagcggctagcactagcagacagagcccctcctccccctagctcttgctcttccacaggcacagcgcaacgcttccaactagtctcgagacgaccggcagagatgatgaggcgttgcagcatcgccgccctcgccatcttcctcctcctcctcgtgtgctcctcgtcctcctccaactgcgcggcagccgctcgcctcctgcactggcgccggacatctccggcctctccggcatgccgccgagggcgccagtggagacgagctttccgcgggctccgaggtgacaacccaacacacaatggaagcgtgcgatgatggcaacggcaaggacgactgcttgcagaggcggctgctcctcgacgcgcacctctacatactctacacgcggcacaatggcgagccgtgaccgcgatggaggatgccctgccgcaactgcagtggagcgaggagctcgcacatgcaggccaccgtctcggctcggatgctagtgctacggccccccctacggata

SEQ ID NO: 52360 - protein, 35 aa, Zea mays
  misc_feature: Ceres CLONE 1469043-F
MEACDDGNGKDDCLQRRLLLDAHLYILYTRHNGEP

SEQ ID NO: 52361 - DNA, 675 bp, Zea mays
  misc_feature: Ceres CLONE 1469049-F
  misc_feature: Translation starting site: 160
  misc_feature: Pfam Name: Ribosomal_L18e Pfam Description: Eukaryotic ribosomal protein L18
  misc_feature (498)..(498): n is a, c, t, g, unknown, or other
  misc_feature (507)..(507): n is a, c, t, g, unknown, or other
  misc_feature (585)..(585): n is a, c, t, g, unknown, or other
  misc_feature (626)..(626): n is a, c, t, g, unknown, or other
aagctggagctccccgcggtggcggccgctctagaactagtggatcccccgggctgcaggaattcgtctcacccctagaaaaactctctccttcccgagcaggaggcggacaaggtaagcagcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaggggccaggattgtncatgctggntggcgagtgcctcacatttgaccagcttgctcttcgtgctccacttggcgagaacacggtcctctttgagggcccaanaatgcccgtgagcattgagcactttggcaaggctccctggnatgccgccagccccccccaagccgtatgtgccctccaaggaaagaaatt

SEQ ID NO: 52362 - DNA, 678 bp, Zea mays
  misc_feature: Ceres CLONE 1469052-F
  misc_feature: Encodes the peptide sequence at SEQ ID NO. 52363
  misc_feature (561)..(561): n is a, c, t, g, unknown, or other
ctggagctccccgcggtggcggccgctctagaactagtggatcccccgggctgcaggaattcgtctcacccctagaaaaaccccactcgagccagccagccagccaggaagccgcttgggcgccatctctctggagcttcttaccctcgaagagagatccggcgcggcccaataaacacccggcttactacagactcgcagatggccggcctcatgatgaagttcgtcgccgtcgccgccatggccgccgcgctcgtggcgtccgccgcagccgccgaggcccccgccccggctcccgcgtccgacgccgcggccgccgtacccctcgccgcggcctccctcgacgccgccgccttcggctacctcttctgctacatccgcgctggatacgtggttcctgctccagaatatgattcctctggtctggcgcgcctgagtccagctcgtgtgtcgtgcgtgtctctgtgtcatgtgtcgacgcggcgtctgtgtatgtatggagacgccaccgccggcgtcgtgaagactacgtgtgcgcgtggtggataggtacgtgcttcnacgcgccactgtttgtcgcggcgatcatgtactagcctgcatgcgattctggttatcagctgaatgatttatatgatgcctcattaagctaaagagtagaccctcgaggtaaccggc

SEQ ID NO: 52363 - protein, 115 aa, Zea mays
  misc_feature: Ceres CLONE 1469052-F
MAGLMMKFVAVAAMAAALVASAAAAEAPAPAPASDAAAAVPLAAASLDAAAFGYLFCYIRAGYVVPAPEYDSSGLARLSPARVSCVSLCHVSTRRLCMYGDATAGVVKTTCARGG

SEQ ID NO: 52364 - DNA, 675 bp, Zea mays
  misc_feature: Ceres CLONE 1469054-F
  misc_feature: Encodes the peptide sequence at SEQ ID NO. 52365
tggagctccccgcggtggcggccgctctagaactagtggatcccccgggctgcaggaattcgtctcacccctagaaaaactctccctcgcatctacttgctcgcccagcagccgccccaaccctcgcgtccgcatcgattcgaggcagctcgctcttatatatcccattccgctcggttggattcagcttcccctcgccctccctcgtcgataaaaccgatgcaccgtgccgcctcgcgaaccctagcggcggcgggacgaggggaagaaggttacaggcacggcgcgtgaagggtcctgtcctgcccagtcccgtctggtccgccgcgatgccgtggcccgagatgtggctgcctcccgcggccggggagggggcggtggcggcggggctgtttctcgatggcgtcgatgggacggcgcacggcgcgctcctcgcgggcatgcccgggtgctccctgggtcgtcggcaccagcatcggcgccgacgtggggcgccgctggggtttctgtcgctgacaatgtcggtgaaggggggtaggggggttcgcgccgggcccgggtggggttgctcccccaccgcggaagaaaaggccagggcgggaggagtcggaacgccctggtccccggggaaaaagggctgtggaaaatggcctccggaggctgaaggtaaataat

SEQ ID NO: 52365 - protein, 114 aa, Zea mays
  misc_feature: Ceres CLONE 1469054-F
MPWPEMWLPPAAGEGAVAAGLFLDGVDGTAHGALLAGMPGCSLGRRHQHRRRRGAPLGFLSLTMSVKGGRGVRAGPGWGCSPTAEEKARAGGVGTPWSPGKKGCGKWPPEAEGK

SEQ ID NO: 52366 - DNA, 671 bp, Zea mays
  misc_feature: Ceres CLONE 1469055-F
  misc_feature: Encodes the peptide sequence at SEQ ID NO. 52367
tggagctccccgcggtggcggccgctctagaactagtggatcccccgggctgcaggaattcgtctcacccctagaaaaaaaaaaacaccccacgccttgtctctgaactctgatcagagatcaaagaggtagccgttaagttaacgatggcttccgccgacctcgcagaggccatggagcccgggaagaagagcaacgtcaagtatgcttccgtctgtgccatcatggcctccatggcctgcgtcatccttggctacgacattggtgtgatgagtggggcggcgatttacatcaagaaggacctgaagatcacggacgtgcagctggagatcctgataggcatcatcagtctctactcgctcttcggatccttcgctggcgcgcggacgtccgacaggatcggccgccgcttgaccgtcgtcttcgccgcggtcatctttttcgtgggcgcgttgctcatgggcttctcccgtcactacggcatgctcatggtgggccgcttcgtggccggagttggcgtgggctacgggggcatgatcgcgcccgtgtacaccgccgagatctcgccggcggcgtcccgcggctccttcacgtccttccctgaagtcttcatcaacctcggcatcctggtcggctacctgtcgaactacgcatttgcgggcctccgcctc

SEQ ID NO: 52367 - protein, 175 aa, Zea mays
  misc_feature: Ceres CLONE 1469055-F
MASADLAEAMEPGKKSNVKYASVCAIMASMACVILGYDIGVMSGAAIYIKKDLKITDVQLEILIGIISLYSLFGSFAGARTSDRIGRRLTVVFAAVIFFVGALLMGFSRHYGMLMVGRFVAGVGVGYGGMIAPVYTAEISPAASRGSFTSFPEVFINLGILVGYLSNYAFAGLRL

SEQ ID NO: 52368 - DNA, 668 bp, Zea mays
  misc_feature: Ceres CLONE 1469067-F
  misc_feature: Pfam Name: Glyco_hydro_47 Pfam Description: Glycosyl hydrolase family 47
  misc_feature: SWISSPROT Homolog: EC 3.2.1.113 Mannosyl-oligosaccharide 1,2-alpha-mannosidase
tacccgcggtggcggccgctctagaactagtggatcccccgggctgcaggaattcgtctcacccctagaaaaatgttgatgctcggattaatctttttgagtgtaacataagacttcttggggggcttatttctgctcatattcttgcaaaagactacagcagccagtttaagcatgggctgtatcaagatcaattactacgtcttgctgaaagtttaggcaatcgttttctaccggcatttgagacacctactggattgccgtattcatggattaatcttaaggttcatataccgaactttggcttttctcagactttaaaatcttaattttttgcatgcatgaatcaatcgtaagattcctttacaacctgaaatcgtatggccatttgaatgccatcatttattgtgtgtacatatctgtgtacattcaacaggtcaaactgagaaagggtcttctgcaaagagttaccacatttgtctgaaagcagactacaacaaacattgagtttcttctccaataatttttgaaaaaggacgtgtatagttattaagacaagcatgctcattagtacaattttaacatctatcaatgtttaccttaggaaaactgggatattacttgctatcagctaaaatgataagaatgaccaattataagcatgctat

SEQ ID NO: 52369 - DNA, 678 bp, Zea mays
  misc_feature: Ceres CLONE 1469068-F
  misc_feature: Encodes the peptide sequence at SEQ ID NO. 52370
aagctggagctccccgcggtggcggccgctctagaactagtggatcccccgggctgcaggaattcgtctcacccctagaaaaaaagttctcattccttctcctcgctcgctcgcctcctcctctcctctcctctcctctgcggtgggaactgcggcggcggcttaaaccctcgcgccggcggcttccggcgctccatcagcgccgcgctcgaaggccgcccgtcgctggtcgagcgcgcgaggcagcaggcaccggctaggcaggcagccaataatggcccccaaggccgggcgtggcaagggcaggggcggcggcggcagaggcggcgacaggaggaagaaggaagagaaagtggtgcccagcgtggtggacgtcacggtcgtcaccccctacgaatcccaggtgacactcaaggggatatcgacggaccgtgtgctggacgtgcggaggctgctggggtcgaacgtggaaacgtgccacctgacaaactattcactctcccatgtggcgcgcgggcaccggctggaggacggcgtggaagtcgtggcgctcaagccctgcgctctccggatcgtcaaagaagagtacgcgacggcggagcaggcggaagcgcacgtgcgcccgctgctggacatcctcgcctggcacaccgcgttcgccaagcccgggacggcgcc

SEQ ID NO: 52370 - protein, 134 aa, Zea mays
  misc_feature: Ceres CLONE 1469068-F
MAPKAGRGKGRGGGGRGGDRRKKEEKVVPSVVDVTVVTPYESQVTLKGISTDRVLDVRRLLGSNVETCHLTNYSLSHVARGHRLEDGVEVVALKPCALRIVKEEYATAEQAEAHVRPLLDILAWHTAFAKPGTA

SEQ ID NO: 52371 - DNA, 644 bp, Zea mays
  misc_feature: Ceres CLONE 1469072-F
  misc_feature: Encodes the peptide sequence at SEQ ID NO. 52372
  misc_feature (449)..(449): n is a, c, t, g, unknown, or other
  misc_feature (470)..(470): n is a, c, t, g, unknown, or other
  misc_feature (472)..(472): n is a, c, t, g, unknown, or other
ggagctccccgcggtggcggccgctctataactagtggatcccccgggctgcaggaattcgtctcacccctagaaaaagctccaggcctccaacgttcacctctctctcgttcatccttggctcatgcctcccgtatgaacacgcccaggacagccacagcataaggcggctgctgtgccaccgatcgtgcatgccagtgcctccatctcgtctaccattactcgaaccctagatagcgagaaagcctggtgtttctggaggagacagacatgatccctgccgttgctgatccgacgacgctggacgggggcggcgcgcgcaggccgttgctcccggagatggaccctcgggggcgtgctgccgccggcgccgggcagaagcggccgccggcgacgccgaccgttctccccgccgtcgtctccgccgtgctcgtcctcgtcctcgtggncggtcacagttcctcgcgtcnancacgtcaacggaaagctgggggcgttccccgggccaagatgccgccctcgtcgaaggggccgcctcccctggcctggcttaagcgctgtcgaaaaattccaggcccccgttcccggggggggggcggtccagaatttccctggaccaaccgattcttggggggcaacccccc

SEQ ID NO: 52372 - protein, 124 aa, Zea mays
  misc_feature: Ceres CLONE 1469072-F
  misc_feature: SWISSPROT Homolog: EC 3.2.1.26 Beta-fructofuranosidase
  misc_feature (60)..(60): Xaa is any aa, unknown, or other
  misc_feature (67)..(67): Xaa is any aa, unknown, or other
  misc_feature (68)..(68): Xaa is any aa, unknown, or other
MIPAVADPTTLDGGGARRPLLPEMDPRGRAAAGAGQKRPPATPTVLPAVVSAVLVLVLVXGHSSSRXXRQRKAGGVPRAKMPPSSKGPPPLAWLKRCRKIPGPRSRGGGGPEFPWTNRFLGGNP

SEQ ID NO: 52373 - DNA, 648 bp, Zea mays
  misc_feature: Ceres CLONE 1469086-F
  misc_feature (567)..(567): n is a, c, t, g, unknown, or other
  misc_feature (584)..(584): n is a, c, t, g, unknown, or other
tggagctccccgcggtggcggccgctctagaactagtggatcccccgggctgcaggaattcgtctcacccctagaaaaaatccgtgcgcaggcaccctccgccggcgatggctcacgcatcgctcggcgcccgccccacgtccccgaggcgacgaccggcacaacgcgccctcgcggcgctacccgacacctgcgacgaaacgcgccaagttcaggagcgcgtcgacacaggggctcgggaacacggtgtcgccatcgcggaaccctagcgagatcgtcgggaaggtccgaaggtgagcacgtgtttgtgtaacctttggctccggttcgcaatggtggacggcgatggtgacagggaacaccagcaatagccggttgtggcagctgccgccgcgtcacatagcgccgagttggaggggcacatcacgtgaatagatctgcgcagtctcgcatcatggcagtgccggcggcctcccgggcatggcgactctccccagtcgaccaggcacctcttcgtcctttgggcccgtaccctccgcttcctcgggcgtgtccgccggtctattngacgccgtcaaaccggntggccgtgtccgggtcatctccgcgcccctcctcaaatggccaaaccctacctggtgtaactag

SEQ ID NO: 52374 - DNA, 690 bp, Zea mays
  misc_feature: Ceres CLONE 1469093-F
ggagctccccgcggtggcggccgctctagaactagtggatcccccgggctgcaggaattcgtctcacccctagaaaaagtgtgcgagggtccgctcctcctcccctccgtgcacccggagggcagcggcgtctcttcttcctggtcgaatctccccgcggctgtgaataggaggaggtcgacgacgccataacaaaaaacaaatccttggaatgctttcggagggtcggggattcgtcgccggctgcctgcactgatgcttggagcgcgcgaatctgctcaagttttgatcttggcgtgctcttgagtctggaatccgggcattcattggggctttgttctcaatttgcaaggctgcaaggccgtgctagtttgaacccatggagactactagcacaacaaatgaacagactgataggggggcgatgtgggagttggaaaggaatctccatcaccccatggatgcagaggccgggagattgagaaatatgtacagggaaaaagccctaccctacacttggtgctgttacaccttgctttccaaagccttggtgtgggggttgggggatttagggcacatcacccttttaaggccttccccaaacattttcccctccggaaatttgaaaacaccggaaacaaaattattgggaacccctcctcgcctgggttatttacccgcccttaaccc

SEQ ID NO: 52375 - DNA, 373 bp, Zea mays
  misc_feature: Ceres CLONE 1469128
  misc_feature: Encodes the peptide sequence at SEQ ID NO. 52376
agctgagacaagaactctgagcatgagccgcagaaagaacactgtcctcgcccttgtggcatggatcatgttgcttgcactcttcatcacaacggcgacggcctcactcccatgccaatgctgctggctggtgcagcatccgaaggtgacatgcggccacgcctgctgcggcgacaactgttgcccgcccacgccaccaccgtccacccgctgaattcgagatagatcataaatacagtatcatgatgatacataataaactccgccggaaagttgttatagtatcccgccacttttctgtgagcatatgatatatatgctgcagcatgcatgacaataaaacatctctttggttcaaaaaaaaaaaaaaaaa

SEQ ID NO: 52376 - protein, 63 aa, Zea mays
  misc_feature: Ceres CLONE 1469128
MSRRKNTVLALVAWIMLLALFITTATASLPCQCCWLVQHPKVTCGHACCGDNCCPPTPPPSTR

SEQ ID NO: 52377 - DNA, 651 bp, Zea mays
  misc_feature: Ceres CLONE 1469142-F
  misc_feature: Encodes the peptide sequence at SEQ ID NO. 52378
  misc_feature (393)..(393): n is a, c, t, g, unknown, or other
  misc_feature (402)..(402): n is a, c, t, g, unknown, or other
  misc_feature (413)..(413): n is a, c, t, g, unknown, or other
  misc_feature (504)..(504): n is a, c, t, g, unknown, or other
  misc_feature (512)..(512): n is a, c, t, g, unknown, or other
  misc_feature (525)..(525): n is a, c, t, g, unknown, or other
  misc_feature (546)..(546): n is a, c, t, g, unknown, or other
aaagctggagctccccgcggtggcggccgctctagaactagtggatcccccgggctgcaggaattcgtctcacccctagaaaaaaggctccatgccactgccacctgggtgggttttctttccgggggcacatcacacatggcgtccgtccgcgtaggcacagaaggcttctcctggaggtgtgggagctgagttgggaggaggactgctgctgcagccatgaaggccctcattctcgtcggaggcttcggcacccgcctgcgcccgctcacgctcagcgtgcccaagccgctcgtggatttcggcaacaagcccatgatcctgcaccagatcgaggctctgaaggaaagtggtgttacagaagttgtcctgggccatcattaccagcctgangtcatgctncactttctcanggacttcgagagcaagcttgggcatcagatcacctgctcgcaggagacgggagccctcgggaccgcaggcccgctggccctggcccgcgancagctcgnccgacggatcccngcgaccctttcttcgtgctcnacaggcgacgtgatcagccgagtacccgtttcgcgaggctcatttgagttccacaggggcccacgggcggcgaaggccaccgatcatgggtgaccaaaggtccaa

SEQ ID NO: 52378 - protein, 139 aa, Zea mays
  misc_feature: Ceres CLONE 1469142-F
  misc_feature: SWISSPROT Homolog: EC 2.7.7.13 Mannose-1-phosphate guanylyltransferase
  misc_feature (58)..(58): Xaa is any aa, unknown, or other
  misc_feature (65)..(65): Xaa is any aa, unknown, or other
  misc_feature (95)..(95): Xaa is any aa, unknown, or other
  misc_feature (98)..(98): Xaa is any aa, unknown, or other
MKALILVGGFGTRLRPLTLSVPKPLVDFGNKPMILHQIEALKESGVTEVVLGHHYQPXVMLHFLXDFESKLGHQITCSQETGALGTAGPLALARXQLXRRIPATLSSCSTGDVISRVPVSRGSFEFHRGPRAAKATDHG

SEQ ID NO: 52379 - DNA, 654 bp, Zea mays
  misc_feature: Ceres CLONE 1469146-F
  misc_feature (625)..(625): n is a, c, t, g, unknown, or other
  misc_feature (637)..(637): n is a, c, t, g, unknown, or other
aagctggagctccccgcggtggcggccgctctagaactagtggatcccccgggctgcaggaattcgtctcacccctagaaaaatgccattgcaaatagagtcgatactgtacataagttaccatggataggtttccagtcatggcgggctgctggaagaaaggatgtcctccatgctccagtcaaagctcgccatgggtgacttgactgcctgggactcctactcacctgtcctcagcactatgttgatatgaattcagctccataaggtatccttgtctgaaagagctgaagaaaccttagaggaaattacatctggagaaagtaacgaggatgttatatactactggtcaccaatggatatggaccaaacttctgacttttggttgacatgtgattctctaaatgctggcaattgcagatctcttttcgaagatgcatttagggctatgtatggattaccagagaatgtcttgggcccttccaccaatgcccaatggatggtgatcattggtctactcttcatagctgggtcatgcccaccccatcatttctgaaattcatcatgttctcaagaatatttgttgaatcacttcatagcttgaatgtgaatagtactgaaaacnacgtctttgttnccttgggggcatcaaaa

SEQ ID NO: 52380 - DNA, 629 bp, Zea mays
  misc_feature: Ceres CLONE 1469153-F
  misc_feature: Encodes the peptide sequence at SEQ ID NO. 52381
  misc_feature (328)..(328): n is a, c, t, g, unknown, or other
  misc_feature (379)..(379): n is a, c, t, g, unknown, or other
  misc_feature (384)..(384): n is a, c, t, g, unknown, or other
  misc_feature (397)..(397): n is a, c, t, g, unknown, or other
  misc_feature (412)..(412): n is a, c, t, g, unknown, or other
  misc_feature (423)..(423): n is a, c, t, g, unknown, or other
aaagctggagctccaccgcggtggcggccgctctagaactagtggatcccccgggctgcaggaattcgtctcacccctagaaaaaaacctgtgcctcctctattctttcccttttcctcgcatccatcctccggcgtccgcccttctctcgcgcgcgccgaccgccgccgccaggtgccaggaagtcgtgggaagtcttcttcggcgacgagcacccaccaggtcatatctctgcaatgggtgactacacaatccagattagcaccaagctcattgaccagcttgctcgtgatgacgagaaggtaaaacggaaagcccagaagcccangcctaagaagaaagccaccgtcccagcacatggagagcccctggaattccngagangacaaagacgacnagccttgctactgcntcctgggtggnctctgcagcctccccctatgttttctgcagtgaccccttcttccccggcacccccgggcaaaatgccgggaggtggaaaccattccgtccggtccttgaaagaaagccaggcccttcctccagaacctgggaaaaccaggaaactgggggccagcccaaagcccccccagaaaaccaagggattgcccgacaaaggggttttcagt

SEQ ID NO: 52381 - protein, 131 aa, Zea mays
  misc_feature: Ceres CLONE 1469153-F
  misc_feature (31)..(31): Xaa is any aa, unknown, or other
  misc_feature (48)..(48): Xaa is any aa, unknown, or other
  misc_feature (50)..(50): Xaa is any aa, unknown, or other
  misc_feature (54)..(54): Xaa is any aa, unknown, or other
  misc_feature (59)..(59): Xaa is any aa, unknown, or other
  misc_feature (63)..(63): Xaa is any aa, unknown, or other
MGDYTIQISTKLIDQLARDDEKVKRKAQKPXPKKKATVPAHGEPLEFXRXQRRXALLLXPGWXLQPPPMFSAVTPSSPAPPGKMPGGGNHSVRSLKESQALPPEPGKTRKLGASPKPPQKTKGLPDKGVFS

SEQ ID NO: 52382 - DNA, 610 bp, Zea mays
  misc_feature: Ceres CLONE 1469161-F
  misc_feature: Translation starting site: 280
  misc_feature: SWISSPROT Homolog: EC 1.2.4.1 Pyruvate dehydrogenase (acetyl-transferring)
  misc_feature (389)..(389): n is a, c, t, g, unknown, or other
  misc_feature (391)..(391): n is a, c, t, g, unknown, or other
  misc_feature (392)..(392): n is a, c, t, g, unknown, or other
  misc_feature (434)..(434): n is a, c, t, g, unknown, or other
  misc_feature (438)..(438): n is a, c, t, g, unknown, or other
  misc_feature (443)..(443): n is a, c, t, g, unknown, or other
  misc_feature (549)..(549): n is a, c, t, g, unknown, or other
  misc_feature (553)..(553): n is a, c, t, g, unknown, or other
aaagctggagctccccgcggtggcggccgctctagaactagtggatcccccgggctgcaggaattcgtctcacccctagaaaaaccgaggccttgcctgcctgccttgtttccccaaccccctcggaccctcacatcttcctcggtctctccgccgcccaccacctccatccccctcctctctttatacgccaccgcggcggggcttcccccatccctctgtccgttcgctgcattgctcccctaaccgttcggccaggagacagcggagagggcagagatggcggccgcgtccttcaccgccgccaagttcctggcgccggtggccgcgagatccggcggaaagagggcgcccccgctcccccgcggcgcctcgtcctcctccttcgncnnagaccctgcgccgcggcgcggtgggcacaccgcgcctgcgcnacgngctcngcgtctcctccgaactgctcgctgggaacaggccgcgcaggccgcccgccgcgcatcgggcggttacacgggaagaagcactggagctgtatgaagacatggttcntggncgttgtatcgaggaactgtgtgcacaaatggactacgtgggaagaaggtttggttcc

SEQ ID NO: 52383 - DNA, 652 bp, Zea mays
  misc_feature: Ceres CLONE 1469162-F
  misc_feature (538)..(538): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
aagctggagctccccgcggtggcggccgctctagaactagtggatcccccgggctgcaggaattcgtctcacccctagaaaaacctctcttcttccaccaccacctcctactccgctgcaaccccaaatctctccttcctcgcatacgcgcgcagcagaggagctgagaccaacgaagaagaagaacaaccgagcaagcacaagcttagctagcgtggaggtgcccaaggcgacgacggccgccgcgccaggctagccaaccagctgctcatcgctcctagctgcggagccgatggctggagccgacgtcgacgtcgggacggagctccgcctcggcctgccaggaggaggcgccgatgcggccaaggctgccaagagggcgcttcgaaggacacccattcgaacctcaaagcttgaagcctggcccccccccccccgggtttggggaaaaaaaaaatttgtcctttttttccccccccccccccccaatatgggggggggggagggcggcggcccccccccccccaaaagaaagatnttnnnnccccaacccccccccccaaaggagggggggggcccggccccctttttttttttatattataaaaaaaaaaaaaaaaaacccccccccccccccccccccccgcggggg

SEQ ID NO: 52384 - DNA, 805 bp, Zea mays
  misc_feature: Ceres CLONE 1469171-R
  misc_feature (16)..(16): n is a, c, t, g, unknown, or other
cgaattgggtacgtgnagcgtctcgtttttttttttttttttggaacttgggaaaatatagttaggctttctaagggtccacctgagaaaaaccttccaaagcttaccacaataacctagctttaatacacaacaaaggggcaaagggtgggaggcacatcaccaaaaccaccaaaatctacgcttcaatgcccagccgctgcagcatactcaacaaaaaacctcagcctccggctcaaaacatcaagctcatccatcctctgtgctctccaccgcttgaaaagctcgctctccgcattgccaccattgataatcccgttactctttgcctccctcaggcattcctcaaacacatctagaacaccatttgccattcggggctctttgctgcacggcaccaccgttttacactccgcactcatctcactgccaattccgttgttcccattcgggaaagtaaccacggcctcaggctgctcctgcacaacaacatcaaatttgctatctgctacaaaagcagcgccttcatgattgcccagctgcccgctttcttgctcaaggtaaaacgtaacctccccgttggaaccatccggaaacaaaccgggagcaaaggagctaatcccattgtagtcatgggagttgctatccccaaacccttctgggggagggagcaggcctgccacacagattgaaacagcggcccttgttcccccacattccggccctggccacaaaggggaaggtggcgccctttgcggggtccccacccctggaaacaaaagtggagaaacttcccgttccttcc

SEQ ID NO: 52385 - DNA, 646 bp, Zea mays
  misc_feature: Ceres CLONE 1469176-F
  misc_feature: Encodes the peptide sequence at SEQ ID NO. 52386
  misc_feature (438)..(438): n is a, c, t, g, unknown, or other
  misc_feature (454)..(454): n is a, c, t, g, unknown, or other
  misc_feature (486)..(486): n is a, c, t, g, unknown, or other
  misc_feature (569)..(569): n is a, c, t, g, unknown, or other
ggagctccccgcggtggcggccgctctagaactagtggatcccccgggctgcaggaattcgtctcacccctagaaaaaaattaaactgggcatcatatagtatgggagaaaaacgctcggaaatttcgtctgatcactcgatatttgttggcgatttggctgttgatgttactgatgcgatgttgctggaacttttttctaacaaataccgatcggtgaaaggagctaaagttattattgatgcaaacacaggccgttctagaggctacggctttgttaggtttggagatgataatgacaaaattcatgcaatgactgaaatgaatggtgtttactgttccacaagaccaattcgtgtaggaccagcgactcctagaagatctcaaggtgattctggcacttctccaccaggcaatctcatgttgactctactaacanggacgtatatgttggntgggcttgacccccaatgtagcgaagatgaanctgaggaagcatttgcaaaaatatggtgatcttgcctctgtcaaatttctttttggaaacaaatgtggttttggtcaatttgnaaaccgaatttgatgctgaaaaacccctgcctgggtggaatgaatcactattggaaagcaggcatttccatttcctg

SEQ ID NO: 52386 - protein, 137 aa, Zea mays
  misc_feature: Ceres CLONE 1469176-F
  misc_feature (14)..(86): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (113)..(113): Xaa is any aa, unknown, or other
  misc_feature (118)..(118): Xaa is any aa, unknown, or other
  misc_feature (129)..(129): Xaa is any aa, unknown, or other
MGEKRSEISSDHSIFVGDLAVDVTDAMLLELFSNKYRSVKGAKVIIDANTGRSRGYGFVRFGDDNDKIHAMTEMNGVYCSTRPIRVGPATPRRSQGDSGTSPPGNLMLTLLTXTYMLXGLDPQCSEDEXEEAFAKIW

SEQ ID NO: 52387 - DNA, 642 bp, Zea mays
  misc_feature: Ceres CLONE 1469178-F
  misc_feature: Encodes the peptide sequence at SEQ ID NO. 52388
  misc_feature (494)..(494): n is a, c, t, g, unknown, or other
aaagctggagctccccgcggtggcggccgctctagaactagtggatcccccgggctgcaggaattcgtctcacccctagaaaaagtctcgccgcccggggaggaggggtccgccgctcccggggaagagtgagccattgccgctgctggtgagttcccctcctctctctctcccagacatcagccgccgacgcagaaaataaaaactccctgaacccccaatccacaaatggcgtcaaacagcacctaccttgccgccgacggcttcgcggcgccgagcctcttctcgcagggtgtatcctacacgtacgacgacgtcatcttcctcccggcctatatcggcttccccgccgacgccgtcgacctctccacccgcctctcccgccgcgtcccgctatccatcccttgcatcgcgtccccgatggacacggtttccgagtccgctatgggcgcgaccatggcatcactcggcgccgccgccgtcgtgcactgaanacccgatccccacgcccaagccgccatcgtccgcgcttgctagtcccgccgcattccctgcgtttcctccgtgccctttttctccacgtactccgccccgactctcaacgatttcgctggctgttactacgccctcgtcaccgagcgg

SEQ ID NO: 52388 - protein, 87 aa, Zea mays
  misc_feature: Ceres CLONE 1469178-F
  misc_feature: SWISSPROT Homolog: EC 1.1.1.205 IMP dehydrogenase
MASNSTYLAADGFAAPSLFSQGVSYTYDDVIFLPAYIGFPADAVDLSTRLSRRVPLSIPCIASPMDTVSESAMGATMASLGAAAVVH

SEQ ID NO: 52389 - DNA, 656 bp, Zea mays
  misc_feature: Ceres CLONE 1469179-F
  misc_feature: Encodes the peptide sequence at SEQ ID NO. 52390
  misc_feature (548)..(548): n is a, c, t, g, unknown, or other
tggagctccccgcggtggcggccgctctagaactagtggatcccccgggctgcaggaattcgtctcacccctagaaaaactcgcttccaccgtcctccgcctccgcctccatccgccccgcgcccagtactcgtctcttgctttctccctctctctctctccgcgcgcgcacccacgcacgcagtttgagagggtgtgcggcgctcgaggggcgaggagcggggcggtccatggcagaggcaggctgttccgcggtgaggaccaggacggcggggctcgccgccgccgccgccgccgcggcggcgctcctcgtgctcgtggttgtcgccggcagcgcggcgctccctggcgcgcgggtgagggtcctcgacggcctccggcacaggagcacggccgtggcggcgggcggcgcgaggcgttggctgcggtactcctcctggccggcggcggcggcggcgacgacgacgacgaggggcagggccgacgacggcgacgccggcggggcatcgagggccgtcaccggcgcggtggaggatccggaggccgtnggcaacgacgtgcacgtgtccatcaggaacagcacggcgcggcgaaacctcgggtacctgtcgtgcgggacagggcacccgatcgacgactgctggcgctgccactcg

SEQ ID NO: 52390 - protein, 142 aa, Zea mays
  misc_feature: Ceres CLONE 1469179-F
  misc_feature: SWISSPROT Homolog: EC 4.2.2.2 Pectate lyase
MAEAGCSAVRTRTAGLAAAAAAAAALLVLVVVAGSAALPGARVRVLDGLRHRSTAVAAGGARRWLRYSSWPAAAAATTTTRGRADDGDAGGASRAVTGAVEDPEAVGNDVHVSIRNSTARRNLGYLSCGTGHPIDDCWRCHS

SEQ ID NO: 52391 - DNA, 556 bp, Zea mays
  misc_feature: Ceres CLONE 1469190-F
  misc_feature (116)..(116): n is a, c, t, g, unknown, or other
  misc_feature (154)..(154): n is a, c, t, g, unknown, or other
  misc_feature (262)..(262): n is a, c, t, g, unknown, or other
  misc_feature (277)..(277): n is a, c, t, g, unknown, or other
  misc_feature (288)..(288): n is a, c, t, g, unknown, or other
  misc_feature (292)..(292): n is a, c, t, g, unknown, or other
  misc_feature (354)..(354): n is a, c, t, g, unknown, or other
aagctggagctccccgcggtggcggccgctctagaactagtggatcccccgggctgcaggaattcctctcacccccctagaaaaaaagagcaacgccctaggcacacaccgacacngaaccaggcagccagccgcggagggaggaaccctagcnggaacaggtgacggcggcgcgcaaccggtgacgggggatacggcggcatcctcccctcctccatccccggcgcggcggcgccagcagccggcctgcaggctgtttgangagcccgccattttnatctcatggangccnagttttttccgttttcctgaagctccgttggggtccgcttccaagcggagtcagagaaccanaagccctggagttgttccttaaaactggcctttcgccctggagggtggacccagttccgcgggcccattccggaactctaagggtccgaaagtggttcaaaggggaagggggatcccggacctttgaccaggttttccaacctgaaaccccgaaaaaaaccaaaaaaatatgggcgttccccaaggggttcaacctttttcc

SEQ ID NO: 52392 - DNA, 672 bp, Zea mays
  misc_feature: Ceres CLONE 1469191-F
  misc_feature: Encodes the peptide sequence at SEQ ID NO. 52393
tggagctccccgcggtggcggccgctctagaactagtggatcccccgggctgcaggaattcgtctcacccctagaaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggttggcaaggtgcctgccgagccatgctgtaccctcatcaaaggccttgcggacttcgaggccgccgtctgcctctgcacggccatcaaggccaacgtgctcggcgtcgtcgtcgatgtccccatcaagctcagcgcgctcgtcaactactgtggcaagtgcgtgcccaagggctacatgtgcgcgtaagcagctccgggcggttacacgctcgtagctgttcacgtacgagattatatatgcacgcaccctgcatggcacgaatgcatgcattgtgtccgctgatatatctctcctgtctcagttgtgcac

SEQ ID NO: 52393 - protein, 133 aa, Zea mays
  misc_feature: Ceres CLONE 1469191-F
  misc_feature (51)..(132): Pfam Name: Tryp_alpha_amyl Pfam Description: Protease inhibitor/seed storage/LTP family
MASKAVLFLALNLLFFTVANACGNCPTPTPPVEPPPPPPAATPPPSSSGKCPLNALKFGVCADVLGLVKGEVGKVPAEPCCTLIKGLADFEAAVCLCTAIKANVLGVVVDVPIKLSALVNYCGKCVPKGYMCA

SEQ ID NO: 52394 - DNA, 679 bp, Zea mays
  misc_feature: Ceres CLONE 1469192-F
  misc_feature: Encodes the peptide sequence at SEQ ID NO. 52395
  misc_feature (245)..(245): n is a, c, t, g, unknown, or other
  misc_feature (247)..(247): n is a, c, t, g, unknown, or other
  misc_feature (346)..(346): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (612)..(612): n is a, c, t, g, unknown, or other
  misc_feature (618)..(618): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (658)..(658): n is a, c, t, g, unknown, or other
aagctggagctccccgcggtggcggccgctctagaactagtggatcccccgggctgcaggaattcgtctcacccctagaaaaaagcgaggtagagaagaactggaaactgaatgatctcttggacgctcttgatttcaaccaagttgtgatattcgtgaagagtgttagcagagctgccgaactgaaatagttactttgtgaatgcaactttcccatcatctgcattcattctggaatgacccangnagaaaggctcctacagaccttgggagtcctgaaagcagctccctatccttgtcccatttctggtacccctgtgggtgacgataaaaggcaaaaaattgnattttaaaaggaccatggccaaggccggccctgcgcagaagaaaggcctgaaaaaacaaataaccttccgaaggggcccccattttccgaacgcgcgaaaaactttaaaaggggaaacccaatttttttttgggagaacttttttaaaaaaaatttcaacctgggcttgtttcccggggaaaacccttttggtgggaaatttcccccccacaccccgagttcccctttttttgggggggggnnnngggaaaaaaaaaaaaaaaaanaccacncaatttttnnnaaaaaaaaaaaaaaaaattggagggaccntcccccccgctctccgcgcga

SEQ ID NO: 52395 - protein, 62 aa, Zea mays
  misc_feature: Ceres CLONE 1469192-F
AGAPRGGGRSRTSGSPGLQEFVSPLEKSEVEKNWKLNDLLDALDFNQVVIFVKSVSRAAELK

SEQ ID NO: 52396 - DNA, 685 bp, Zea mays
  misc_feature: Ceres CLONE 1469197-F
  misc_feature: Encodes the peptide sequence at SEQ ID NO. 52397
ggagctccccgcggtggcggccgctctagaactagtggatcccccgggctgcaggaattcgtctcacccctagaaaaactcgcccctctctcccaccccgcagccgccctagcacccgcgacgagcaggatctgcccagttgctcttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcagacagctccttggacaggctgtggcaaaagaagaaggctgatatcaagcagtagattttacatctagtttaccaagaattggacaccgccttagctatgttttgaattcatgtcactatatgcaatgttgtgatttcagctggtaccttaaatctgaagatttagtatctttgttgggttccttctgagtttgatgtgtggtgttcgtttaattcccttgtacaaccccatttagtatcattgtgatgattttggattctaaaaaaaaaaaaaaaacgagacgctcgaggtacccaattcgccctatagtgagtcgtattac

SEQ ID NO: 52397 - protein, 81 aa, Zea mays; identical to SEQ ID NO: 6959
  misc_feature: Ceres CLONE 1469197-F
  misc_feature (1)..(81): Pfam Name: Ribosomal_S21e Pfam Description: Ribosomal protein S21e

SEQ ID NO: 52398 - DNA, 650 bp, Zea mays
  misc_feature: Ceres CLONE 1469199-F
  misc_feature: Encodes the peptide sequence at SEQ ID NO. 52399
acccgcggtggcggccgctctagaactagtggatcccccgggctgcaggaattcgtctcacccctagaaaaaagcctccacccctcacccgccgcagccaatccctccccagcagccgtcgtcgccaccgctgcagcgcggaggcgaccccccatcgccgccaagatgcagatcttcgtgaagaccctgacggggaaaacgatcacgttggaggtggagtcctcggacaccatcgacaacgtgaaggccaagatacaggacaaggagggcatcccgccggaccagcagcggctaatcttcgccggcaagcagctcgaggacggccgcaccctcgccgactacacatccagaaggagtccaccctccacctggtgctccgcctccgaggtggcgccaagaagcgcaagaagaagacgtacaccaagcccaagaagatcaagcacaagcacaagaaggtaaagctcgcagtgctgcagttctaccaggtggacgacgccaccggcaaggtgacccgcctcccgcaggagtgccccaacaccgagtgcgggtgcgggtgtctccatggccaaccactttgaccgccactactggcggcagtgcgggcctcccttacgtctacaattccgagagggtaatccccgtgcgcgctt

SEQ ID NO: 52399 - protein, 97 aa, Zea mays
  misc_feature: Ceres CLONE 1469199-F
  misc_feature (6)..(75): Pfam Name: ubiquitin Pfam Description: Ubiquitin family
MQIFVKTLTGKTITLEVESSDTIDNVKAKIQDKEGIPPDQQRLIFAGKQLEDGRTLADYTSRRSPPSTWCSASEVAPRSARRRRTPSPRRSSTSTRR

SEQ ID NO: 52400 - DNA, 708 bp, Zea mays
  misc_feature: Ceres CLONE 1469200-F
  misc_feature: Encodes the peptide sequence at SEQ ID NO. 52401
  misc_feature (400)..(400): n is a, c, t, g, unknown, or other
aagctggagctccccgcggtggcggccgctctagaactagtggatcccccgggctgcaggaattcgtctcacccctagaaaaacctccattcgcggtttgcctctctgcctccctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttcccctgagttctcaacctgatggcacgcaagatgaaggacacagactctggaggagagctcanggaggcctttcgcggtgtcgacaagggacagaacgcttcatctctgctgctgaacttcgacatggcctgacccacctaggtgaaaacctgacggaagaagaaggtggataaaatgatccgtgaaacccaaacgggaccgggatggcccaatcaacaaccaggattccgggaaggtgaataggccaaaggaaaaaattgccctgttttaaacccttccccccccctaggggaaaaccccgctccggttggaaaaaatccgtttttggccccccttgttccccccggggaaaggggagaaatcctttttt

SEQ ID NO: 52401 - protein, 67 aa, Zea mays
  misc_feature: Ceres CLONE 1469200-F
  misc_feature (12)..(40): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFP

SEQ ID NO: 52402 - DNA, 681 bp, Zea mays
  misc_feature: Ceres CLONE 1469210-F
  misc_feature: Encodes the peptide sequence at SEQ ID NO. 52403
ctggagctccccgcggtggcggccgctctagaactagtggatcccccgggctgcaggaattcgtctcacccctagaaaaagtccaattcatccaccttgtccctcccggagaaccagaaggctacccaccctccaaggcaggggaggggccatggacgaccccgtcgagcgcttgaaggacgggttccacaagttcaagaccgaggtctatgacaagaagccggagctgttcgagcctctcaaggccggccaggcccccaagtacatggtgttcgcctgctccgactcccgcgtgtgcccgtcggtgacactgggactgcagcccggcgaggcattcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaccttccacttcgttgagaactgggttaagatcggcttccctgccaagattaaggtgaagaaagaccacgcatcggtgccgttcgatgaccagtgctctattctagagaaggaggccgttaacctgtccctggagaacctcaagacctaccccttcgtcaaggatgt

SEQ ID NO: 52403 - protein, 176 aa, Zea mays
  misc_feature: Ceres CLONE 1469210-F
  misc_feature (31)..(176): Pfam Name: Pro_CA Pfam Description: Carbonic anhydrase
  misc_feature: SWISSPROT Homolog: EC 4.2.1.1 Carbonate dehydratase
MDDPVERLKDGFHKFKTEVYDKKPELFEPLKAGQAPKYMVFACSDSRVCPSVTLGLQPGEAFTVRNIAAMVPAYDKTKYTGIGSAIEYAVCALKVEVLVVIGHSCCGGIRALLSLQDGAPDTFHFVENWVKIGFPAKIKVKKDHASVPFDDQCSILEKEAVNLSLENLKTYPFVKD

SEQ ID NO: 52404 - DNA, 665 bp, Zea mays
  misc_feature: Ceres CLONE 1469211-F
  misc_feature: Encodes the peptide sequence at SEQ ID NO. 52405
ctccccgcggtggcggccgctctagaactagtggatcccccgggctgcaggaattcgtctcacccctagaaaaaaccagcaacccccaacagcgccactgtccagtgcgcgcgtcaagcttgcttagctagccgccatgggctccctcgccgccgtctccgtgaagcccgtggccatcaagggtctcgccggcagctccatctccggaaggaagctcgccgtcgccaggccgtcggcccgctccatccgcaggccccgcgcatccgccgtggtggccaagtacggcgacaagagcgtctactttgacctcgacgacatcggcaacaccaccggacagtgggacctctacggctctgacgcgccctcgccctactgcccgctacagagcaagttcttcgagacgttcgcagctccgttcaccaagagaggtctgctgctcaagatcctgctgatgggcggcggctcacttctggcctacttcagagcgtcggcgtcaccggacttcctgccaatcaggaagggacctcaagagccccccaacccgggccccgcgcggaaaaacaaaaccccacttcccccttggcaggcccaaaaacttggtttgtaagggaaggccgggcaatccgcccaaaccgcaaggaaaacccccctatttgggggttacc

SEQ ID NO: 52405 - protein, 156 aa, Zea mays
  misc_feature: Ceres CLONE 1469211-F
  misc_feature (5)..(144): Pfam Name: PSI_PsaH Pfam Description: Photosystem I reaction centre subunit VI
MGSLAAVSVKPVAIKGLAGSSISGRKLAVARPSARSIRRPRASAVVAKYGDKSVYFDLDDIGNTTGQWDLYGSDAPSPYCPLQSKFFETFAAPFTKRGLLLKILLMGGGSLLAYFRASASPDFLPIRKGPQEPPNPGPARKNKTPLPPWQAQKLGL

SEQ ID NO: 52406 - DNA, 618 bp, Zea mays
  misc_feature: Ceres CLONE 1469216-F
  misc_feature: Encodes the peptide sequence at SEQ ID NO. 52407
  misc_feature (618)..(618): n is a, c, t, g, unknown, or other
cccccgggctgcaggaattcgtctcaccccctagaaaaaaaatccgcggagtcacataaacaaaatctagattcgacgttccacgggctccggcggcggcaggaacgcctcccgatttcgacggcagagcgagagagcgatggcgctgactaacttcatcgtgacggtggccgtggttggcgcgggggtgcttctcttcaccaccgacatccgcaggtctggcgccctcttccgccgcaacgcgcgccagctccggcagtggctcgaggaggacacggcctccgccgcgtccaagtctgcaaaagaagcagctcaaaagaaactcgactcgacggtccccaaggagaaaccaaaggaagatagccactgactggagctgtttatatgaacggtataacccctatttgaagtattgcaagtcctgttttctacaattactgcaatagaaacttgtagctctcaagtaggtgcacggcaagattatgtttccgcttgaacatcggcctctgtggaacagctagctgaatgttggtattatgtcgtgtgcttatatggatccgaagcacttcgcgaaaaaaaaaaaaaaaccgagacgctcgaggtacccaattcgcccan

SEQ ID NO: 52407 - protein, 76 aa, Zea mays
  misc_feature: Ceres CLONE 1469216-F
MALTNFIVTVAVVGAGVLLFTTDIRRSGALFRRNARQLRQWLEEDTASAASKSAKEAAQKKLDSTVPKEKPKEDSH

SEQ ID NO: 52408 - DNA, 622 bp, Zea mays
  misc_feature: Ceres CLONE 1469219-F
  misc_feature: Encodes the peptide sequence at SEQ ID NO. 52409
ggagctccccgcggtggcggccgctctagaactagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccacctaccatggggtcaccacggggcgggcccccggggctttccggggggggcggcggaaaaaccccagggggcccacaaaaaagagaaaatttttaaaaacccgggggggccccccggggggaaattgttccccccaaaaacccccggggggggagaaaaaatttctttctcccctccccccccggggggggtattattatataaaaaaaacaccccccccgcggggggggggggggggggggggggatctacacccccccccccccccctctctttttgggggtgttttgtttcttccccccccc

SEQ ID NO: 52409 - protein, 154 aa, Zea mays
  misc_feature: Ceres CLONE 1469219-F
MAYYQEVDYCSEEVRSVAPAGFGRHGGGVQQHVVKEKFEEVDTVSRAGANHHHLPWGHHGAGPRGFPGGAAEKPQGAHKKEKIFKNPGGPPGGKLFPPKTPGGGEKISFSPPPPGGVLLYKKNTPPAGGGGGGGGSTPPPPPLSFWGCFVSSPP

SEQ ID NO: 52410 - DNA, 691 bp, Zea mays
  misc_feature: Ceres CLONE 1469227-F
  misc_feature: Encodes the peptide sequence at SEQ ID NO. 52411
  misc_feature (409)..(409): n is a, c, t, g, unknown, or other
  misc_feature (476)..(476): n is a, c, t, g, unknown, or other
  misc_feature (477)..(477): n is a, c, t, g, unknown, or other
  misc_feature (482)..(482): n is a, c, t, g, unknown, or other
  misc_feature (494)..(494): n is a, c, t, g, unknown, or other
  misc_feature (496)..(496): n is a, c, t, g, unknown, or other
  misc_feature (497)..(497): n is a, c, t, g, unknown, or other
  misc_feature (503)..(503): n is a, c, t, g, unknown, or other
  misc_feature (504)..(504): n is a, c, t, g, unknown, or other
  misc_feature (530)..(530): n is a, c, t, g, unknown, or other
tggagctccccgcggtggcggccgctctagaactagtggatcccccgggctgcaggaattcgtctcacccctagaaaaaactctctctccccatccgcgccagtccaaccaagtcagcacccgcgcgcggcaaggagttcacgcccatggcgagcaccaacatggcgtcggccacctcgcggttcatgctggccgcgggcgtgcccaccgccagtagcggcagcggccgcgtcagcttcgcctcggcgcccaaccggcttggcaggaggcttgtggtccgggccgatgaggagtccccggcagagccggcgccgacggcggaaggggagggcgccgtggccaccaagcccaaggccgagaagccgccgccgatcgggcccaagagaggcgccaaggtgaagatcctgangcgggagtcctactggtacaacgggatcggcaacgtcgtcaccgtcgatcaggatcctaacacccgnntaccnggtggtggtgcngnntcacanngtgaactacgccggcgtgtctacaancaactacccctggaacgagatccttccagggaaatgagtggaagcagtctgctcaggaccccatgccctgggggaattgaaattgggaagggaggcgcctgctaactgcaactttaactgctagcgcccaaaatcaaccctggaaaacctaacccccccaa

SEQ ID NO: 52411 - protein, 162 aa, Zea mays
  misc_feature: Ceres CLONE 1469227-F
  misc_feature (78)..(136): Pfam Name: PSI_PsaE Pfam Description: Photosystem I reaction centre subunit IV / PsaE
  misc_feature (88)..(88): Xaa is any aa, unknown, or other
  misc_feature (111)..(111): Xaa is any aa, unknown, or other
  misc_feature (117)..(117): Xaa is any aa, unknown, or other
  misc_feature (119)..(119): Xaa is any aa, unknown, or other
  misc_feature (120)..(120): Xaa is any aa, unknown, or other
  misc_feature (128)..(128): Xaa is any aa, unknown, or other
MASTNMASATSRFMLAAGVPTASSGSGRVSFASAPNRLGRRLVVRADEESPAEPAPTAEGEGAVATKPKAEKPPPIGPKRGAKVKILXRESYWYNGIGNVVTVDQDPNTRXPGGGAXSXXELRRRVYXQLPLERDPSREMSGSSLLRTPCPGGIEIGKGGAC

SEQ ID NO: 52412 - DNA, 671 bp, Zea mays
  misc_feature: Ceres CLONE 1469231-F
  misc_feature: Encodes the peptide sequence at SEQ ID NO. 52413
  misc_feature (51)..(51): n is a, c, t, g, unknown, or other
aagctggagctcaccgcggtggcggccgctctagaactagtggatcccccngggctgcaggaattcgtctcacccctagaaaaaacaaaacaaaaaaaaaaaaaaaaaaacagagcaaaaataacaaaaaaaaaaaaaaaaaaaaaaaatccccgcggcatgaaatttgaggacattgcacccttggctccaactcactctctctccccatccgcgccagacaaaccaagtcaacacccgcgcgcggaaaggagttcacgcccatgggaagcaccaacatggcgtcggccacctcgcgattcatgctggccgcgggcgtgcccactgccagtagcggcagcggccgcgtcagcttcgcctcggcacccaaccggattggcaggaggcttgaggcccaggccaataagaagttcccggcaaagccggcgcccacggcgaaagagaagggcgccgtggccaccaaccccaaggccaagaagccgccgccaatcgggcccaaaaggggcgccaaggtgaaaatcctgagacggaagtcctactgatacaaagggataggaaacgtcatcaccgtcaatcaggatcctaacacccgttacccggtgggggtgcggttcaacaaggtgaactacgccggcgtgtctaccaacaattacgccttggaacaaaaccca

SEQ ID NO: 52413 - protein, 92 aa, Zea mays
  misc_feature: Ceres CLONE 1469231-F
MGSTNMASATSRFMLAAGVPTASSGSGRVSFASAPNRIGRRLEAQANKKFPAKPAPTAKEKGAVATNPKAKKPPPIGPKRGAKVKILRRKSY

SEQ ID NO: 52414 - DNA, 644 bp, Zea mays
  misc_feature: Ceres CLONE 1469233-F
  misc_feature: Encodes the peptide sequence at SEQ ID NO. 52415
  misc_feature (476)..(476): n is a, c, t, g, unknown, or other
ggagctccccgcggtggcggccgctctagaactagtggatcccccgggctgcaggaattcgtctcacccctagaaaaaagctcgctcgccatcccctgcccggctgctgcccccaacggaacgacggccagaggaagctagcagagtcgagagagagagagagagagagagagagagagagagagagagagcatggctggcaggagtttcctgattcggtcccccaaggaggaggagtccgacgccgccgtcagagaagctgtactgctgggagcaaagaacgccgcaatagctggtactgtggttgcagttcccacgctggttggctgccgtgtccttccttgggctaaggcgaatctcatctacactgctcaagctctcattatatctgcagcctgtattgctggcttcttcatcactgctgactaagccattcgacggaacgcacgacaaaacaccatcgggaggcttgacangtcaacctgatgcagagatgtctctgaagctgatcaggttctctggttgccgcgggggctgatagggtgtcttttgccccatatgcagcggcaccatttctcttcgtggacaagtaatttttgggtgtttggctattcaaaccagaggttgttctgttatgacttgtc

SEQ ID NO: 52415 - protein, 78 aa, Zea mays
  misc_feature: Ceres CLONE 1469233-F
  misc_feature (11)..(78): Pfam Name: ENOD93 Pfam Description: Early nodulin 93 ENOD93 protein
MAGRSFLIRSPKEEESDAAVREAVLLGAKNAAIAGTVVAVPTLVGCRVLPWAKANLIYTAQALIISAACIAGFFITAD

SEQ ID NO: 52416 - DNA, 695 bp, Zea mays
  misc_feature: Ceres CLONE 1469238-F
  misc_feature: Encodes the peptide sequence at SEQ ID NO. 52417
ccccgcggtggcggccgctctagaactagtggatcccccgggctgcaggaattcatctcacccctagaaaaaaacgcacgctggcaggcggcggcaatggcgtacctccctccccacaagcgccaacccagcaccacagcctccacgcccatccccgcacccaacccgccacctccgtccctctcctcctcccttcgctccctctccctctcatccccgcgcggccgcggccgcggcgcagtcggacgccacccgctcgcttctacaaagattttccgcgctgccggctgcatctcccgttggttccctctacctcccttctcccctgccggcgacggcgaggagtacaccctacgcctaaagcccttcccgtgttcgggcatcgagcacaggaccggcgccaaaccccttgcccttgtcgtcacctccaacccaggacaaggctcttccggctccactgcggcgggagtcacctccatcgccgagcaatttcttcccgatctccttggccccccggaaagggccaagggaaaacaggcccccctaaagcatgaatttggtgaaaatggaatccttgtttgcaaaaaatggagaagcgggtgctcttacctaatggccaagccaagggagaaaaacgcgccggctttccctggggaaggaaacttcctggcccgagaccctattaaagatcaagg

SEQ ID NO: 52417 - protein, 199 aa, Zea mays
  misc_feature: Ceres CLONE 1469238-F
MAYLPPHKRQPSTTASTPIPAPNPPPPSLSSSLRSLSLSSPRGRGRGAVGRHPLASTKIFRAAGCISRWFPLPPFSPAGDGEEYTLRLKPFPCSGIEHRTGAKPLALVVTSNPGQGSSGSTAAGVTSIAEQFLPDLLGPPERAKGKQAPLKHEFGENGILVCKKWRSGCSYLMAKPREKNAPAFPGEGNFLARDPIKDQ

SEQ ID NO: 52418 - DNA, 671 bp, Zea mays
  misc_feature: Ceres CLONE 1469240-F
  misc_feature: Encodes the peptide sequence at SEQ ID NO. 52419
tggagctccccgcggtggcggccgctctagaactagtggatcccccgagctgcaggaattcgtctcacccctagaaaaagccgctgtccatttcctacttgcaccggagcgagcagcgcgcgggcgcgagccaaccgcgagcccccaagaaaaccacaaaaagaagcgagcatgcctcccaacggcagcaatgctctgctgctcctcctgccaccgctgctgctcctcctgctgcgttccttcgccaatgccggctctctggatgccgacgtcgcggcgctgtcggatttcaggctcgtcgcggacccgtccggcgccgcgctggcgacctggaacgcgtccgcgaacccggcgccgtgcgccggggcgtggcgcggtgtcacctgcgccggcggccgcgtcacgaggctggtgctcgagggcctcggcctctcgggcgccgccgcgctgccggggcacgcgaggctggacggcctccgcgtgctcaccctcaagggcaacggtttctcggggggaatccccgaaactctccgccgctcgcggggctccagcctgctgttccctcgcggggaaaacaacttgcccggcgccgaatcccccccgtcccctggggggggccttgtaccccccttggttcccggattcccaccctggtcgctccaaataaattc

SEQ ID NO: 52419 - protein, 166 aa, Zea mays
  misc_feature: Ceres CLONE 1469240-F
  misc_feature (30)..(73): Pfam Name: LRRNT_2 Pfam Description: Leucine rich repeat N-terminal domain
  misc_feature: SWISSPROT Homolog: EC 2.7.11.1 Non-specific serine/threonine protein kinase
MPPNGSNALLLLLPPLLLLLLRSFANAGSLDADVAALSDFRLVADPSGAALATWNASANPAPCAGAWRGVTCAGGRVTRLVLEGLGLSGAAALPGHARLDGLRVLTLKGNGFSGGIPETLRRSRGSSLLFPRGENNLPGAESPPSPGGGLVPPLVPGFPPWSLQIN

SEQ ID NO: 52420 - DNA, 928 bp, Zea mays
  misc_feature: Ceres CLONE 1469242-R
  misc_feature (721)..(721): n is a, c, t, g, unknown, or other
  misc_feature (758)..(758): n is a, c, t, g, unknown, or other
  misc_feature (804)..(804): n is a, c, t, g, unknown, or other
  misc_feature (818)..(818): n is a, c, t, g, unknown, or other
  misc_feature (887)..(887): n is a, c, t, g, unknown, or other
  misc_feature (928)..(928): n is a, c, t, g, unknown, or other
acgaattgggtacctcgagcgtctcgtttttttttttttttttagcagtaacgcgttccttcttttttagggaattacaaactacacttctgctaacaaagtatggggaatatatacagcaacggccaatattattgccaaataactttccgactttttttgtacaccggaaattgggcttacctctttaatctggaacgacgggggaacaactataatagtggtataagtctgcttcccctatggttcaagaactaggacccccctgaggactgggaagggaaacccctcctttgcggtggagcggctgaaatatttcgccccaccttatgattcttaggcgctaaaacccttgtggatagaactccgggggttggaaggaatgctggtgaaaccctaaacaacaaccttaaacactgcttaaggaaaggatcccagggttgaagatgtttcccaaaagacccatgtggctttattccaaaacggcgccaaagacccaaattggggccttaaaagtaccaacccgcgggaattgaagaaagcccccaacctgggaacaaagggccccccatggtgccgcggaaagggttttaaaaaacctttgggaacggcgccgcaaaaacccacagaagaaggcttcccaagggagcccaaaaatttgtgtggagagagctgagaacttggggggcccttcacgttgaggggatcccctcccgcgagncttgatgttttttccgggagggggggggcgccccgcnattccgcgcgcactcctgtgcgaaaaagagagaccaccgccgccgncgtccgcccttgantgaaaacgggggggggaaaaaaggtaggccacaaatttgtcacgttcgaacgaaagcgcctcgccgggngggcaagagggggttggggccccccactgtccggcaaaaan

SEQ ID NO: 52421 - DNA, 664 bp, Zea mays
  misc_feature: Ceres CLONE 1469242-F
  misc_feature: Encodes the peptide sequence at SEQ ID NO. 52422
ggagctccccgcggtggcggccgctctagaactagtggatcccccgggctgcaggaattcgtctcacccctagaaaaattcgtctgcctcggccccgacccccctccgtttgctagcgactccgggctctactgtttgtcgttctgcttcccttccctaccactgaatggtggctgatcttctcgggctcgcgctgctgctctccgcttgcctctgctacgcttgggcgctcacacacctttggacgacaacttcctggccgtgctaacgctcgcaggactataactcctcccgaagccggagattcgtgctaatctgccgctcccacgtgtactacgattacttgctcctacgcgaacttctgccatgaatatcagatcatgaagaaggttctaattaggaactagaacatctgtgtcttcatgaactataaggacctatctaaccggttatagcctagaactgttgtcatcctctatcatgcacagagtggcaacatcaatactctatgtgcctcaggatgacgctgggcgatacgtcttcttcaacagtatcttcactgttatgcttgaagctttgaatgctctctacgcttgctgatatgaagtatgtgatccgcgtccccaatgaccagacattggtttactgcaacgcttacgatgga

SEQ ID NO: 52422 - protein, 33 aa, Zea mays
  misc_feature: Ceres CLONE 1469242-F
MVADLLGLALLLSACLCYAWALTHLWTTTSWPC

SEQ ID NO: 52423 - DNA, 662 bp, Zea mays
  misc_feature: Ceres CLONE 1469246-F
ggagctccccgcggtggcggccgctctagaactagtggatcccccgggctgcaggaattcgtctcacccctagaaaaaacaaggcacatccctcttcactctctcctccgtcgtcccgtcactcgtcagtcctcgctctcttcactcgctgaaaggcaggctggtggagtggaagcgcttcactccccttcgtgccaccccagcccatcgccttccactggactcatctgcttggcactcctcgccccgtgcttggattcttgcacttggtgcttcccttctcctacctcacatcacccgcccagatccaatccacacgagatttgcgacgctccggcctcccggcacgaagcctttctagggatcgccactcgccacacgccggccggggcgaaaaaagctcttcttggagcccttctgcttggcctctccctctcttctctcccggcgtcattgtcgccgctgcctgcgagcaacaacaattatggccgccgcgacgtcgcgcgggccagcgtcggtcgccatctgtgcgctcgccgtgctccacgcaatggctgcgctgtgcgactccgccaccgcggcggcggcgacgtgcgcgggcctggccccgccaagcaccgggcggaggtgatatccatcgccgacttcgggggggtgggcga

SEQ ID NO: 52424 - DNA, 634 bp, Zea mays
  misc_feature: Ceres CLONE 1469250-F
  misc_feature: Encodes the peptide sequence at SEQ ID NO. 52425
  misc_feature (590)..(590): n is a, c, t, g, unknown, or other
tccccgcggtggcggccgctctagaactagtggatcccccgggctgcaggaattcgtctcacccctagaaaaaaaaaaaaaaaaaaaaaaaaaaactgtcctggcctgtccacggtccacacacgccttccttatatcggcgctcacggttctataaaaaaaacacagtacgagcagagcaaggcggccgtgagctgagctgagggaaggacgacgtacggcacagttgctagcccggccgccggagctctccgtgatctgggccgccagcaacagcatgggtgccgcgctcttggcttcttggccatgggacaacctcggcttctacaagtacgtcctgtacgggccgctggtgggcaaggcggtggcgtcacgggcgtgggaggcggcgagccccgaccgctggatcctcctcctgctcctcctcttcggcctccgcgcgctcacctaccagctctggagctccttcagcaacatgctcttcgccacacgccggcgccgcgtcgtccgcgacggcgtcgacttcgaccagatcgacaaggagtgggactgggacaacttcctgatcctgcacgccctgatggcggccngcgcgctgtgcgcgttcccgtcgctgcggcatctcccggcgtga

SEQ ID NO: 52425 - protein, 118 aa, Zea mays
  misc_feature: Ceres CLONE 1469250-F
  misc_feature (105)..(105): Xaa is any aa, unknown, or other
MGAALLASWPWDNLGFYKYVLYGPLVGKAVASRAWEAASPDRWILLLLLLFGLRALTYQLWSSFSNMLFATRRRRVVRDGVDFDQIDKEWDWDNFLILHALMAAXALCAFPSLRHLPA

SEQ ID NO: 52426 - DNA, 649 bp, Zea mays
  misc_feature: Ceres CLONE 1469257-F
  misc_feature: Encodes the peptide sequence at SEQ ID NO. 52427
  misc_feature (649)..(649): n is a, c, t, g, unknown, or other
tccccgcggtggcggccgctctagaactagtggatcccccgggctgcaggaattcgtctcacccctagaaaaaaagacagtagcgacgagtgagggtgacgaccgtgcgagttgtaggcctctatcgtcccctctccctttcgcgccatcaatcctgtgcctcctccgtcctcactgcaacaaatcgcgctcgtcccaaccagatcccccggggtcttgtccgctgccgtgatccgccgcaggtggcggaagccatgtccgacgcggacgcggccggcagcaaggaggcgccgagatgcgactactgcatgggcctgccggccgtggtgtactgccgggccgactccgcgaggctgtgcctgccgtgcgaccgccacgtgcacggcgccaacacggtgtccacccgccacgcccgggcgccgctctgcgccaggtgccgcgcagccgccgccacctcccgccgcggcggcggcagcggcgacttcgtctgcgccgactgctactgcttggagaaggagaaggaggaggaggagaagggggaggagcaccgggacccgcggccgctccaccacgaccatgacgcggtggaagagtacgccgggtgcccttcgatcgccgagctcgcggccatcctcggcgtcgccgggan

SEQ ID NO: 52427 - protein, 131 aa, Zea mays
  misc_feature: Ceres CLONE 1469257-F
  misc_feature (10)..(57): Pfam Name: zf-B_box Pfam Description: B-box zinc finger
MSDADAAGSKEAPRCDYCMGLPAVVYCRADSARLCLPCDRHVHGANTVSTRHARAPLCARCRAAAATSRRGGGSGDFVCADCYCLEKEKEEEEKGEEHRDPRPLHHDHDAVEEYAGCPSIAELAAILGVAG

SEQ ID NO: 52428 - DNA, 654 bp, Zea mays
  misc_feature: Ceres CLONE 1469258-F
ggagctccccgcggtggcggccgctctataactagtggatcccccgggctgcaggaattcgtctcacccctagaaaaatgaaaccactgcatgtgcttgattactttggtttgtaccgacagcttttggtgcctatttgtgatgagattgaacatcctgctgcttgtgtttaatcttctaggttcgtgttcttgctgtatgcgtggttaatggttgactaatgactagtacttctctgatgctgaggatgattgctattgattgtctagaatttaacatttccctgtggggaagtaatctcctatgttctgtcgaaagcagcaaactctggtaactgtattgctgcatatattttccgctcacaaaatatttgctaagtatgagaaccacacttattttgccttttcatccccccttgtggcacaatactatgtcccagttttgaacctctacagctaatagttagctggtaaacttacctatagaggttccaatcactcttagctaataactcaactaattgttaactaactcacagctaacaaattattcattagctgactcaacccacctaacattttggtacctgactaactattaaattttaggggttttcgacaatgactgtatcaatttgacttcctctggtgggcc

SEQ ID NO: 52429 - DNA, 1087 bp, Zea mays
  misc_feature: Ceres CLONE 1469258-R
  misc_feature (1087)..(1087): n is a, c, t, g, unknown, or other
aatgggtcctcgagcgtctcgtttttttttttttttttgagatatttaatactatttatataaagtttgaaatagaggatgaaataagggatataataggacatctattggagatggccttaatagctacccgcaaccaagaactcttccttgcggaacaaaggcaccttcataaagtccatctacaagctgctgcgggggcggcgcactgtggctgggtgcagtctcagcaacagcaaggtactgtggattaacagcccccgccgcccttcaaccccagccgtacacttgaagcaccactaaattaaaccttatttccctcgaaccacgcggcccccagagtaaaaacaggcaaaagtaggcttttatttttaatagaaaggggggggcagttacccccacaaaatattaatttcccaacctttttttccctcctccaggaaaccccgcttgcgagtggaatcccattgtatcaatggttctttgactcaaaaattcccccggtgggcttcatcatatttctcccgcggaacaggggcccttctcgttttcactcacccccttctcttggaaagaaaaatcgtgctagaaccacccctcccctccggcacctttggcccatatattttctcccgggtatttgcgcccgctgtggttttgtgcggtgacaatttgttagtgagatcccgttactgttatcgaaaatctttgttggttggagcgggaatttgtgtatagcacacccgtgccctaatttgacatcttcgccccctactcttggtcccgccacatatttcacccatctttatacaccgcccaccaccactctccaataacgcaccgccccctccactcaccccccctccccataaaatacccgtcggaccccatttctggtgattctccccccctgattccccctatatttcaggttagccgtattgccccacgccgagcggacatttttcccgcatacatgttccaaaactttgtcttattatacacgacttaccgaatccacaaagctggtaagtccatacacacagctcgcgtcctctccgtgcacatctttagaccactctctacn

SEQ ID NO: 52430 - DNA, 670 bp, Zea mays
  misc_feature: Ceres CLONE 1469263-F
  misc_feature: Encodes the peptide sequence at SEQ ID NO. 52431
  misc_feature (477)..(477): n is a, c, t, g, unknown, or other
  misc_feature (670)..(670): n is a, c, t, g, unknown, or other
tccccgcggtggcggccgctctagaactagtggatcccccgggctgcaggaattcgtctcacccctagaaaaaaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtgtcggccgactatgagggcaaaggagacacgacgaaactgggcgagctcggcgccaagctcaacgggctggcccccgccgacgccatcctcatggcgagctccatcctgcacatgctcaaactcgncaaccctggcccaaagaagtgcaaaaacgcgccacggccgtcggcaacaccaagctcaagaaaaggtgggttccgccggaccaaggctccccgccaccccccgagtcccgactctcgaggaaaaccctcaagcgccctccctggcccaaaggtccgcaaagtccccccgaggaaggggtttcaaggcgcttcn

SEQ ID NO: 52431 - protein, 173 aa, Zea mays
  misc_feature: Ceres CLONE 1469263-F
  misc_feature: SWISSPROT Homolog: EC 4.1.1.31 Phosphoenolpyruvate carboxylase
  misc_feature (109)..(109): Xaa is any aa, unknown, or other
MASTKAPGPGEKHHSIDAQLRQLVPGKVSEDDKLIEYDALLVDRFLNILQDLHGPSLREFVQECYEVSADYEGKGDTTKLGELGAKLNGLAPADAILMASSILHMLKLXNPGPKKCKNAPRPSATPSSRKGGFRRTKAPRHPPSPDSRGKPSSALPGPKVRKVPPRKGFQGAS

SEQ ID NO: 52432 - DNA, 671 bp, Zea mays
  misc_feature: Ceres CLONE 1469267-F
ggagctccccgcggtggcggccgctctagaactagtggatcccccgggctgcaggaattcgtctcaccccctaaaaaatttttaggataaggattcgagatattcaacaacaacaaaacctttttgtcccaacaagttgggctagtctagagttgaaacccaacagaaaccataagtcaaggttcaaccacatggatagttatttttcatggactcctattcaaggctaaatctttggttatatttcatttcttcaagtctttttttactgcctctttccatgtcaacttcggcctacccctgcctttattcccattgatattgtgccttataatttcactatgcacaagtgactctggaaatctctgttggacatgaccaaaccatctcaactgctttggacaagcttttcttcagttggtgctactacccctagcctatcacgtatgtcatcatttcagactcaattccttcttgtatgaccataaatccaacacaaacttgcgtatttccgcaatacttgtctcctgaacatgtcgtcttttaatatgccgacattccgcaccatatagaatagtaggtctaatcgccgtcctataacgattctacataaattgtacatgagtagtccaagtgttcacatgactcacataccacagttatttatgttt

SEQ ID NO: 52433 - DNA, 660 bp, Zea mays
  misc_feature: Ceres CLONE 1469268-F
  misc_feature: Encodes the peptide sequence at SEQ ID NO. 52434
cgcggtggcggccgctctagaactagtggatcccccgggctgcaggaattcgtctcacccctagaaaaaccccaagtcacagaacaagatcgtcgtgggcagcactcgccactcgctctcgcaggcggtgaggcggcgctatcagagcggacttcgccctccccccacccccacgtccccctacaggtagccctgcaaccatggccgcggcggccgggctcagccgccggtgcaccgtccgctgacaagtcgacctttctcctacgacagcaaccgtcttcgtccggtcctggctgtttaaaaagagaggaaaggcaggaggaggggaggatttagtgttaagccaatgggggctattggaggcgatgagtcggtgcagtgggataaagtggctggagctgatgctgttaatggcggcggagcaagtgtgggcagaatggacaggatacaggtgctggtcaggctgaggccactgagcgagaaagaggttgcgaggggagagcctgcaaaatgggagtgcatcaatgacaccactgtcatgttccggagcacgttccctgatcgacccaccgctccgacggcatacacatttgatcgggtttttcattctgactgtagtacgaaagaagtctacgaggaaggggttaggggagttgccct

SEQ ID NO: 52434 - protein, 104 aa, Zea mays
  misc_feature: Ceres CLONE 1469268-F
MGAIGGDESVQWDKVAGADAVNGGGASVGRMDRIQVLVRLRPLSEKEVARGEPAKWECINDTTVMFRSTFPDRPTAPTAYTFDRVFHSDCSTKEVYEEGVRGVA

SEQ ID NO: 52435 - DNA, 639 bp, Zea mays
  misc_feature: Ceres CLONE 1469273-F
  misc_feature: Encodes the peptide sequence at SEQ ID NO. 52436
ggagctccccgcggtggcggccgctctagaactagtggatcccccgggctgcaggaattcgtctcacccctagaaaaagcttgaactcatttgcaattgcgaacgcttcttctcccagtcccagcacgcccaaccccgtcgccgccttctcgaaccttccgaagatgagccccccggccccggccgccgcggcggcggcggcgccgcgaacggtcgcctcggcggtgctccgcgtccagatggcgctcctcgacggcgccgcggtgtccagcgaggccctcatccacgcggccgcctccgcgctcctctcccgcgccgactacgacgacgtcgtcaccgagcgcaccatctcggacgcctgcggcaaccccgcgtgccccaaccctctctcctcctcctccgccgccgccacggggccccgcttccacatcgccctcagcgagcaccgcgtctacgacctcgaggaggcgcgcaagttctgctccgagcgctgcctcgtcgcctccaaggccttggccgcctcgctcccgcacgaccggccctacggggtcccgctcgaccgcctcgccgcggtcgtcgcgctcgttgagggcgccgccgcaggggacgggagcggggtagggttccaggactggatgg

SEQ ID NO: 52436 - protein, 133 aa, Zea mays
  misc_feature: Ceres CLONE 1469273-F
MALLDGAAVSSEALIHAAASALLSRADYDDVVTERTISDACGNPACPNPLSSSSAAATGPRFHIALSEHRVYDLEEARKFCSERCLVASKALAASLPHDRPYGVPLDRLAAVVALVEGAAAGDGSGVGFQDWM

SEQ ID NO: 52437 - DNA, 650 bp, Zea mays
  misc_feature: Ceres CLONE 1469283-F
  misc_feature: Encodes the peptide sequence at SEQ ID NO. 52438
tccccgcggtggcggccgctctataactagtggatcccccgggctgcaggaattcgtctcacccctagaaaaaccaaaacccccacactcccccttcggcatctccgatatccgttcagcaatgaccatgaacgctgcgatcgcctcccgactcggcctcgccgtctccaggtgtggggctgggtcccgagtggacagccggccgctgacgccggcagtgggtttcacggcggggccgagggcgcgctcagtagccgtcaccgccgcctcctcttctccggcgaccggtggcgtgacgccggtgccaccccgctcgaatcgctcgatataaaaggagggatggaggaactccctgaagaacaagatacaacagatccaccacatacatgacgtaagggttatgaagcgtcacacgctatcagtttttgttggtgatgaaagtgggatgatcaatcgaattgctggggtttttgctagaagaggatataacatcgagtcattggctgttgggttgaacaaggataaagcattatttacaatagtagtgtcaggaacagacaaaatattaaaccaggtcgtagagcaactaaacaagcttgttaatgtcataaaggttgatgatttatcaatggaaccacaagttgaaagag

SEQ ID NO: 52438 - protein, 83 aa, Zea mays
  misc_feature: Ceres CLONE 1469283-F
  misc_feature (4)..(68): Pfam Name: ACT Pfam Description: ACT domain
  misc_feature: SWISSPROT Homolog: EC 2.2.1.6 Acetolactate synthase
MKRHTLSVFVGDESGMINRIAGVFARRGYNIESLAVGLNKDKALFTIVVSGTDKILNQVVEQLNKLVNVIKVDDLSMEPQVER

SEQ ID NO: 52439 - DNA, 775 bp, Zea mays
  misc_feature: Ceres CLONE 1469288-R
  misc_feature (714)..(714): n is a, c, t, g, unknown, or other
cgattgggtacctcgagcgtctcgtttttttttttttttttctttttttttttttttttacattaggttactcgattttgcacaaaataatgaagctggtactaagttcgggcaaggcggggggcaacacttgttggcgattttttattttgcagcttgttccagatatagaaaatccgcgaaagccttaagaagagcgtccaacgccatgtgctcaaatccctgggcttccatgaataccgggtgcacccccaccctctttgtttatgacttcctcgggccaaggctagttagggtcccacacacataaatatttgtaggttaatatttatatagttctcacggataaacttcttaggaggcacgagctccaaattccttcaggatcttgtattctctgaacccggctttggcgaagaatcgctccattctttttcatctctctgccgcccttttgtcccggtcatcatgccgatgtccatcaggaggtgagtttcccgcctaagcccccagtggtcaatcgtaatatcaccgtttataacttttccgccgcccttccgtggaggaatccccttccagggttgtgccaggatcttgtaacactcctcatcggtcaggtggccgcagctcaagctttaacacaacagtttgagcaggtggtatgcaactgaacgtgtgcaccttcgacatagttgaacttcgatccaatgggancggtttggggggaaccatcctcgggaggggccagcacagtgcattttaatagggtgggaag

SEQ ID NO: 52440 - DNA, 655 bp, Zea mays
  misc_feature: Ceres CLONE 1469371-F
  misc_feature: Encodes the peptide sequence at SEQ ID NO. 52441
  misc_feature (265)..(265): n is a, c, t, g, unknown, or other
  misc_feature (266)..(266): n is a, c, t, g, unknown, or other
  misc_feature (320)..(320): n is a, c, t, g, unknown, or other
  misc_feature (323)..(323): n is a, c, t, g, unknown, or other
  misc_feature (324)..(324): n is a, c, t, g, unknown, or other
aaagctggagctccccgcggtggcggccgctctagaactagtggatcccccgggctgcaggaattcgtctcacccctagaaaaaagccacgcgctcaactccacgggccttgagctagggttttcttcgccgctacctccctacgaggcgggcgtgcagccatggcgctggtgcaggcgggcatgggccttacccgggtcgttatcctcgtcggcgccggcgttgccggctccgtcgtcctccgcaacggccgcctcgccgaganntctcgcgagctcccagagatctcgacagggaaaaaggggaaaaaaggattgganaanngggaaaaacgggaaaaccgattttcaacgaaggctcttccctcccaagtggcttccccctttgcttggaagttccgggcaactggggaaatccccgttcaaaaaatgggtctcaaaggggaggtttttgccccatcccggaaaattacgggctgaaaattacccgcgccccatgtgggaaaccccggggttaccggtttatatgggttgaaaaggggaatcccgctttcccaaacaatggggtgttcccccccaccccaaaaggggaaaggggggtttttaacaaaggaaaaaaatttttggggggagggggagaatttctctttgcggga

SEQ ID NO: 52441 - protein, 105 aa, Zea mays
  misc_feature: Ceres CLONE 1469371-F
  misc_feature (35)..(35): Xaa is any aa, unknown, or other
  misc_feature (53)..(53): Xaa is any aa, unknown, or other
  misc_feature (54)..(54): Xaa is any aa, unknown, or other
  misc_feature (55)..(55): Xaa is any aa, unknown, or other
MALVQAGMGLTRVVILVGAGVAGSVVLRNGRLAEXSRELPEISTGKKGKKGLXXXEKRENRFSTKALPSQVASPFAWKFRATGEIPVQKMGLKGEVFAPSRKITG

SEQ ID NO: 52442 - DNA, 643 bp, Zea mays
  misc_feature: Ceres CLONE 1469372-F
  misc_feature (369)..(369): n is a, c, t, g, unknown, or other
  misc_feature (400)..(400): n is a, c, t, g, unknown, or other
  misc_feature (417)..(417): n is a, c, t, g, unknown, or other
  misc_feature (418)..(418): n is a, c, t, g, unknown, or other
  misc_feature (422)..(422): n is a, c, t, g, unknown, or other
  misc_feature (508)..(508): n is a, c, t, g, unknown, or other
aagctggagctccccgcggtggcggccgctctagaactagtggatcccccgggctgcaggaattcgtctcacccctagaaaaattccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagacaactgtgaaattggtgttttctccaagctgacaaatgcttactgtctggtagcgattggagggtcagaaaacttctacagtgcctttgaggctgagcttgcagatgccatccctgtggtncagacctctattggtggcactagaataatanggcccgactttgtgtgnnaacnagaatggacttctattgccacatactacacccgaccaagagcttcagcatctgaaggaatgcttgcctgatcaagtgggtgttcancggcatggatggaaagtttaactgccctttggcaattgcataacctgcaatgaacatgttgcccttaaccaccctgaccttgaaaagaaaaccggagaattccttgcaaaattgctggggggccaagggttttaa

SEQ ID NO: 52443 - DNA, 642 bp, Zea mays
  misc_feature: Ceres CLONE 1469390-F
  misc_feature: Encodes the peptide sequence at SEQ ID NO. 52444
  misc_feature (369)..(369): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (532)..(532): n is a, c, t, g, unknown, or other
  misc_feature (594)..(594): n is a, c, t, g, unknown, or other
gggagctccccgcggtggcggccgctctagaactagtggatcccccgggctgcaggaattcgtctcacccctagaaaaaagacggccacacttgtcagcaaagcgccggaaaccaaaccacgcaccgccgcctcggctagctaacacgtacactagcagtgatccccatggcaatgctgccgcgtccaacggcgctcgtcgcagcggtggtggtggcgtcggcgctggtgctcgggatggcgtcggcgcaggggccggccgccgcgcccgcgccgggcccggcgcccgggatcagcgacgagtgcttcaacgcggtgctgaacatgtcggactgcctgacgtacgtgaacggcggcagcaaggcgcggncaccggacacgccctgctgcccggagctggccgggctgctcgagtccccacccgtctgcctctgccagctgctggggcggccgcgccgaatcctaccgcgtcagcgtcgactaacagcgcgcgctcgcgcttcccggggatctggcgcnnntcacgcgcgccngttagcgcctgcgcagcttttcggatttcctatcccgaagggattggtgcctactggcgggncccatggcaggcctctctccatcttctatcgggcccagatgtgcctgc

SEQ ID NO: 52444 - protein, 158 aa, Zea mays
  misc_feature: Ceres CLONE 1469390-F
  misc_feature (68)..(68): Xaa is any aa, unknown, or other
  misc_feature (118)..(118): Xaa is any aa, unknown, or other
  misc_feature (122)..(122): Xaa is any aa, unknown, or other
  misc_feature (143)..(143): Xaa is any aa, unknown, or other
MAMLPRPTALVAAVVVASALVLGMASAQGPAAAPAPGPAPGISDECFNAVLNMSDCLTYVNGGSKARXPDTPCCPELAGLLESPPVCLCQLLGRPRRILPRQRRLTARARASRGSGAXHARXLAPAQLFGFPIPKGLVPTGGXHGRPLSIFYRAQMCL

SEQ ID NO: 52445 - DNA, 673 bp, Zea mays
  misc_feature: Ceres CLONE 1469392-F
  misc_feature: Encodes the peptide sequence at SEQ ID NO. 52446
aagctggagctccccgcggtggcggccgctctagaactagtggatcccccgggctgcaggaattcgtctcacccctagaaaaaaaaaaaaaattctcttggcacatgctactgcagttgcaagataccgtacgaaatatcaggctgctcagaagggtaaggtcggaatagtcctggacttcaactggtacgaggctcttacaaactcacctgatgaccaagcagcagcccaaagagccagggacttccacattggctggtttgttgatccattgataaacggacactatccacagataatgcaagatctcgtgaaggagaggctgcccaggttcactcctgagcaggctaaactggtgaagggctcggcagactacatcggtatcaacgagtacacatccagctacatgaaggggcagaagctggtccagctggcgcccagtagctactctgccgattggcaggttcaatatgtttttgcacgcaatggcaaaccgattggaccacaggcgaattctaagtggctctacatcgccccgacggggatgtacgggtgcgtgaactacctcaaggagaagtatgggaatccaacgatctacataacggagaacggaatggaccagcctggaaacttgacccgagaccagtacctgcgcgacgccaccgagggtgcc

SEQ ID NO: 52446 - protein, 125 aa, Zea mays
  misc_feature: Ceres CLONE 1469392-F
  misc_feature: SWISSPROT Homolog: EC 3.2.1.147 Thioglucosidase
MQDLVKERLPRFTPEQAKLVKGSADYIGINEYTSSYMKGQKLVQLAPSSYSADWQVQYVFARNGKPIGPQANSKWLYIAPTGMYGCVNYLKEKYGNPTIYITENGMDQPGNLTRDQYLRDATEGA

SEQ ID NO: 52447 - DNA, 649 bp, Zea mays
  misc_feature: Ceres CLONE 1469395-F
  misc_feature: Encodes the peptide sequence at SEQ ID NO. 52448
ctggagctccccgcggtggcggccgctctagaactagtggatcccccgggctgcaggaattcgtctcacccctagaaaaactgcgattctccatctctttccctgctgcgtttcgtcgttctcttccccttcttttcctcagccacttcgctccctccctagcagcaaaaacctccacgaatcgccgacactccaacccggaagagccaacgaggtgactccgcgccccggtcatgggtgacagccaatactccttctctcttaccactttcagcccgtcgggaaagcttgtgcagatagagcacgcgctcacggctgtcggatccgggcagacctccctagggatcaaagctgccaacggtgtagtgattgccaccgagaagaaactgccttctattttagtggatgaaacatctgtgcaaaagattcaggcactaacaccaaatattggagttgtctatagtgggatgggtccagattttcgtgttctggtgagaaaaagtcgaaagcaggcacagcagtattatcggttgtacaaggagcatatacctgtaacacagcttgtgcgggagactgctgctgtgatgcaggagttcacacagtcaggtggtgtaagaccatttggagtatcactgttgattgctgggta

SEQ ID NO: 52448 - protein, 138 aa, Zea mays
  misc_feature: Ceres CLONE 1469395-F
  misc_feature (29)..(138): Pfam Name: Proteasome Pfam Description: Proteasome A-type and B-type
  misc_feature: SWISSPROT Homolog: EC 3.4.25.1 Proteasome endopeptidase complex
MGDSQYSFSLTTFSPSGKLVQIEHALTAVGSGQTSLGIKAANGVVIATEKKLPSILVDETSVQKIQALTPNIGVVYSGMGPDFRVLVRKSRKQAQQYYRLYKEHIPVTQLVRETAAVMQEFTQSGGVRPFGVSLLIAG

SEQ ID NO: 52449 - DNA, 635 bp, Zea mays
  misc_feature: Ceres CLONE 1469397-F
  misc_feature: Translation starting site: 184
  misc_feature (362)..(362): n is a, c, t, g, unknown, or other
  misc_feature (457)..(457): n is a, c, t, g, unknown, or other
  misc_feature (473)..(473): n is a, c, t, g, unknown, or other
  misc_feature (492)..(492): n is a, c, t, g, unknown, or other
  misc_feature (533)..(533): n is a, c, t, g, unknown, or other
  misc_feature (562)..(562): n is a, c, t, g, unknown, or other
  misc_feature (601)..(601): n is a, c, t, g, unknown, or other
caagctggagctccccgcggtggcggccgccccagaactagtggaacccccgggctgcaggaattcgtcccacccctagaaaaatatccacacctgagtcccctccgccgcctgccgcactctcccgcgacgcccccaccacacgttcacggtagcgagagcttatcgtcctcggcggcgaagatggtgtccctgaagctgcagaagcggctcgccgcgagcgtcctccagtgtgggaaaggcaaagtctggcttgaccccaatgaagtcagcgagattctccatggctaactcccgccaaacatccggaagttggttaaggatgggtttatcatcaggaagcctcagaaagttcactctangtcccgtgcaagaagggcacatgaggccaagcagaaagggaagcactctggatatggcaagcgcaggggtaccagggaggctaggctccccaccnagattctgtggatgangaaggatgcgtgttctgangcgcctgctctggcagtaccgtgaggccaaagagatcgacnagcacatgtatcatgacatgtacatgaangtcaggggtaatatgtttaagaacagagggtgctttatngagagtatcccaccagtccaaggctgagaaggcc

SEQ ID NO: 52450 - DNA, 653 bp, Zea mays
  misc_feature: Ceres CLONE 1469402-F
  misc_feature: Encodes the peptide sequence at SEQ ID NO. 52451
ggagctccccgcggtggcggccgctctagaactagtggatcccccgggctgcaggaattcgtctcacccctagaaaaaaacacacctgtaaaagatagagctatcccctccctccccatcccttggaaccagcaactccactcctgagtcctcacctcgtgctgcccgcgccatttccacctcccactgtactttcgtccagtccccagccctgcagaccaaccgaggaggttctggaaggcggtgtatcccttctagaaccttctcgagatgcagagcgccgcggctttccggccgtgccccactcggatgctggtgagcagcccttgtcaccccctcctctcggcccgacccgcttcgtgtctccgccgctggcgccgactctaccagaagcatcgccatgtgccctcgcggtctggggctcgggctgctgccagcctcgcccgatcgggatggcaagtgccgccagcgacaggtgtcatgcatcgcggacggtgatactgtggaggccccgacagcgtaaaaagaggcggactcatgaagacgctgtggctcggatcgctctaccgcctctaggtactgtcaacatctacttcacatctatcataagcagttactcaccgttttcccataccctatgaacatcactgaat

SEQ ID NO: 52451 - protein, 40 aa, Zea mays
  misc_feature: Ceres CLONE 1469402-F
MCPRGLGLGLLPASPDRDGKCRQRQVSCIADGDTVEAPTA

SEQ ID NO: 52452 - DNA, 658 bp, Zea mays
  misc_feature: Ceres CLONE 1469403-F
  misc_feature: Encodes the peptide sequence at SEQ ID NO. 52453
  misc_feature (540)..(540): n is a, c, t, g, unknown, or other
aaagctggagctccccgcggtggcggccgctctagaactagtggatcccccgggctgcaggaattcgtctcacccctagaaaaactccccagtcaatccccacacagtctcggccgggccctcgcgaggccgccgtggaaggacccccagcgatgggctccggcgaggaggacacaggaggcggaggaggggcggtgcggggcgcggtgctgaaggcgctcgtggttgtcggcggcgtcctgctgctccgccgcctgcgccgctccactacccgatgggaccacgcgcgagccgtcgccgacgcgctctccggagaaaagttctcgagggagcaggcgaggaaggatcctgacaacttcttcaatttgagaatgctcacatgtcctgcaaccgagatggtggatggttcaagggtgctttactttgagcaggcatttttggagatctccagaatagccttttagacaaagattctacatggtaaagccctgtccgaaggagaggaaatgcgatgtttgagttgagttcatatgcaattangggttgcctgagagtacaagatttttctgtgaccgcgtccaaaggatcaaaggcccagggcgaaaaagtccttgcagatatcgcagagcatctgaccaccctacacttgtcacgatgc

SEQ ID NO: 52453 - protein, 103 aa, Zea mays
  misc_feature: Ceres CLONE 1469403-F
MGSGEEDTGGGGGAVRGAVLKALVVVGGVLLLRRLRRSTTRWDHARAVADALSGEKFSREQARKDPDNFFNLRMLTCPATEMVDGSRVLYFEQAFLEISRIAF

SEQ ID NO: 52454 - DNA, 671 bp, Zea mays
  misc_feature: Ceres CLONE 1469405-F
  misc_feature: Encodes the peptide sequence at SEQ ID NO. 52455
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (389)..(389): n is a, c, t, g, unknown, or other
  misc_feature (398)..(398): n is a, c, t, g, unknown, or other
nnnnnnnnnnnnnnnnnnnnnnnnnnnnnnnnnnnnnnnnnnnnnnnnnnnnnnnnnnnnngggggggnnnnnnnnnngggggnnnnnnnnnnnnnnnnnnnnnnnaaaattgggactccccgcggtggcggccgctctagaatagtggatcccccgggctgcaggaattcgtctcacccctagaaaaagtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccacccagcacgagtcgctggagaaatgcttcgccctcctacgcgagatcctcgactccnaggtcatcnacgaccgggagacggggaggtcctcgcggcttcggcttcgttacctctcctccgaagactccatgctcgacgctttcgaaaaaatgaacgggagggactccgacggcgtaaaattcccgttaaacaagcgccaatccccgtgctgttgccctgggcccccgttgcttaaaggggggggttcccgggggggggggggttttgggggggggggcccctgaaacccggtttttggcggcgggggggggggttaacaggggcccgggccccaggggg

SEQ ID NO: 52455 - protein, 112 aa, Zea mays
  misc_feature: Ceres CLONE 1469405-F
  misc_feature (38)..(38): Xaa is any aa, unknown, or other
  misc_feature (41)..(41): Xaa is any aa, unknown, or other
MAAADVEYRCFVGGLAWATQHESLEKCFALLREILDSXVIXDRETGRSSRLRLRYLSSEDSMLDAFEKMNGRDSDGVKFPLNKRQSPCCCPGPPLLKGGGSRGGGGFGGGGP

SEQ ID NO: 52456 - DNA, 618 bp, Zea mays
  misc_feature: Ceres CLONE 1469412-F
  misc_feature: Encodes the peptide sequence at SEQ ID NO. 52457
  misc_feature (501)..(501): n is a, c, t, g, unknown, or other
  misc_feature (502)..(502): n is a, c, t, g, unknown, or other
  misc_feature (517)..(517): n is a, c, t, g, unknown, or other
acccgcggtggcggccgctctagaactagtggatcccccgggctgcaggaattcgtctcacccctagaaaaaatccgccttcgcctccaaccgcgtgcgctccacgcctcctccaggaaagcgagagcttctgcataagaacaacaaatcaaaagcttgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaggagttcagctataacaagatcctcaaggatctgaagaaggaattctgctgcaatggtactgtagttcaggacccagagctaggccaggtcattcagctccaaggtgatcagcgcaagaatgttgctactttcctagttcanngctgggattgcgaanaaagagaacatccagattcccgggttctaaaggaacccggaaaaggctttggccccaaatatgggggggcccccccaatttgggggagtcttgaaaacccc

SEQ ID NO: 52457 - protein, 140 aa, Zea mays
  misc_feature: Ceres CLONE 1469412-F
  misc_feature (27)..(108): Pfam Name: SUI1 Pfam Description: Translation initiation factor SUI1
  misc_feature (101)..(101): Xaa is any aa, unknown, or other
  misc_feature (102)..(102): Xaa is any aa, unknown, or other
  misc_feature (107)..(107): Xaa is any aa, unknown, or other
MSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVXXWDCEXREHPDSRVLKEPGKGFGPKYGGAPPIWGSLENP

SEQ ID NO: 52458 - DNA, 742 bp, Zea mays
  misc_feature: Ceres CLONE 1469415-F
  misc_feature: Encodes the peptide sequence at SEQ ID NO. 52459
  misc_feature (347)..(347): n is a, c, t, g, unknown, or other
  misc_feature (421)..(421): n is a, c, t, g, unknown, or other
  misc_feature (705)..(705): n is a, c, t, g, unknown, or other
tggagctccccgcggtggcggccgctctagaactagtggatcccccgggctgcaggaattcgtctcacccctagaaaaaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaagtgccgagcggcgtcgacgccaccagatctcgcaggangagtacctcaacgccgcaggggagaactactccgtcccccttcccgtgcccgaaacctaacggttcctaatggnaaccccattaaagaaaccggaaatgggcccgaaaaatcccgccccaaccaattaaacccggctttccgacccaaaccccttccgtggttaaaccgggtggtctcccgggttttgacccccccaaaataggccccccctccaaaggtttccccccccccaacaaaaaaaaaaaaaaaaaaaaaaaacccgcggaggaccccctctccccccatatagggagaatattacgcccccccccggggggccttttttaaacccgggggaggagaaaaaaccggggggtnccactatttttgtggggggagacacccccctttctcc

SEQ ID NO: 52459 - protein, 93 aa, Zea mays
  misc_feature: Ceres CLONE 1469415-F
  misc_feature (14)..(93): Pfam Name: Copper-bind Pfam Description: Copper binding proteins, plastocyanin/azurin family
  misc_feature (71)..(71): Xaa is any aa, unknown, or other
MAASALLAGGAMAQEVLLGAGDGGLVFEPSQFTVKAGDTITFKNNAGFPHNVVFDEDEVPSGVDATRSRRXSTSTPQGRTTPSPFPCPKPNGS

SEQ ID NO: 52460 - DNA, 643 bp, Zea mays
  misc_feature: Ceres CLONE 1469419-F
  misc_feature: Encodes the peptide sequence at SEQ ID NO. 52461
  misc_feature (643)..(643): n is a, c, t, g, unknown, or other
ctccccgcggtggcggccgctctagaactagtggatcccccgggctgcaggaattcgtctcacccctagaaaaactcgctccaaaccaaagccatcggaggagcaactggacgaccatggcctcgccgctgctcaagtcacactctcagctcgccgccgccgccgccctgcactccgtgaggagagccgaccgctgccctgcgacactacacctgggcaagttccatgaccacgggctcaggtccggccgttctaaggcgttgcagagatccggttcagcgagggtgggcgccttcccgtcgctggacgtggtgccgctgatggtgacgatggtggagcacgtggacatgtcgcgggactacgtcgtgaccaagtccatctggcatctcagcgacgtagccctcaagagcgtctataccttctacgccatgttcaccgtctggggagtctgcttcttcgcgtccatgaaggatcccttctacgacagcgagacgtacaggagccagggtggcgacgggaccgtgcactggtactacgacaggcaagaggacctggaggcgtctgcgagggaggagctgctgcgggaggagctgctcgaggagattgagcagagggttgggggcctcagggagctggaggaagn

SEQ ID NO: 52461 - protein, 175 aa, Zea mays
  misc_feature: Ceres CLONE 1469419-F
MASPLLKSHSQLAAAAALHSVRRADRCPATLHLGKFHDHGLRSGRSKALQRSGSARVGAFPSLDVVPLMVTMVEHVDMSRDYVVTKSIWHLSDVALKSVYTFYAMFTVWGVCFFASMKDPFYDSETYRSQGGDGTVHWYYDRQEDLEASAREELLREELLEEIEQRVGGLRELEE

SEQ ID NO: 52462 - DNA, 976 bp, Zea mays
  misc_feature: Ceres CLONE 1469424-R
gctttaataaaaaaccgctcgtgcgcgacacaaccccatcgccttcacaggataaaatagaaccccggaagcgacctggataggtaatggccggtgcacttgaccggatcttatttagacactcctattatatttatacgcctcgtcgtcgtcgttctctcgactctagtgcgccatcgccgggccgggcgggccggctcagttgcacctgcaacatgagcagcctcagctggtgccgcagttgcaggtgttgcagttgcagtcgccgccttcggtggccgcctcaaagccaccggcgctggccttggtggtcggcgcaacgaggaccatggtcttgatgctgctggcggcggcggtctccacgtcaggggacatgcagttgcataaactccccccaggagcagctggagccccagtttcacttcccgctgctgcaagacatggatcaccgacaaaggggaacacggccctagctttgctttggaggaggcaagaggaggaaatacgtttgcgatcttattttgcccggctaggtatttcgacaggggtttatattgtaagcgtgtgtgcgagcctgcccacctttattaacggccagcattattatattcggtcacttatccgcaacgggatataaattaccggttggcagtatcttattacaaacaggggcttgtacgtaatttgaaaccacccgactcacacaatcaagtttctagacaattgaatagaagcggcgcattaatcttaagatataagtaggtggactccgtaggtagggttgtggcgcactatatattgtacgcaactcctggtctctgatgaaggagcgggttccgcaaggagattaaactgtttagattatgtcccgcagattgatatagttgtcctactatctattggtcggactgtaatacctgtgagatgaaaattatagtataacagcgagagagtgggcatgtatattaatagtatg

SEQ ID NO: 52463 - DNA, 689 bp, Zea mays
  misc_feature: Ceres CLONE 1469424-F
  misc_feature: Encodes the peptide sequence at SEQ ID NO. 52464
tggagctccccgcggtggcggccgctctagaactagtggatcccccgggctgcaggaattcgtctcacccctagaaaaaatctcaggcaacaaagcaccacacctcttcctcctcttcctactcctagcatagctagcgcctgctccccttctgctgcgatcatgccttgaatcaccatcaatggcaactgccgatacatctgctcctgcaggagattcttgctgctgcctgtcccctagaatggaaaccagccgacctaccagcatcatcattaccatggacctcgctgctcacaccacctaaggctcgccacgatgattcaaggatgacacggagggccgcgacagacgactgctaaacctgacactgctatacctactaccgctgctcctgctatatctgtgactgagccgacccgccccgccctgtcatggccctatagattgtattatgaccacgacgacaacgagtatacttattatatgaccatctacattagatcctgtcgactgcgcccgccattaacgatcactggaccctcatgcggatcatgtccctctgcgtaacatgctcacgtgcacgatacgtgcagtactttaaatctatctatatgcatggatttgagtgaatttccagttccttgacgagtcaatagatatcttcaccatttacaataaatatattacta

SEQ ID NO: 52464 - protein, 40 aa, Zea mays
  misc_feature: Ceres CLONE 1469424-F
MATADTSAPAGDSCCCLSPRMETSRPTSIIITMDLAAHTT

SEQ ID NO: 52465 - DNA, 701 bp, Zea mays
  misc_feature: Ceres CLONE 1469425-F
  misc_feature: Encodes the peptide sequence at SEQ ID NO. 52466
  misc_feature (348)..(348): n is a, c, t, g, unknown, or other
ctccccgcggtggcggccgctctagaactagtggatcccccgggctgcaggaattcgtctcacccctagaaaaacactcgccctcccacacagaaaaccctagccgccgccaccgaagcggcctcccaggtaagcaggagcgtccaccccgccgccgtcatgaagcgcaatccccgcgtcacgagctcccgacggaagtgccgcaaggcgcactttacagccccgtcctccgtccgccgcgttctcatgtccgccgggctgtcgacggagctccgccacaagtacaacgtgcgctccatcacgatccgcaaggacgacgacgtgcacgtcgtgcgcggctactacganggacacgacgcgaaggtggtgcatgtctaccgccgacgctggggcatccacgtccagcggaatacccgtcagaaaggagacgcgtccaacgttaacgtgggcatcaaccctccaaggtgatcgtcagttaattgaaacctgaaaaaggaccgaaagggggtccttggacctaaaggcccgggggcccggaccccgaataggggtaaggggaaatttactggacaaaaaaggtccctccccccccccctgggagagaacaccagggggcgccctttccaaagaaaataaaaaaaggccccccacgggaggggggagtggttgccgaaaacccctttttccccccgcccttaaat

SEQ ID NO: 52466 - protein, 102 aa, Zea mays
  misc_feature: Ceres CLONE 1469425-F
  misc_feature (63)..(63): Xaa is any aa, unknown, or other
MKRNPRVTSSRRKCRKAHFTAPSSVRRVLMSAGLSTELRHKYNVRSITIRKDDDVHVVRGYYXGHDAKVVHVYRRRWGIHVQRNTRQKGDASNVNVGINPPR

SEQ ID NO: 52467 - DNA, 666 bp, Zea mays
  misc_feature: Ceres CLONE 1469426-F
  misc_feature: Encodes the peptide sequence at SEQ ID NO. 52468
aaactggagctccccgcggtggcggccgctctagaactagtggatcccccgggctgcaggaattcgtctcacccctagaaaaaacgagcacgagactgctcggccgacgaaataataaagcgcgcgcgcgcacgcggagaggctcggagagctgagtgagatggcacaagccatggcgtccatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgctgccgccggcggaggcggtggcgagggtgaagacgtcggcgcaggacatcatcaacctcaagccactcatcgacaagaaggcgtggccgtacgtccagaacgacctccgcctccgggcctcctacctgcgctacgacctcaagaccgtcatcgcttccaagcccaaggaggagaagca

SEQ ID NO: 52468 - protein, 164 aa, Zea mays
  misc_feature: Ceres CLONE 1469426-F
  misc_feature (9)..(164): Pfam Name: PsbQ Pfam Description: Oxygen evolving enhancer protein 3 (PsbQ)
MASMTGLSQGVLPSRRAANRARTAAVVRASAEAQAQAQAGRRAVLGLVATGIVGGALSQAVHAETVKTIKIGAPPPPSGGLPGTLNSDQARDFDLPLKERFYLQPLPPAEAVARVKTSAQDIINLKPLIDKKAWPYVQNDLRLRASYLRYDLKTVIASKPKEEK

SEQ ID NO: 52469 - DNA, 658 bp, Zea mays
  misc_feature: Ceres CLONE 1469430-F
  misc_feature: Encodes the peptide sequence at SEQ ID NO. 52470
aagctggagctccccgcggtggcggccgctctagaactagtggatcccccgggctgcaggaattcgtctcacccctagaaaaaaccgtacctcctccgaatccaccgaccgccggcgagcccctcctcctccacgacacgcgcttccccggctatcatggattcagatccatcatcacagaacccaacaaatatgactgcatttgtccataacctccttggacagatgcaaacaaggttcgagtccatgtcgcacaacattgtgtcaaagatagatgaaatgggaaccaagattgatgagctcgagcagagcatcaacgatctcaaagctgatatgggcactgagacgcccgtcaagaagcctgatgagccaaagcactgctgactctgcctaacttgagcgtaacccacagattgttgtgtgaagaattgatgatggtgtgacaaatttcaccagtacgtgatcgtatctgttttcatgagtcctggcagatatgtacacacgaacccatcgtatgcaagatgaatccatgtttgagctctccacacatcaacgcatgttcttagcttttctgtcatctttcggcaactatttgtttgactgttataacatgttatgcaacatctactccatttgaagtaattgccttgtgtagagc

SEQ ID NO: 52470 - protein, 75 aa, Zea mays
  misc_feature: Ceres CLONE 1469430-F
  misc_feature (10)..(63): Pfam Name: HSBP1 Pfam Description: Heat shock factor binding protein 1
MDSDPSSQNPTNMTAFVHNLLGQMQTRFESMSHNIVSKIDEMGTKIDELEQSINDLKADMGTETPVKKPDEPKHC

SEQ ID NO: 52471 - DNA, 664 bp, Zea mays
  misc_feature: Ceres CLONE 1469431-F
  misc_feature: Encodes the peptide sequence at SEQ ID NO. 52472
aagctggagctccccgcggtggcggccgctctagaactagtggatcccccgggctgcaggaattcgtctcacccctagaaaaaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaggcgacggcggggctgaagctggaggcgcgcgactccggcctgcagacggttgaccccgccggttcacccctccccaacccctggcctggggggcctccggccattcctcggggtcgggttcggggtcgggttcaaaaaaccggggccctgaacaaatatcggggaaatccccaggcccccttgttaaaataaaaccaaacccccaattcccccccggccggagggcccccagggggaacttttaacgggggggcggcca

SEQ ID NO: 52472 - protein, 82 aa, Zea mays
  misc_feature: Ceres CLONE 1469431-F
MASQLSAAVPRFHGLRGYAAPRSAVAALPSVRVGRKRSSSQGIRCDYIGSATNLIMVTTTTLMLFAGRFGLAPSANRRRRRG

SEQ ID NO: 52473 - DNA, 659 bp, Zea mays
  misc_feature: Ceres CLONE 1469443-F
  misc_feature: Encodes the peptide sequence at SEQ ID NO. 52474
tggagctccccgcggtggcggccgctctagaactagtggatcccccgggctgcaggaattcgtctcacccctagaaaaaagcagcgttcagagtttggaaaattcagacttgagctagaaccagaggaacaccaaacacgcacgcgcccaccccccgaaacggagagaactgaccccgcagagaagatggccggcgagatgagctgggtgggcaagaagatccacctctacaacgtcaccatgggcctctacatgctcgattggtgggagcggtgcctattcacttcgcttccgacgtcttcgaaagccacctgaaggcgcggattttccaaggctcaaattacggcctggcaattggcacgccctcctcataggccttcagcgcaacacacagaagcagcgaaatctgctggttctggaatgttaactagttcccacaaactttagcgctgtcgtgatgtgtatgatgtggttccaatatgtaagattttttttacagttattctctttattttcttgttttgtgtttgattacacgatatcacaccctgaactctactgtaattaaaaaccattttcttggtatctcgtactgtaagtagccaaaaaaaaaaaaaaaacgagacgctcgaggtacccaattcgccctatagtgagtc

SEQ ID NO: 52474 - protein, 42 aa, Zea mays
  misc_feature: Ceres CLONE 1469443-F
MAGEMSWVGKKIHLYNVTMGLYMLDWWERCLFTSLPTSSKAT

SEQ ID NO: 52475 - DNA, 657 bp, Zea mays
  misc_feature: Ceres CLONE 1469451-F
  misc_feature: Encodes the peptide sequence at SEQ ID NO. 52476
acccgcggtggcggccgctctagaactagtggatcccccgggctgcaggaattcgtctcacccctagaaaaaaccagagtcatcgcggcgtgatataatcccacaatcttcttgtagcacaccactgctcttcatccaactcggcggctatgtctgggcgcggcaagggcggcaaggggctgggcaagggtggtgcgaaacgccaccgtaaggttctccgcgacaacatccagggtatcacgaatccggcaatccggacgctggcgaggaggggcggcgtgaaacgtatctccggacttatctacgaagagacccgcggcgtgctcaagatcttcctcgagaatgtcatccgcgacgcggtcacctacaccgagcacgctcgccgcaagaccgtcaccgccatggatgttgtgtacgccctctagcgccagggccgcactctgtacgggttcggtggttgagcgcatctcttccctcgtctgcagcggctgccggtggcgtttcctcagttccctctgccttgcttggcttgatgtagagagttatcacattataatatctctgatgtgcttcattcatgagtggaatcatgtgtccctgccgtgctgggaaatcgagatcaagatgtatctttctttgcagtaatgaaatgttaaa

SEQ ID NO: 52476 - protein, 91 aa, Zea mays
  misc_feature: Ceres CLONE 1469451-F
  misc_feature (25)..(92): Pfam Name: Histone Pfam Description: Core histone H2A/H2B/H3/H4
MSGRGKGGKGLGKGGAKRHRKVLRDNIQGITNPAIRTLARRGGVKRISGLIYEETRGVLKIFLENVIRDAVTYTEHARRKTVTAMDVVYAL

SEQ ID NO: 52477 - DNA, 653 bp, Zea mays
  misc_feature: Ceres CLONE 1469456-F
  misc_feature: Encodes the peptide sequence at SEQ ID NO. 52478
ccccgcggtggcggccgctctagaactagtggatcccccgggctgcaggaattcgtctcacccctagaaaaaaaaccgataaatcgccgtcgaactactccggacgggaagcacctgcgatcccctcgcccccacggaccctcggcgccggggaagcgccgctcgctcaggaggacagccatggcgccggagccggaggatgatattatgaatgagagcaatcccccgcccgctcaacgaggacgacatcgcgctcctcaaaacctatgggcttgggccgtactcgactagcattaagacggtccagaaggagatcaaggaaatggccatgaaaatcactgacctttgtggtataaaggagtctgatacatgggtggctccacctacccatggggatttggtttctgatacacgcatgatgcaagagtaccaaccgttacaagtggtgaggagtacaccgatcatacgccctactacggatgatgccaaatatgttataactgtaacacaaatcgcaaaatttgttgctggactggagcgataagtgtctccaactgacatcgtagaaaggatgaggctcggtgttgatggcatcaagtaccacattcaaatcccctcttccaccaaagatgagccaagtgttaccatgatgg

SEQ ID NO: 52478 - protein, 110 aa, Zea mays
  misc_feature: Ceres CLONE 1469456-F
MRAIPRPLNEDDIALLKTYGLGPYSTSIKTVQKEIKEMAMKITDLCGIKESDTWVAPPTHGDLVSDTRMMQEYQPLQVVRSTPIIRPTTDDAKYVITVTQIAKFVAGLER

SEQ ID NO: 52479 - DNA, 666 bp, Zea mays
  misc_feature: Ceres CLONE 1469457-F
  misc_feature: Encodes the peptide sequence at SEQ ID NO. 52480
  misc_feature (613)..(613): n is a, c, t, g, unknown, or other
ggagctccccgcggtggcggccgctctagaactagtggatcccccgggctgcaggaattcgtctcacccctagaaaaaattggatctcgctgtgttcccgttcaatcactcgcatttctctactaatcgtcacctcttggagaaattaatctttaaaggcgcttaatcatgaagtgttttgagttaaaccttcacggaacagagggaagctagagagcctcctcggattctctacgtgctgccgcgcgagaggggagagagtttccctttttccaatcaccctctcactggagtgcggcagcagtccagtctccattcccccagttcgtgctccctcccatagtcgtcggccgccgccgccgccgctgttcgtcctctcgctccttctccgcggcgacctagcgagagttcgtgcgcgtgtttggtaagggaggaggaagaaatggctcttctataaggacaaaaatcagcttttcttgagagcttctgagaagtgtccctggcttacagcttagtcagatccttgggcacaaggatatgtggtcaaaagaactacatggcgtgtttaccctttctatgctcatggttttcaatgtttcaggggcattttgtngtatcactattggcaatgacatgtcgaacataccaccagccacagatatagtg

SEQ ID NO: 52480 - protein, 43 aa, Zea mays
  misc_feature: Ceres CLONE 1469457-F
  misc_feature (26)..(26): Xaa is any aa, unknown, or other
MWSKELHGVFTLSMLMVFNVSGAFCXITIGNDMSNIPPATDIV

SEQ ID NO: 52481 - DNA, 668 bp, Zea mays
  misc_feature: Ceres CLONE 1469458-F
  misc_feature: Encodes the peptide sequence at SEQ ID NO. 52482
  misc_feature (391)..(391): n is a, c, t, g, unknown, or other
  misc_feature (668)..(668): n is a, c, t, g, unknown, or other
tggagctccccgcggtggcggccgctctagaactagtggatcccccgggctgcaggaattcgtctcacccctagaaaaaagcagccagcagcggacgcgcggacaagggcagcggcatggcggagacggcgatcacgacggtgctggccaaagtggcggagctggtggcgtgggaggcggctgtgctgctggaggtgggcgacgacgtgcgcctcctccgggacaagctcgagtggctccacaccttcatccgcgacgccgaccgccgccgccgccgccgcgacgacgagttcgtcgccgtctgggtgcgccagacccgcgacgtcgccttcgagggccgagacgcgctggacgacttcctacaccgcgctgggcggaggaaggccgcgcntggctccgggtgcgcgctcgggtgcctgtggccccgcggtgcgccggcccagtcgcgctcgccacgacctctcggggcgtatccgccagatcagggagcggctccataagatctccgagaaccccgccgactacaacatcgagcacacgcccgcgcccgccctgggcccgcttgttcctcctccgccaccaccttgggtggcctgggacgatctatgaggagtaccccggtcggccctggacaagtacccgcgacctgcttaaaggggccacctccn

SEQ ID NO: 52482 - protein, 127 aa, Zea mays
  misc_feature: Ceres CLONE 1469458-F
  misc_feature (92)..(92): Xaa is any aa, unknown, or other
MAETAITTVLAKVAELVAWEAAVLLEVGDDVRLLRDKLEWLHTFIRDADRRRRRRDDEFVAVWVRQTRDVAFEGRDALDDFLHRAGRRKAAXGSGCALGCLWPRGAPAQSRSPRPLGAYPPDQGAAP

SEQ ID NO: 52483 - DNA, 693 bp, Zea mays
  misc_feature: Ceres CLONE 1469459-F
ggagctccccgcggtggcggccgctctagaactagtggatcccccgggctgcaggaattcgtctcacccctagaaaaaattcgtttgcccatcctcgtgacggctcctcgcgagacgcctcgtctctccctgccgggtcgcctccagttccgcctccgccgcgtctcccgcctccgccgcgcctgactagcgcagtctaggactgtgcaggtagagaggagtatggtctggctgagatggggatgcgagatcagaagcggaaccagaagcgagtgctcgcgcgttgtaccgcggcaccgcgcccaggcgagggctaggatttcctgccgctggaaggaggccctggtattaagcatttgaaggtgcagcttcctgaagagggcggaaaacctgcctcaatcgtctatattgggcccccccccaatggtttctcccaggaccagatgaaagggtcctttaagttagttggggaattacggaggcattggatccccctgacccggaggacggggaattcccagcaccatgggatccgtggagtatggagatcccttgcttttgtccaattgtccgtacccccatgaagatggattaacctctttcctgggattaaattgggccttggccaactttgacctctggctctagtccagcccccaattgtcccccccaacaactaatgtgttttggggg

SEQ ID NO: 52484 - DNA, 2068 bp, Zea mays
  misc_feature: Ceres CLONE 1469467
  misc_feature: Encodes the peptide sequence at SEQ ID NO. 52485
gagacggagcgacggacgacgacgacgcgaccttatctggtgtcggtcgaccagcagccgtccgcggctccgcccgacgcgatgtccccaaccggcagccgagcgcggattgccgaagcaccacactctcctcgctgattcgtgcggccgccctccgaagctccgcccgacgcgacgccaccactgcttcacgacggcaggtggcggagctcgttgcgcgccgcgcgcgtgcagacgtcggcgaacggggctcccgggacgtccgcgctggccagtcgtgtctggtctatggaagaaatagccgagcgaccagatattagatatccatctattttcctctagtcccctattgaccatgatattcttatgtctcgtttttttgaaaagagatggtgcaatgtgacgaggtgccctccgggttatttcaaggatgaaggcattgataaaattttggtgccaagaatgaagaaaatgccagtaaagatgtttagatccatcagacataccaaggattttgatatgtctctcaactatgacaaagcttatgaactgcctccaggcattccatcacacaagtttgcagagtattctgtatcgggactgacagatgccagtgaaaagtatgcacaccgtaatttatctgcacccatcaaagcaaatctacatttttctttgagcagaagtggaattatcgctcttgatagagcagaagcagtaattgagataactgaatgggttgaagttccaaagaagatattgactccagagagtaacatcaccaatcagaattcatcttctaaagtaggagtagctaatagcacgacagatattaaggaaaatttgagttctggcagtgataataattccagcactcccattaatgggagtaatgttcaagaaattattacagagaaggtgctaaagaaaagaacatttagggttccattgaaggttgtggaaaaaacaactggtggtggaacaattctttcaaaggagttgtattctgaagcaaaaaataggttagaggcactcgataagaaggatgctgagcggaggaaaactgccgaacttaagaataacctagagtcatacgtatattctatgaaggagaagttggaagaaagcacagatattttgactgtctcaactgaacaggagagggaatcctttgcggagaaacttagcaaggtgcaggattggttgtacatggacggtgaagatgctcaagctaatgaattcaaagaacgccttggtcaacttaaggccattggtgaaccgattcttttcagattgagtgaattaaaagcccgaccagctgcctgtgaaaatgctcgattgtatcttgatgagctgcaaaagattgtgaacaagtgggagacaaataaacaatggctccccaaaaagagagtagatgaggttgtgagtcaagcagagaaagtgaaagcttggctggaggagaaggaaaacctgcagaaaaatacccctgtctatagctcaccagttttcacatctgaacaagtttatgagaaagttctggacttacaagataaggtctcaagtgtcaacagaattccaaaaccaaaacccaaggccgagaagaaaatagcagaggaagagcctgctagcaaggggaaaaccacatcttcggaatctgcacccaacgagggtgagtacaccgaaacgtctcaggaacctaaggctcgagaaggggatcattcagcatcagccaacagtagtgatttagatcctgaatctcacgacgagttgtgagtagcagaatccatagaaacaggtaggaaagattacgcatatatagtacacaagaaggcagtttgaggataaattttggttgctcaaatttccccaatttttatttgacgaccaaaagatgaggctatgtagtagggtgccgaggaatactagatgctgtagggccgaaatgattttatcggtagtttctgattgctcattgctgtaaggcagctttatattggtgtaagttactcgcctcaaaggcgttattcaggatctagaaacgctttgttgtgctgaaaaaaaaaaaaaaaaa

SEQ ID NO: 52485 - protein, 467 aa, Zea mays
  misc_feature: Ceres CLONE 1469467
MSRFFEKRWCNVTRCPPGYFKDEGIDKILVPRMKKMPVKMFRSIRHTKDFDMSLNYDKAYELPPGIPSHKFAEYSVSGLTDASEKYAHRNLSAPIKANLHFSLSRSGIIALDRAEAVIEITEWVEVPKKILTPESNITNQNSSSKVGVANSTTDIKENLSSGSDNNSSTPINGSNVQEIITEKVLKKRTFRVPLKVVEKTTGGGTILSKELYSEAKNRLEALDKKDAERRKTAELKNNLESYVYSMKEKLEESTDILTVSTEQERESFAEKLSKVQDWLYMDGEDAQANEFKERLGQLKAIGEPILFRLSELKARPAACENARLYLDELQKIVNKWETNKQWLPKKRVDEVVSQAEKVKAWLEEKENLQKNTPVYSSPVFTSEQVYEKVLDLQDKVSSVNRIPKPKPKAEKKIAEEEPASKGKTTSSESAPNEGEYTETSQEPKAREGDHSASANSSDLDPESHDEL

SEQ ID NO: 52486 - DNA, 655 bp, Zea mays
  misc_feature: Ceres CLONE 1469473-F
  misc_feature: Encodes the peptide sequence at SEQ ID NO. 52487
tccccgcggtggcggccgctctagaactagtggatcccccgggctgcaggaattcgtctcacccctagaaaaagcctctagctcagccggccggcctctccgattcctcttcctccgtgcctcccactcagccggccggccagacccacccactgcctggtgatcgtcgtgctcgtggtggcgggtccggcgagcgagcgcggcgcccatggcgagcgacggcgaccacggcggcgcgctgcagaagccgctgctgccgaaggcggccaggggcgggggctggttccggaaaggtacgagcacggcgcacccgtccggcctcagcgccgccgctgccggcacctcgtccaaggccgccgcgctgcggccgacccaccacgtgcccgcgctgctctgcacgctggtcgtcgcgctcggccccatccagttcggcttcaccaccgggtactcctcgccagcgcaggacggcgtcacccgggaccttaacctctccatctccgagttctcggcgttcggctcactgtccaacgtgggcgccatggtcggggcgatcgccagcggccagatggccaagtacgtcggccgcagagggtcactgatgattgcggcggttccgaacattatgggctggctcgcaatctccctggccagagac

SEQ ID NO: 52487 - protein, 149 aa, Zea mays
  misc_feature: Ceres CLONE 1469473-F
MASDGDHGGALQKPLLPKAARGGGWFRKGTSTAHPSGLSAAAAGTSSKAAALRPTHHVPALLCTLVVALGPIQFGFTTGYSSPAQDGVTRDLNLSISEFSAFGSLSNVGAMVGAIASGQMAKYVGRRGSLMIAAVPNIMGWLAISLARD

SEQ ID NO: 52488 - DNA, 627 bp, Zea mays
  misc_feature: Ceres CLONE 1469474-F
  misc_feature: Encodes the peptide sequence at SEQ ID NO. 52489
cgcggtggcggccgctctagaactagtggatcccccgggctgcaggaattcgtctcacccctagaaaaagccaaccggacaagaggcgggacaggagcccagcctctgtcacgggcgttttcgccgcataatcccacgggttccgcgttccaacccatttccttcgcctttccccttcgccctccattctccgcccaccgtttcctcgggtctgccacgcccatgaacctgtggacggacgacaacgcctccatgatggaggccttcatggcctccgccgacctccccgcctacccctggggggcgccggccgggggcggcaacccggtgccgccgccgcagatgccgccggcgatggcgatggcgccggggttcaaccaggacacgctgcagcagcggctgcaggccatgatcgaggggtccagggagacctggacctacgccatcttctggcagtcctccctggacgccgccaccggcgcgtcgctgctcggctgatgcgacggctactacaagggctgcgacgacgacaagcgcaggcaccgcacgccgctcacgcccgccgcgcatgccgagcaggagcaccgcaagcgcgtgcatcgtgagctcaactcccacatctccggg

SEQ ID NO: 52489 - protein, 91 aa, Zea mays
  misc_feature: Ceres CLONE 1469474-F
MNLWTDDNASMMEAFMASADLPAYPWGAPAGGGNPVPPPQMPPAMAMAPGFNQDTLQQRLQAMIEGSRETWTYAIFWQSSLDAATGASLLG

SEQ ID NO: 52490 - DNA, 911 bp, Zea mays
  misc_feature: Ceres CLONE 1469474-R
  misc_feature (58)..(58): n is a, c, t, g, unknown, or other
  misc_feature (59)..(59): n is a, c, t, g, unknown, or other
  misc_feature (312)..(312): n is a, c, t, g, unknown, or other
gctgaataatactacatcctatactacagctttgggcattcaaccaacgctaaaacanntcggtcgaatccatcgtcgtcacagctcacaacaacaggtacttaattaacaacgggggtgacgcttgacggctgcttaatcctgctaattaccaggctactagcaaaaacacaagaggatgatgaacagcagccggaagctaggtgtcatcatccatccatccttctagagttttcaacaacaccagcatcatcatcgtcgtcgccgttcctccacctccctcctgaaatttctatgggcctatcatggccntggtgtgtgtttttggaaaccattgggggcaccccccaaatgaacagtccccccttggtggggtagcaaatggaatcgggaattgggccccctatcccgggcaggggccccaccagggccaaacctaaaagaaagcctccccctcggcccgaaaaatacccgggccccaataaaaaaatcccccgggggggtcttttactttattgggggctcttttaaaaaaacccccccggccccccttaaaaaaagtgggtgctccccccgcaaagaaaaaaaaaaatactccccgcgctgggggggcgcctctcttcttttaagagggggggaaaaacccgtgtgggggggaaaaaaaataaaaggaggggtccctcttttttctccccgcgaggaacaaccccccccggggggggggggagaaacacccccccccccaccaaataaaaaaacatcctcggggggagagagcccccattataaattaacacccccccccaaaaaaaggggggggtggtcaccccctttggggccaccctctctccccccaaataaaatttcccccccccccccccccccaaaatattgtgtgtttttttatattt

SEQ ID NO: 52491 - DNA, 644 bp, Zea mays
  misc_feature: Ceres CLONE 1469478-F
  misc_feature: Encodes the peptide sequence at SEQ ID NO. 52492
  misc_feature (569)..(569): n is a, c, t, g, unknown, or other
  misc_feature (593)..(593): n is a, c, t, g, unknown, or other
cgcggtggcggccgctctagaactagtggatcccccgggctgcaggaattcgtctcacccctagaaaaagagcccgggcggagcggccgtcggtgcagatcttggtggtagtagcaaatattcaaatgagaactttgaaggccgaagaggagaaagttccatgtgaacggcacttgcacatgggtaagccgatcctaagggacgggggaaacccggcagatagcgcgaaatccaggcgggcaatccccacaggccacaatggcgtcgctgctgcgcctcccctcgctgctctccccgtccaagcccctgctccggcgccggctgccggcggcgaggctcgcggcatctgccgcatccaggggtcaagcctcggcgaccgcgggcgcggcggcgccggcggccgcggagacccgcggcggggacagggaggggcaggtcacgccgcggtccgcggacttcaacgcctggtacacggacgtcatcgccgctgccgagctcgcggactacgggcccgtgcgggggaccatggtcattcgcccctacggatacgccatctgggaggccatccnagattatttgaatgtcaaattcanggagacagggcacagcaacatgtacttcccctcagtcattccatactcatt

SEQ ID NO: 52492 - protein, 128 aa, Zea mays
  misc_feature: Ceres CLONE 1469478-F
  misc_feature: SWISSPROT Homolog: EC 6.1.1.15 Proline--tRNA ligase
  misc_feature (104)..(104): Xaa is any aa, unknown, or other
  misc_feature (112)..(112): Xaa is any aa, unknown, or other
MASLLRLPSLLSPSKPLLRRRLPAARLAASAASRGQASATAGAAAPAAAETRGGDREGQVTPRSADFNAWYTDVIAAAELADYGPVRGTMVIRPYGYAIWEAIXDYLNVKFXETGHSNMYFPSVIPYS

SEQ ID NO: 52493 - DNA, 648 bp, Zea mays
  misc_feature: Ceres CLONE 1469482-F
  misc_feature: Pfam Name: CRAL_TRIO Pfam Description: CRAL/TRIO domain
ccccgcggtggcggccgctctataactagtggatcccccgggctgcaggaattcgtctcacccctagaaaaagatccagactattatactccgcatctcggccgctccactctcgacccgtgcgcgtgcgcactcacatcacttactcctaaatacttgacgagtgtcatgtgccagaatttcgtggtggccaatgcacttgtattgaacgttgccaaagatctcacaaaggtccttggaacgatcccaacataataaagagagtcctcaatgactaggcaaactacggcagacaaattgtgaccatatccagcattgatggaaaaataatacgttatgctaggccagatcacccaactagaaaagggagtgatgcatctgccgagtctggatctgaactgtaagatgtaacatctcctattgcatcacggaacctgattacacatcctattttgaccccctggtcacgaagagtcaaaattgtcgccacatgcttccacatttgttgctcatgcttctattagaagacaacattccctgttgtacactaggtttgtggaagatggaatgggatactccccaaaggtagtctccaagctttcttcagggttcgttgccctccgaggaagcacccccctggaacatttc

SEQ ID NO: 52494 - DNA, 707 bp, Zea mays
  misc_feature: Ceres CLONE 1469483-F
  misc_feature: Encodes the peptide sequence at SEQ ID NO. 52495
  misc_feature (419)..(419): n is a, c, t, g, unknown, or other
gcggtggcggccgctctagaactagtggatcccccgggctgcaggaattcgtctcacccctagaaaaacctggggacccagatcactatatctgttatgtagcttatcccttctacctctttgccgagggttctgttgctaacctgtttccttaacttgaggataacgtatttggcttccaagcctgacgagttctacgtttaggaggtctagcatatccccctgcttatccacgaacttatgatggacgatctcagggactacaagttgatacgtatacgtagagccagttcggacgtcccattattgggatgtactattacgccaaaattggtattatccgcagaacattaccggtagaccgctgtatggctgtttacgccccaggagtttgattttccccaaacatagatgaaaanggtaaatcttcccaaccttttatgcgcatgggagataccgcattttgtctttttgtcgcaccagcactttctttacgcccaagccagaacgtgggggaaagccacgggaaatttaattggaatgcgactgcccggccctttccaaaagcaaatgattaacgcgcaccttgtttttggcaaggaaaattagaagtctcctatatcgctccggcatgacttctctcacttcggagggattcccccggaaaatacccacttttggccccctataagcgccgggaggccccc

SEQ ID NO: 52495 - protein, 50 aa, Zea mays
  misc_feature: Ceres CLONE 1469483-F
  misc_feature: SWISSPROT Homolog: EC 4.1.1.39 Ribulose-bisphosphate carboxylase
GGGRSRTSGSPGLQEFVSPLEKPGDPDHYICYVAYPFYLFAEGSVANLFP

SEQ ID NO: 52496 - DNA, 652 bp, Zea mays
  misc_feature: Ceres CLONE 1469491-F
  misc_feature: Encodes the peptide sequence at SEQ ID NO. 52497
  misc_feature (636)..(636): n is a, c, t, g, unknown, or other
ggagctccccgcggtggcggccgctctagaactagtggatcccccgggctgcaggaattcgtctcacccctagaaaaactctccctctccgctccccattgccgcattgctctccctcggctcggtccctctccggctctccctcacggcctcgcccactgcgccttcgaggagctccgaatcccgatcgcctcggtccccgcgagctcacatggtgggggcgcgcaccagaggctagggttcccagttcccatcattctcctgctgattaaaaccgtggggttttggagagcctgaggctgtggcggcggcaggaatgaacggggaggtggaatgcagcgtgtgccatgcgaaggtgccggtgccgccgccggtgtcgaaagcgtacgacagccaccggagcactgtgtcgtcgcggcaacgtgcgctaaacgtgctcctcgtctccggcgactgcgtccttgccggcctccagcctatattagtgtacatctcacaagtggatgggaaattcaaatttagcccaatcagcgtgaatttcttgacagagattacaaaaattatgtttaccattgtaatgctattcatccaggctagacgtctaaaggtgggagacaagccactttgtacagtttncatatttatgcaggct

SEQ ID NO: 52497 - protein, 112 aa, Zea mays
  misc_feature: Ceres CLONE 1469491-F
  misc_feature (107)..(107): Xaa is any aa, unknown, or other
MNGEVECSVCHAKVPVPPPVSKAYDSHRSTVSSRQRALNVLLVSGDCVLAGLQPILVYISQVDGKFKFSPISVNFLTEITKIMFTIVMLFIQARRLKVGDKPLCTVXIFMQA

SEQ ID NO: 52498 - DNA, 691 bp, Zea mays
  misc_feature: Ceres CLONE 1469492-F
  misc_feature (415)..(415): n is a, c, t, g, unknown, or other
ggagctccccgcggtggcggccgctctagaactagtggatcccccgggctgcaggaattcgtctcacccctagaaaaaaaaagtcccttcctcccccaccttcctctcttctcccctcacccctttctggctttctcctccgccgaggccccgagtcctgccggaattctagatcccggaggcaacttgccacgggctcctccgctccggtcgctgaatcgtactatcgtgctctcgacagaaagcccggccgaaacccagccggaccaagccctgttcgccgtgcgcgcggtgccccgggccagatctgcgagatctgcaccgacaccgctacgcctatcacgagcctgtaggtggatgctctcgtgatctctcggagtcccctggactgagcggcatctcggcggaccccccncctgtttagctggtgggctgcctagatgcagcggattggggtggggaaatgcagcgtgtgcccctccccgggtggtgctgccgagtccccgggagcgcgccccgggccgaccaacaatcaccagcatccaagatgttcttcccaattttcgcggcggctcaacgctcttcctccgttggttcggccgactggccatccgttggttgggtcttcccagcccccattcctaattggttcccctgtccaaaggggttgtatggggcaaatcttctccat

SEQ ID NO: 52499 - DNA, 727 bp, Zea mays
  misc_feature: Ceres CLONE 1469497-F
  misc_feature: Encodes the peptide sequence at SEQ ID NO. 52500
tggagctccccgcggtggcggccgctctagaactagtggatcccccgggctgcaggaattcgtctcacccctagaaaaaaaacgccacttgttctccctccctctcggcctgactagctacgatcatcggaaacatcaatggtgatggcgtcctctagagatctgaggatctgcaacgccatgagcgtgcccagcctgctggctccgtcgtcccggtccggccgcctggcgccgttctgcgccaacgccactacctctggacgtgtcaccatgtccgcggattggatacccggtcagccacgccctgcccacctcgagcgctcctctcacggggacttcgggttcgatccgctggacctcgagaccgtaccggacaccttctatgagttcaatggaatttcaagaagtaacactcccccctgtgaccatgaattgccgtccccgggcatccttggagaccagaagcttctgggccccgccccacctggggtggaaagctcaacgaagtggggtggtccgacccccggtcgggccggggcatcgtacctagggaaaccccctggtgaccaattgtggcaccgattgccgtatcaaaccttggcgaaacaaaagtcgcgtggttcgatttttctttcgcccgagtctcccagaccccccctttggtttaatgggcccccgcgaaatagaacaaaattatccctttgggagccgcctttacgaacccaaa

SEQ ID NO: 52500 - protein, 196 aa, Zea mays
  misc_feature: Ceres CLONE 1469497-F
MVMASSRDLRICNAMSVPSLLAPSSRSGRLAPFCANATTSGRVTMSADWIPGQPRPAHLERSSHGDFGFDPLDLETVPDTFYEFNGISRSNTPPCDHELPSPGILGDQKLLGPAPPGVESSTKWGGPTPGRAGASYLGKPPGDQLWHRLPYQTLAKQKSRGSIFLSPESPRPPLWFNGPPRNRTKLSLWEPPLRTQ

SEQ ID NO: 52501 - DNA, 557 bp, Zea mays
  misc_feature: Ceres CLONE 1469556-F
ccccgcggtggcggccgctctagaactagtggatcccccgggctgcaggaattcgtctcacccctagaaaaatttcggtgccggattcgagtcggcctctatactttctttgtaggttcgaggtgccgcgctcgtgacgccgccggctccgaagagatggatgatggcgtatctacttatactgtcgatagagcgcctgtgatcatggcgtttgcgaattcccgtgcttcatgcttgatactctgacatgttgacatcttcgagcatggagatgctgcttcctgctttgtttggcatcgattcagctgagtggagggcttctgactgtgaaaacccccataccctggtggcttctgggaaagctagaagaacaaatgcctggggttaattccccaaaattcttgaaaaaggttgcggttgagttccccaccttttgtcccgtggaaaaagggcctccccgggggtttgggccccattaaaaaaatttttttttttcccccatttttagggggccgggggggaatttgcgccggggggcccttttttttatttttttt

SEQ ID NO: 52502 - DNA, 671 bp, Zea mays
  misc_feature: Ceres CLONE 1469558-F
  misc_feature: Encodes the peptide sequence at SEQ ID NO. 52503
  misc_feature (369)..(369): n is a, c, t, g, unknown, or other
  misc_feature (419)..(419): n is a, c, t, g, unknown, or other
  misc_feature (531)..(531): n is a, c, t, g, unknown, or other
aaagctggagctccccgcggtggcggccgctctagaactagtggatcccccgggctgcaggaattcgtctcacccctagaaaaaaacgtgctcgatctccctccgccactccatccatctcctcgctcccagtccccgggaagctacgaagcatggcgtccgtcaccgcccgcgccccggtcgcggcccttcgcccgtcgtcggcatcgctcaagtcgtcgtcggccttccttggccactctagccgcctcggccgcaccgcgtcgcccacgaggcgcagcctcaaggcggaggccaagggcgagtggctccccggccttccctccccctcctacctcgacggcagcctggcgggtgacaatggcttcnacccgttgggcctggcggaggaccccgagaacctgcggtggttcgtgcangcggagctggtgaacggccggtgggccatgcttggcgtggccgggatgctcatcccggaagtgctgaccaaagccgggctgatcaacgcgccgcagtggtacgacgccggcnagtcggagtacttcgcgtcgtcctccacgcttggtcgtgggtcgaagtcatcctggtcccctacctggaaaatcgggcggtgggcaggacatcaagaaacccccggaagggtcaaccaggaccccattcttcagagctac

SEQ ID NO: 52503 - protein, 173 aa, Zea mays
  misc_feature: Ceres CLONE 1469558-F
  misc_feature (57)..(173): Pfam Name: Chloroa_b-bind Pfam Description: Chlorophyll A-B binding protein
  misc_feature (73)..(73): Xaa is any aa, unknown, or other
  misc_feature (89)..(89): Xaa is any aa, unknown, or other
  misc_feature (127)..(127): Xaa is any aa, unknown, or other
MASVTARAPVAALRPSSASLKSSSAFLGHSSRLGRTASPTRRSLKAEAKGEWLPGLPSPSYLDGSLAGDNGFXPLGLAEDPENLRWFVXAELVNGRWAMLGVAGMLIPEVLTKAGLINAPQWYDAGXSEYFASSSTLGRGSKSSWSPTWKIGRWAGHQETPGRVNQDPILQSY

SEQ ID NO: 52504 - DNA, 675 bp, Zea mays
  misc_feature: Ceres CLONE 1469562-F
  misc_feature: Translation starting site: 119
  misc_feature (446)..(446): n is a, c, t, g, unknown, or other
  misc_feature (522)..(522): n is a, c, t, g, unknown, or other
  misc_feature (556)..(556): n is a, c, t, g, unknown, or other
aaatgctggagctccacgcggtggcggccgctctagaactagtggatcccccgggctgcaggaattcgtctcacccctagaaaaatcttcgtgaggaccttcaaccatctcaggcggaatggcggcttctggtgagggcgcgtcgctgccgtctccggcgggcggggaggatgcgcaccgccgccgcgtcagctatttctacgagccgtcgatcggagactactactacgggcaaggtcacccgatgaagccccaccgcatccgaatggcgcactcgctggtggtccactacggcctccaccgcctcctcgagctctcccgcccctacccggcctctgaggccgacatccgccgcttccactccgacgactacgtcgccttcctcgcgtccgccaccggaaacccgggtgtcctcgacccgcgcgccattaagcgctttaacgtcngtgaggactgcccccgtgtcgacggtctcttccccttctgcaggcctccgctgggggaagcatcggcgccgccgtncagcttaaccgcggggacgccgacatcaccgtcnactggggcgggcggcctccaccaacgccaggagagcgaggccctcggggttctgctacgtcaacgacatcgttctcggcctcctcgagctcctcaagttcacaggcgtgggctatatgg

SEQ ID NO: 52505 - DNA, 654 bp, Zea mays
  misc_feature: Ceres CLONE 1469563-F
  misc_feature: Encodes the peptide sequence at SEQ ID NO. 52506
  misc_feature (620)..(620): n is a, c, t, g, unknown, or other
  misc_feature (644)..(644): n is a, c, t, g, unknown, or other
tccccgcggtggcggccgctctagaactagtggatcccccgggctgcaggaattcgtctcacccctagaaaaagctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcgggcgccgccggcctcgtcgccatcctcagcgtctgcctcnacatgtacggcgtcgcctccttcnacgaggggga

SEQ ID NO: 52506 - protein, 147 aa, Zea mays
  misc_feature: Ceres CLONE 1469563-F
  misc_feature (44)..(137): Pfam Name: PsaL Pfam Description: Photosystem I reaction centre subunit XI
  misc_feature (136)..(136): Xaa is any aa, unknown, or other
  misc_feature (144)..(144): Xaa is any aa, unknown, or other
MASQVMKSSLVVHSRPRGLSGAAALTRRPGRFTVKAIQPEKATYQVVQPINGDPFIGSLETPVTSSPLVAWYLSNLPAYRTAVSPLLRGVEVGLAHGYLLVGPFALTGPLRSTPVHGQAGALGRRRPRRHPQRLPXHVRRRLLXRGG

SEQ ID NO: 52507 - DNA, 668 bp, Zea mays
  misc_feature: Ceres CLONE 1469564-F
  misc_feature: Encodes the peptide sequence at SEQ ID NO. 52508
  misc_feature (1)..(1): n is a, c, t, g, unknown, or other
  misc_feature (542)..(542): n is a, c, t, g, unknown, or other
natagctggagctccccgcggtggcggccgctctagaactagtggatcccccgggctgcaggaattcgtctcacccctagaaaaactctccccgagtcctctcctctccggggtattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttgccagtctcgtctgggctgtgcggtccgctgtccggcctcctcgtccagcccctcgtcggccacctctccgaccgcatcggccccgccgcttcgccgctcggggcgccgcaggccctccatcgccgccgggcgccgcgtggcatcgccgcagccgtggctcaccgtcggcttctccgctgacctcggccgactcctcnggcgacgacgtcaccccgggctcaacgcgcctcggcgccatctgcgtctaccttggtaggattctggctggctcgacgtgggcaacaacggcacgcaggggcccttgcagggcgttccctcgcgac

SEQ ID NO: 52508 - protein, 164 aa, Zea mays
  misc_feature: Ceres CLONE 1469564-F
MPPRTAPAATSTPPRKVPLRKLLRAASVACGVQFGWALQLSLLTPYVQELGIPHAFASLVWAVRSAVRPPRPAPRRPPLRPHRPRRFAARGAAGPPSPPGAAWHRRSRGSPSASPLTSADSSGDDVTPGSTRLGAICVYLGRILAGSTWATTARRGPCRAFPRD

SEQ ID NO: 52509 - DNA, 628 bp, Zea mays
  misc_feature: Ceres CLONE 1469565-F
  misc_feature: Encodes the peptide sequence at SEQ ID NO. 52510
aagctggagctccccgcggtggcggccgctctagaactagtggatcccccgggctgcaggaattcgtctcacccctagaaaaagcacggaagtttcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcagggcgcttgctcgttccgggatgaaaatcggacgcattgaggacgttaccccggtccccactgacagcctccaaaaaagggggccgtaaggagggggagggaggctgtaagcc

SEQ ID NO: 52510 - protein, 144 aa, Zea mays
  misc_feature: Ceres CLONE 1469565-F
  misc_feature (28)..(142): Pfam Name: Ribosomal_S11 Pfam Description: Ribosomal protein S11
MSRRKTREPKEENVTLGPTVREGEYVFGVAHIFASFNDTFIHITDLSGRETLVRITGGMKVKADRDESSPYAAMLAAQDVAQRCKELGITALHIKLRATGGNKTKTPGPGAQSALRALARSGMKIGRIEDVTPVPTDSLQKRGP

SEQ ID NO: 52511 - DNA, 647 bp, Zea mays
  misc_feature: Ceres CLONE 1469572-F
  misc_feature: Translation starting site: 148
aaagctggagctccccgcggtggcggccgctctagaactagtggatcccccgggctgcaggaattcctctcacccctagaaaaacagcatctcaagtcttcacactcctcgccatcacataaaaccagtgcaagcagaagcagcgcaatggcgagcagcaccatggccctctcctccacagccttccccggcaaggcagtgaacgtgccgtcctctctcctccgcgaagcccgcgtgacgatgcgcaagacggcggcgaaaagcaagcccggcgcgagctccggcagcccgtggtacggccccgaacgcgtgctcttactgggcccgctgtcccgcgcgcccccgagctaactgaacgggcgaagtccccggcgaactacagctgggacaccccggggctgtccgccgaacccgaaacattcgcccagaaacccggaaactggaagtcatccactcccccctgtgccatgctctggcgcgttttgcctctccgtttcccggagatggtctcccgcaaaaggggtccaattctgcgaggaccccgtgggtctaagccgggtctcacatactcccccaaggggggtgggtggtattccctgggaaaccaaagcttgatcccacgcgcaagcatcctcgccatctggccc

SEQ ID NO: 52512 - DNA, 660 bp, Zea mays
  misc_feature: Ceres CLONE 1469573-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaactgggactccccgcggtggcggccgctctagaatagtggatcccccgggctgcaggaattcgtctcacccctagaaaaactgcgtctgcaatgctcaatttcgtttgtgctgtcaggtgcacgattctctggtggaaaagaccaagtgcatacctggagccaaggtggagaacaacaagttctggtgtgtctgtccacttcagatgcgtcgatgaagaaggagctggatcacggtgggccggatatgggtgaaagttcggtgctcaaggactacccgaaaagctgaaaactgaccccaggggcaagggatgggtggtttccaagggtccgccccccccccattcaaagtgggaaaaagggcaaaggcccctggaaaatttccccccccccaaaaaccccctcggggtaacccccaaattggccccccaaatgtgtttcccctgtttaaaaattggggaaaaaaaacccc

SEQ ID NO: 52513 - DNA, 637 bp, Zea mays
  misc_feature: Ceres CLONE 1469580-F
  misc_feature: Encodes the peptide sequence at SEQ ID NO. 52514
  misc_feature (1)..(1): n is a, c, t, g, unknown, or other
  misc_feature (241)..(241): n is a, c, t, g, unknown, or other
  misc_feature (289)..(289): n is a, c, t, g, unknown, or other
  misc_feature (290)..(290): n is a, c, t, g, unknown, or other
  misc_feature (464)..(464): n is a, c, t, g, unknown, or other
  misc_feature (568)..(568): n is a, c, t, g, unknown, or other
nagctggagctccccgcggtggcggccgctctagaactagtggatcccccgggctgcaggaattcgtctcacccctagaaaaaaaacatagtgcagcaagcaactgcaaagcagcaagctctactcttcttctgtactgaacgtgtgactagataacaataagcgtgaaccatggcggacgagtacggccgcagcggctacggcaggtccggcgccggcgacgactacgacagcggctacnacagcaagtccggcactgatgactacggccgtgggcgaagtggctacnnacagtcgggcggcgatgacgactaccgccgcagcggccgccatgggtaccgcaggtccggcggcgacgactacagccgtggcacccggcggtggtggctaccacaagtccgggcggctgcgaaaactacaggcgcaacggacggcgataggtatgggaagtgcccggggccacnaaatataggcctgtggaccggggggcgggcgggtacaaaaaagtcctggaacgcacaggtaccaaagcggggacacacagatatcgggcaccaccacgacgacnaatatacggcctggcaaccgggcgccggtacgggcagcagccctctggcaacgactcgtacgccggccg

SEQ ID NO: 52514 - protein, 155 aa, Zea mays
  misc_feature: Ceres CLONE 1469580-F
  misc_feature (24)..(24): Xaa is any aa, unknown, or other
  misc_feature (40)..(40): Xaa is any aa, unknown, or other
  misc_feature (98)..(98): Xaa is any aa, unknown, or other
  misc_feature (133)..(133): Xaa is any aa, unknown, or other
MADEYGRSGYGRSGAGDDYDSGYXSKSGTDDYGRGRSGYXQSGGDDDYRRSGRHGYRRSGGDDYSRGTRRWWLPQVRAAAKTTGATDGDRYGKCPGPXNIGLWTGGRAGTKKSWNAQVPKRGHTDIGHHHDDXYTAWQPGAGTGSSPLATTRTPA

SEQ ID NO: 52515 - DNA, 637 bp, Zea mays
  misc_feature: Ceres CLONE 1469582-F
  misc_feature: Translation starting site: 216
  misc_feature: Pfam Name: YABBY Pfam Description: YABBY protein
ctggagctccccgcggtggcggccgctctagaactagtggatcccccgggctgcaggaattcgtctcacccctagaaaaaatctggtccttgattactcgtcctttttgcttggtgcctgtgtatatcgtcgccccggccgcttgagctagcttcctctagtgctcgctctcgtcgtcgatcggttgtttgcatagcccacggcgagccgaagcaatgtcgtcggcgcccctgcagatcgcgccggtgccggagcatgtgtgctacgtgcactgcaacttctgcaacacaattctcgcggtcagtgtcccgagtcacagcatgctgaacatcgtcacagtccgttgtgagcactgcactagcctgctgtcggtgaacttgagaggactcatccaatcacttcctggtcagaaaccacactactcccagcagcaggagaatttgcagcgtcaaaatatggggtttactgcaaatttaccctgagtacgcaccttcgtaccgcatgccaacgacgctgtcagtgaaaagtgatctgtatcataatgctgcacgtgcgcgctccagagaagaagcagcgtgttccttcagcatataacagatttattaaggacgagatacgaaggattaaagcatgtaac

SEQ ID NO: 52516 - DNA, 630 bp, Zea mays
  misc_feature: Ceres CLONE 1469597-F
  misc_feature: Encodes the peptide sequence at SEQ ID NO. 52517
  misc_feature (390)..(390): n is a, c, t, g, unknown, or other
  misc_feature (391)..(391): n is a, c, t, g, unknown, or other
  misc_feature (432)..(432): n is a, c, t, g, unknown, or other
  misc_feature (497)..(497): n is a, c, t, g, unknown, or other
  misc_feature (547)..(547): n is a, c, t, g, unknown, or other
ctggagctccccgcggtggcggccgctctagaactagtggatcccccgggctgcaggaattcgtctcacccctagaaaaagcggtgctatccacccatcagctctcgtatccgcagcgcccggaatggcggcaccctcccacgtcctcccgttcctgtcccccgccggcgggtgtgccgcctcctccgcccgcgcccactctggctaccgcgctggtctcctgcgctgctcggccgcggccggccaggcgggcttcttcactcgcctcggtcgcctcataaaggagaaggccaagagcgacgtggagaagctcttctccggcttctccaagacccgcgagaacctctctgtcgtcgacgagctccttacttactggaacccttgcgacanncgacgcgtcctcgacgaccctcgagaggcgctgctggtctncgacttcgggcccaaaatctcattccggatcgtcgacacgctccgcgaggagatccgcgacggcnagctcaagtctggcgccgagataaaggcccgctgaaaaggtgcatcctgnaactgctgacgagcaagggcggcaactcggagctcaatctcggattcaggaagccggctgtcatcatgatcgtgggagtgaat

SEQ ID NO: 52517 - protein, 135 aa, Zea mays
  misc_feature: Ceres CLONE 1469597-F
  misc_feature (89)..(89): Xaa is any aa, unknown, or other
  misc_feature (103)..(103): Xaa is any aa, unknown, or other
  misc_feature (125)..(125): Xaa is any aa, unknown, or other
MAAPSHVLPFLSPAGGCAASSARAHSGYRAGLLRCSAAAGQAGFFTRLGRLIKEKAKSDVEKLFSGFSKTRENLSVVDELLTYWNPCDXRRVLDDPREALLVXDFGPKISFRIVDTLREEIRDGXLKSGAEIKAR

SEQ ID NO: 52518 - DNA, 685 bp, Zea mays
  misc_feature: Ceres CLONE 1469599-F
  misc_feature: Encodes the peptide sequence at SEQ ID NO. 52519
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
aaactggagctccccgcggtggcggccgctctagaactagtggatcccccgggctgcaggaattcgtctcacccctagaaaaactcgttcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttaggcggcgggnnnannnnnntttaaaaggggaggaggaggcaaccggtgttttaccggcgggcgggcaaacccgtgggtttaacggggtgggaaggtggggggaaccgcccggcttacggcgggggaacccgttggcttacagggggggaaggcgggcgggcttattgggggccggnnntttttttttttttgtnnnnnnnnnnnnnnnnttttcgtttnnnnnnnnt

SEQ ID NO: 52519 - protein, 100 aa, Zea mays
  misc_feature: Ceres CLONE 1469599-F
  misc_feature (5)..(72): Pfam Name: CSD Pfam Description: 'Cold-shock' DNA-binding domain
MASDRVLGTVKWFNGTKGFGFITPDDGSEDLFVHQSSIKSDGYRSLNDGDAVEYTVGSGNDGRAKALDVTAPGGGPLAGGERPDGGNGGGRGGYGGGDRG

SEQ ID NO: 52520 - DNA, 636 bp, Zea mays
  misc_feature: Ceres CLONE 1469604-F
  misc_feature: Encodes the peptide sequence at SEQ ID NO. 52521
tggagctccccgcggtggcggccgctctagaactagtggatcccccgggctgcaggaattcgtctcacccctagaaaaagcctttgtattcgtcttgctccagccgccgtcggatcggatccgatccaaagcaagcagcagcagccggctccgcctcccgcagcagccacaccccgtccgtcaccagaggaagaggaagaggaggatgtcggggtcgaaggtgtacacccttgaggaggtggccaagcacaacaccaaggatgactgctggctcgtcatcggcggcaaggtgtacaatgtgaccaagtttctggaggaccaccccggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggagttcgtcatcaagatcctccagtttttggtccccctggcaatactgggcctggctgttgctgtaaggatctacaccaagtcggaatctgcctagtcatctgaaccaagttagcgagg

SEQ ID NO: 52521 - protein, 135 aa, Zea mays
  misc_feature: Ceres CLONE 1469604-F
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MSGSKVYTLEEVAKHNTKDDCWLVIGGKVYNVTKFLEDHPGGDDVLLSSTAKDATDDFEDVGHSTTARAMMDEYLVGEIDAATIPSKVKYTPPKQPHYNQDKTPEFVIKILQFLVPLAILGLAVAVRIYTKSESA

SEQ ID NO: 52522 - DNA, 624 bp, Zea mays
  misc_feature: Ceres CLONE 1469605-F
  misc_feature: Encodes the peptide sequence at SEQ ID NO. 52523
  misc_feature (582)..(582): n is a, c, t, g, unknown, or other
tccccgcggtggcggccgctctagaactagtggatcccccgggctgcaggaattcgtctcacccctagaaaaactcgctccaaaccaaagccatcggaggagcaactggacgaccatggcctcgccgctgctcaagtcacactctcagctcgccgccgccgccgccctgcactccgtgaggagagccgaccgctgccctgcgacactacacctgggcaagttccatgaccacgggctcaggtccggccgttctaaggcgttgcagagatccggttcagcgagggtgggcgccttcccgtcgctggacgtggtgccgctgatggtgacgatggtggagcacgtggacatgtcgcgggactacgtcgtgaccaagtccatctggcatctcagcgacgtagccctcaagagcgtctataccttctacgccatgttcaccgtctggggagtctgcttcttcgcgtccatgaaggatcccttctacgacagcgagacgtacaggagccagggtggcgacgggaccgtgcactggtactacgacaggcaagaggacctggaggcgtctgcgagggaggagctgctgcnggaggagctgctcgaggagatgagcagagggttgggggcctc

SEQ ID NO: 52523 - protein, 169 aa, Zea mays
  misc_feature: Ceres CLONE 1469605-F
  misc_feature (156)..(156): Xaa is any aa, unknown, or other
MASPLLKSHSQLAAAAALHSVRRADRCPATLHLGKFHDHGLRSGRSKALQRSGSARVGAFPSLDVVPLMVTMVEHVDMSRDYVVTKSIWHLSDVALKSVYTFYAMFTVWGVCFFASMKDPFYDSETYRSQGGDGTVHWYYDRQEDLEASAREELLXEELLEEMSRGLGA

SEQ ID NO: 52524 - DNA, 669 bp, Zea mays
  misc_feature: Ceres CLONE 1469606-F
  misc_feature: Encodes the peptide sequence at SEQ ID NO. 52525
  misc_feature (445)..(445): n is a, c, t, g, unknown, or other
  misc_feature (591)..(591): n is a, c, t, g, unknown, or other
aaagctggagctccccgcggtggcggccgctctagaactagtggatcccccgggctgcaggaattcgtctcacccctagaaaaaaaccccattcctccgccggccgccggcagccgcccgcgatgtcgaaggccgcggcagcgtccctcccgccgccgccgccagaggtggcgcaccttgtggagcagctccagcgccaccacctcgccccggacgcgtccctcctctccagctccgcgcactccgacctcctccaggcgcgcgaggaggtcgcggcggagcgcgcgctgtacctcgaggcactggcggtgtacgcggaggcggtggccatggtggaggagtaccatgcggctgccggcgccggcaagaagctcaactgctccccgcaggtgtacgagtctttggagcaccggttggccgtggcagaggcagcacagaggcttangctcccactgctctctcaggacgggggagtcccatgagcagagatcgaaaagctgagcacctattcaagaaagtcattcgatagcaccctcacaagcgcgacacccagctcaagttcatctcgacgagttacaaacattatagcancaccgcttagggcgggacggttgctgcccccctttgaatgggaatttctaaggctttaaactggaatttggggggtcc

SEQ ID NO: 52525 - protein, 119 aa, Zea mays
  misc_feature: Ceres CLONE 1469606-F
  misc_feature (108)..(108): Xaa is any aa, unknown, or other
MSKAAAASLPPPPPEVAHLVEQLQRHHLAPDASLLSSSAHSDLLQAREEVAAERALYLEALAVYAEAVAMVEEYHAAAGAGKKLNCSPQVYESLEHRLAVAEAAQRLXLPLLSQDGGVP

SEQ ID NO: 52526 - DNA, 617 bp, Zea mays
  misc_feature: Ceres CLONE 1469610-F
  misc_feature: Encodes the peptide sequence at SEQ ID NO. 52527
  misc_feature (296)..(296): n is a, c, t, g, unknown, or other
ccccgcggtggcggccgctctagaactagtggatcccccgggctgcaggaattcgtctcacccctagaaaaaatccgtcccgatcccgaccagctttgagatcgcgatggcggacggccgctgctgcaccttcctggagatcctcttcgccatcatcctcccgcccctcggcgtcttcctccgattcggctgctgcagaatagagttctgcatctgactgctgactcacatccttgggtacgtcccccggatcatctaccccgatctatgtccttgttggctcccgactctgaccngccgaaaagggaatacttcccccctgcctaaaacatccggggttgggcccgggggggcccctgcccctttaaacccaaaaaacaaaattttttttcccccgggggatttgggccgaaacgggtttaacccgcccatgggggaacacaaaaggggggggggggccatttcctccgtgtaacccacattgggggggccccctttttttggggccccccatttataacacccccgtttttgtgggcccccccccaaaaaaaaaaaaaggcgccgtgtgtttcttctaaaaaaacccgggggtttttttaattgggggggccccc

SEQ ID NO: 52527 - protein, 36 aa, Zea mays
  misc_feature: Ceres CLONE 1469610-F
MADGRCCTFLEILFAIILPPLGVFLRFGCCRIEFCI

SEQ ID NO: 52528 - DNA, 781 bp, Zea mays
  misc_feature: Ceres CLONE 1469617-F
  misc_feature: Translation starting site: 274
  misc_feature (39)..(39): n is a, c, t, g, unknown, or other
  misc_feature (47)..(47): n is a, c, t, g, unknown, or other
  misc_feature (435)..(435): n is a, c, t, g, unknown, or other
gttgttacaccccacgtgtcgagtctctctttggggggnggggggantgtttaacttttcgtggactccccctccgtggggggcgctctcgtattaatggatcccccgggctgcaggaattcggctcaccccttgaaaaagaggagcaccgaggaccttcggcgcccgttcaggatccacatcttcccgagcgagttctaggttgagctcttcctcttcggaccacctccaaggctcttggtgtagcttgccactctcaccactcaggttttcatgtctgatctcgacattcagatcccgactgccttcgatcccttcgctgaggccaatgctggggagtctggtgcggcagcagggtcaaaggactacctacacgtgcgcatccggcaacgtaatggtcgcgagaccctgactaccgtccagtgattgataaangagttcagctacggctggatcctcaaacgatctcaagaaggagttctgctgccctgggacagaggtccaggacccagaacttggactggtcattcaggctccagggtgatgcgaggaggaacgtctcgaacttcctccctcaggccggcattggcgacgaatggagcccatcgagaatttgtggtttgcctgagcacgccggccggggcccatcggctaaaccaggcccctgcctggctgggggcgcagcaatctttaatgtcgccactggtccctgaaggggggtgagccattgtgcctcttcgcggtggcttggtagggacgctacccagagcgccgccgccca

SEQ ID NO: 52529 - DNA, 702 bp, Zea mays
  misc_feature: Ceres CLONE 1469620-F
  misc_feature: Encodes the peptide sequence at SEQ ID NO. 52530
  misc_feature (180)..(180): n is a, c, t, g, unknown, or other
  misc_feature (214)..(214): n is a, c, t, g, unknown, or other
  misc_feature (451)..(451): n is a, c, t, g, unknown, or other
  misc_feature (526)..(526): n is a, c, t, g, unknown, or other
ggagctccccgcggtggcggccgctctagaactagtggatcccccgggctgcaggaattcgtctcacccctagaaaaacatgcagaagtccgactacccgtcccgccgcctcatcatcctcggctccatcaccggcaacaccaacacgctggccgggaacatcccgcccaaggccgggcntgggcgacctccgcggcctcgcggcggggctgcngcggccagaacggctctgccatgatcgacggctccgagagcttcgacggcgccaaggcgtacaaggacagcaagatctgcaacatgctaacaatgcaggagctgcaccggcggtaccacgaggagacgggcatcacgttcgcgtcgctctacccggggtgcatcgccaccacgggggctgtcccgcgagcacatcccgctgttccggctgctcttcccgccgttccagaagtcgggnccccaaagggctttccctggtccgaaagccggaaattcccggcaaaaaagggctgggccccaaaggtggtttcanggaaaccccaccccctcccaattccggggggtgaaccggagacctggaaaaaagaacccggggggcctttcaaaaacccctttgtcccaggagggcccccggttcccgaaaagggccaaaaaaccccgggaaataaccaccaaaaaaccccgggggggttgtcccaaaaccccccc

SEQ ID NO: 52530 - protein, 156 aa, Zea mays
  misc_feature: Ceres CLONE 1469620-F
  misc_feature: SWISSPROT Homolog: EC 1.3.1.33 Protochlorophyllide reductase
  misc_feature (73)..(73): Xaa is any aa, unknown, or other
  misc_feature (98)..(98): Xaa is any aa, unknown, or other
MIDGSESFDGAKAYKDSKICNMLTMQELHRRYHEETGITFASLYPGCIATTGAVPRAHPAVPAALPAVPEVGXPKGFPWSESRKFPAKKGWAPKVVSXKPHPLPIPGGEPETWKKEPGGPFKNPFVPGGPPVPEKGQKTPGNNHQKTPGGLSQNPP

SEQ ID NO: 52531 - DNA, 690 bp, Zea mays
  misc_feature: Ceres CLONE 1469627-F
  misc_feature: Encodes the peptide sequence at SEQ ID NO. 52532
  misc_feature (381)..(381): n is a, c, t, g, unknown, or other
  misc_feature (436)..(436): n is a, c, t, g, unknown, or other
  misc_feature (439)..(439): n is a, c, t, g, unknown, or other
  misc_feature (531)..(531): n is a, c, t, g, unknown, or other
ggagctccccgcggtggcggccgctctagaactagtggatcccccgggctgcaggaattcgtctcacccctagaaaaaagcccaaaggagacttcacaaagagtatagctgtatctctatagctctatagcgccgatagatccatcctctctttccactcctagctagctaacatatccacacatggcggccagttccaaggtcgtgtgcgcatgcattctcatcgttctcgtcatctcaagccacgccgacgcgaggcggctggtggcggcgacgtgcaacggaacggaaggcggagcatgcaagggtggcatcttcgtccaaggatatgcaggcctcagtgcaaggcagaaaatgggcgccactgctacgagcactgancaggtcgtcggcggcggcggcgaaagcatgccggcgaacaccacggactcccggnccntacgctccggcaacagccccggtattggcaccaaggaaaaatcaacactagtttaattgccgtgggtgttcttgtatgcgttcttatctaantaataagcatccatttaactgaatgctagtaccccaaccgccggaccccgttattattgggaaacaaaggcttggcggccaccgcccccaaattagggcccatttccccttttccattggaaataaagttcccaaagggcccccccccggggaaaaagg

SEQ ID NO: 52532 - protein, 103 aa, Zea mays
  misc_feature: Ceres CLONE 1469627-F
  misc_feature (66)..(66): Xaa is any aa, unknown, or other
  misc_feature (85)..(85): Xaa is any aa, unknown, or other
  misc_feature (86)..(86): Xaa is any aa, unknown, or other
MAASSKVVCACILIVLVISSHADARRLVAATCNGTEGGACKGGIFVQGYAGLSARQKMGATATSTXQVVGGGGESMPANTTDSRXXRSGNSPGIGTKEKSTLV

SEQ ID NO: 52533 - DNA, 618 bp, Zea mays
  misc_feature: Ceres CLONE 1469629-F
  misc_feature (197)..(197): n is a, c, t, g, unknown, or other
aagctggagctccccgcggtggcggccgctctagaactagtggatcccccgggctgcaggaattcgtctcacccctagaaaaactttcagacaatgccacaaacaacatcagcagttgcactttgggttgtccaattggatgccctcattgcgccttatttggataatgcccatgacagacagctggtgaatgctangtagcttacgaagatggatttctttgcgtgatgcacaagcaccccgagctgacttctttttcttgcaccaatctgcagttttttccttgatgaaagctttccatcctagggaaaacgaaacatggggtctgctttgaagtccaaaaacaaaactttgcgacttgctttaaagcaaggaaaaattgttcccctcccacaaaaactttgcccaaaaaaaaaaaaaaaaatttttgtaaaaaaacccggccccccaaaaaggaaaaaatttgggtttcccctggagggccccacatttggggagttggggccctttttttgaaaaaaaaaccccccttttttcaaagagggggggctgtttttggaaaaatataaaaaacacaaggcgccccccttttttttttacaaaggggggggtggtttt

SEQ ID NO: 52534 - DNA, 657 bp, Zea mays
  misc_feature: Ceres CLONE 1469630-F
  misc_feature: Encodes the peptide sequence at SEQ ID NO. 52535
  misc_feature (317)..(317): n is a, c, t, g, unknown, or other
  misc_feature (510)..(510): n is a, c, t, g, unknown, or other
ctggagctccccgcggtggcggccgctctagaactagtggatcccccgggctgcaggaattcgtctcacccctagaaaataccgccgccgccccctacgccagcttcccagctcttcgtcaggcccttctccgtcaacgagcacccagcacatatcctgagcccctccacgcctcaacgatggcgggattcagaagccttgcacccaagaccaggaacctggtggtggctgggggcctgtcggccttcgtgctcggggtctactactacaccatgagagccgtgggaggcacggacgagctgcaggtggcgatcgancagtttgaggagatgaagaagaaggacgctgccagaaactccagcacaggaggatcgtaaacgcggcgcccttctcgtctctgtactgaacctggatctgcaggctgacatgatacggtagtcaagtcgctcagtaggcccagaacatgcgtgcctctactgtgcataaataaatgggggatactccttaccnaatagagcttggcagcttgtgctttaaaggaaaatgtaccctccgagggttttggccctatgaaataaaagggggcccaagggctaaaaaaaaaaaaaaagaaaacgctcgggggacccatttcccccttaaggggggcgcattacc

SEQ ID NO: 52535 - protein, 65 aa, Zea mays
  misc_feature: Ceres CLONE 1469630-F
  misc_feature (46)..(46): Xaa is any aa, unknown, or other
MAGFRSLAPKTRNLVVAGGLSAFVLGVYYYTMRAVGGTDELQVAIXQFEEMKKKDAARNSSTGGS

SEQ ID NO: 52536 - DNA, 648 bp, Zea mays
  misc_feature: Ceres CLONE 1469635-F
  misc_feature (175)..(175): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (281)..(281): n is a, c, t, g, unknown, or other
  misc_feature (282)..(282): n is a, c, t, g, unknown, or other
  misc_feature (284)..(284): n is a, c, t, g, unknown, or other
tggagctccccgcggtggcggccgctctagaactagtggatcccccgggctgcaggaattcgtctcacccctagaaaaagatttcttcacccgtccacctcgtcttgcgctcctctgtctcggcgacgaatgtgctaacgccgccgccgccgcaagacttcttcggggactttgncggcgacgatttcccacccgccccacaggatcagaagaagtgatggcgaggagtgacagctgcctggcgcgcgtgtgtggnnngattgctatctgtggcgcggtcnngnggagaggccgtaaacttcttccctaaacccctaacactaagtttaggcatcaatccgtccgtgcgagccgcttcacccgtcggtgttttttttttttggtggaagtagattagtgtgcgatttcaggaatcttctcgagctagctagtaactacatccctggggttgggtgggtagctagcgggcagatggtataactaggttgccttttggttaagaggtaccaggggcttagggagcatccatctggaagggggaaaaataccaatgccccgagtttggaatttggttttgcccccccattggctttggggcccccaaagggggtggtgtggccggaataccccccccccccccgggggttg

SEQ ID NO: 52537 - DNA, 663 bp, Zea mays
  misc_feature: Ceres CLONE 1469638-F
  misc_feature: Encodes the peptide sequence at SEQ ID NO. 52538
  misc_feature (513)..(513): n is a, c, t, g, unknown, or other
ggagctccccgcggtggcggccgctctagaactagtggatcccccgggctgcaggaattcgtctcacccctagaaaaaacacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgaatcagttgtagctggtgaatttggcaagactcaatttctctcatctgagttcagaaacgtttgcttggtctcctgcttcccttgagtcttgccaaccatagttttctctcatctctttctgtgacttgacaacatctctttttggtcctgtcagtctcgcaatactcccttccnaagacttgtctagaggttggattgccctgctctctgctggcactgcagcctgctgaaatctttactggctgcatcctgggctcacctttgaagctgctctcttctgctctgcgttggttgattctgcactcaaacttctcttggctgtgc

SEQ ID NO: 52538 - protein, 29 aa, Zea mays
  misc_feature: Ceres CLONE 1469638-F
MSAEVAGGHPYFLSCYFWFIYCIKFRDFT

SEQ ID NO: 52539 - DNA, 833 bp, Zea mays
  misc_feature: Ceres CLONE 1469642-R
  misc_feature: Pfam Name: DHHA1 Pfam Description: DHHA1 domain
  misc_feature: SWISSPROT Homolog: EC 6.1.1.7 Alanine--tRNA ligase
  misc_feature (1)..(1): n is a, c, t, g, unknown, or other
  misc_feature (660)..(660): n is a, c, t, g, unknown, or other
nccgattgggtacctcgagcgtctcgtttttttttttttttttcttcaatcgggcacacaacaagctttatactgttacatgtcctgtgcttccaattgtatggtaagtataaatgaaactgcaagcaccattgaacttctgtttaagtataatgggtaaatagaaagctaaaatcaaagagtaatccagcagcagccacgcatgagttccatgggcagtgcaccagttactaccaccaatcagcagagcttcattgaagcaatgctgttcgcaagtgccattgcttccttgagctgagaagcgtcactcccctggccctgggcgacgccgttcttgccgccaccgcctcttcccttgagtggcgcaattgaaggtgttagccagtccaacaccttgaagccgctaggagcattgggaggcacaccagcatagataacggctttgtttgatgcctcatcggtgctgaataacattataggcaaacccttctggtccatgactttgataaccgcctcacggacagccgtggtatcaagacccacatccacatgagtaacacaaaacggtttatttcctgaaagagcagcttctgcagcatccattgcggacttcacagccttttgtatattttgctcccccattttcttctttgccttccntaagtcgtcctctaactttgaaaccttgcctctcaaatcagcttttctcgcagcagggatagcagctgcatccagcccactcttgatggaaagcaaatttcttttccaacaagctccctccaactgagatgctttattgatatcagaatcgatagatgacggcaactccataa

SEQ ID NO: 52540 - DNA, 655 bp, Zea mays
  misc_feature: Ceres CLONE 1469642-F
  misc_feature: Encodes the peptide sequence at SEQ ID NO. 52541
  misc_feature (509)..(509): n is a, c, t, g, unknown, or other
  misc_feature (614)..(614): n is a, c, t, g, unknown, or other
tcaccgcggtggcggccgctctagaactagtggatcccccgggctgcaggaattcgtctcacccctagaaaaaatgggtggatgctgaccgtgccgaccctcccacgcgcgtgccgcctgcttcgtctcttcactcgtctcgaagctagggttttgcccgccgccaccatcctagtttccttctcgtcatcgttctcatcttccccagccgccgccccgcctcagatggatccgtcgccggcgtggccgtcccggcggatccgccaggagttcttaaccttcttcgagtccaacgcacatacgaggtggccgtcgagtcccgtggtccccgtcgacgaccccacgctgctgttcgccaacgctggaatgaaccagttcaagccggtcttcctcggcacagcggcgccggactcgccgctcggccgcctgcaccgtgcctgtaacacccaaaagtgcatccgcgccggcgggaagcacaacgacctcgacgacgtggggaatgacacctnacaccataccttcttcgagatgcttgggaactggtctttcggggactatttcaaggaggaggccatcagatgggcctgggagcttctcacccaggtatataattngcccaccgatagaatttatgccacatacttttggtgtgatg

SEQ ID NO: 52541 - protein, 143 aa, Zea mays
  misc_feature: Ceres CLONE 1469642-F
  misc_feature (11)..(143): Pfam Name: tRNA-synt_2c Pfam Description: tRNA synthetases class II (A)
  misc_feature: SWISSPROT Homolog: EC 6.1.1.7 Alanine--tRNA ligase
  misc_feature (95)..(95): Xaa is any aa, unknown, or other
  misc_feature (130)..(130): Xaa is any aa, unknown, or other
MDPSPAWPSRRIRQEFLTFFESNAHTRWPSSPVVPVDDPTLLFANAGMNQFKPVFLGTAAPDSPLGRLHRACNTQKCIRAGGKHNDLDDVGNDTXHHTFFEMLGNWSFGDYFKEEAIRWAWELLTQVYNXPTDRIYATYFWCD

SEQ ID NO: 52542 - DNA, 650 bp, Zea mays
  misc_feature: Ceres CLONE 1469643-F
  misc_feature: Encodes the peptide sequence at SEQ ID NO. 52543
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
cgcggtggcggccgctctagaactagtggatcccccgggctgcaggaattcgtctcacccctagaaaaacccgccagcatctccctccgagtccagggggcaggggcaccattaccgagtagtttaattagtgctagttgtattaccgttgttagtgacataattaccctcacgcgaagaacccctaccttggctagtcctcctacgtatacgtctcttctcttcgcttaatcttggtcggtgatttgattctgcacttcttgggcgcattgcagagggtgctcggtctgcagctatcttaggttaaccagtcgtgtgtggtctatcggtttcgatatagtactactgctctgttataatcagcggggaggaggaagatgacggtgacgccacggatcacggtgagcgacgggcggctgacggtgcgcggccgtacggtgctcaccggcgtgccggacaacgtgtcggcggcgcacgcggccggggcggggctcgtcgacggggccttcgtcggcgcccacgccggcgaggccaagagccaccacgtcttcaccttcggcacgctccgggactgccggttcctgtgcctgtccnnngttcagctgtggtggatgacgcagcggatgggcgtctccggccgcgacgtcctt

SEQ ID NO: 52543 - protein, 91 aa, Zea mays
  misc_feature: Ceres CLONE 1469643-F
  misc_feature (73)..(73): Xaa is any aa, unknown, or other
MTVTPRITVSDGRLTVRGRTVLTGVPDNVSAAHAAGAGLVDGAFVGAHAGEAKSHHVFTFGTLRDCRFLCLSXVQLWWMTQRMGVSGRDVL

SEQ ID NO: 52544 - DNA, 637 bp, Zea mays
  misc_feature: Ceres CLONE 1469646-F
  misc_feature: Encodes the peptide sequence at SEQ ID NO. 52545
  misc_feature (637)..(637): n is a, c, t, g, unknown, or other
cgcggtggcggccgctctagaactagtggatcccccgggctgcaggaattcgtctcacccctagaaaaaaacccaagccactctcccccgtttctaggcttcacagcctcgccaacaactcccgtcctccacttgcccttctccgccaacagactgtccccggccgctgccattgccgattgctcacatccgcgttcgtgttcgcatccgcatcagggtcacctgcgccggcgagccatttgaaagggaggagtagcagactctcagaggtggacatgacgctgttgtgcgtgccgctggtggggcggacggtggaggagatgattacagacgcggcggcggccgccgccaccggcggcgacatggtcgagatccggcttgacttcatccaggggttccgcccgcgtgagcacctaccgcccctgctccgcggctgcccactcccggccctcgtcacctatcgacctgtctgggaaggagccaatatgaaggtgatgacacccaagatttgagaactacgtttagcaatgaaataggtgtagactatgttgatattgaattgaaggtgcaaacaaattatgagctttattgctggccataggcagagaaatgtaaacttatgtttctcacataattn

SEQ ID NO: 52545 - protein, 78 aa, Zea mays
  misc_feature: Ceres CLONE 1469646-F
  misc_feature: SWISSPROT Homolog: EC 4.2.1.10 3-dehydroquinate dehydratase
MTLLCVPLVGRTVEEMITDAAAAAATGGDMVEIRLDFIQGFRPREHLPPLLRGCPLPALVTYRPVWEGANMKVMTPKI

SEQ ID NO: 52546 - DNA, 650 bp, Zea mays
  misc_feature: Ceres CLONE 1469648-F
  misc_feature: Encodes the peptide sequence at SEQ ID NO. 52547
acccgcggtggcggccgctctagaactagtggatcccccgggctgcaggaattcgtctcacccctagaaaaaaaaagagcagccacttggatccggtgctcagcggaacagctagctatagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagcctctggtgctgcccgcgcaccacagcaatgtcgtcggctcgcgcctgtcgtcgccgtcgccctcggcggccgccgccagcaggaggaccggcggcggcgtgtcctcccggtccggctcccggcggcccgtgcggctgccgaggatcagctgcagcgccaccgaagaggtcagcggcgccgtgtcgtccgtcaccgtggagaggatgctgacggtgacggcgtcggtggaggcgtcgccggccatcgggcagatgtacttccagcgcgccgtcgacgacgtcggcgacctattcggcaagacgctgctgctggagctcgtcagctccgagctcgacgcaaagtcgggcgtg

SEQ ID NO: 52547 - protein, 125 aa, Zea mays
  misc_feature: Ceres CLONE 1469648-F
  misc_feature: SWISSPROT Homolog: EC 1.13.11.12 Lipoxygenase
MMNLNLKQPLVLPAHHSNVVGSRLSSPSPSAAAASRRTGGGVSSRSGSRRPVRLPRISCSATEEVSGAVSSVTVERMLTVTASVEASPAIGQMYFQRAVDDVGDLFGKTLLLELVSSELDAKSGV

SEQ ID NO: 52548 - DNA, 799 bp, Zea mays
  misc_feature: Ceres CLONE 1469649-R
  misc_feature: Translation starting site: 118
  misc_feature: SWISSPROT Homolog: EC 1.14.15.3 Alkane 1-monooxygenase
ctgatcgataaggtacaaaagtgtactgctaatcgtctgtgataagcagcaaaaacattgcgtgtcctcatgaatttcaattatatataatttatgtataataggaactaaataatcatgattttaatttgtcgtacttacatgaggagggttaaatatatttataatactggatcaccagaaggatcgagtggagtaacagcagcgacaatgggttccggatcccctcttctcctcaccgtcacgttgagcccgccggccatgtgcgccgtcatcagcggcatgaacaccggcacgcggccctcgtcaacgggcaccatctcgaaccgccggagcacggagctggccacgaacttcatctgcacaaaggccatctccttgccgaggcacctccgcggccacgcctggaacaccgggtacttgaacggacacacaccagccaccgcggcggggggcgcgttgtcctcccctatggacagccagcgctgcacgctgaactcggcggctttggccccccagatggactacatccgccccatcccgtactggaagtatgtgacacggtcgccgcgctccacgcgtgtgccatccggcagcatgtcccccgccgcagcgtgcttggagtcccacgccaccggcgggtacagccgcatagtctcgcacaggggctcgtggagaacaatcatcttgccctgcgcgcctgcggggtggtctcctgcggcgccacccgtggactcccgatggacctccgttccacgtcgctgtgggggggttgagccccccaaataaccctgctcaa

SEQ ID NO: 52549 - DNA, 630 bp, Zea mays
  misc_feature: Ceres CLONE 1469658-F
  misc_feature: Encodes the peptide sequence at SEQ ID NO. 52550
  misc_feature (454)..(454): n is a, c, t, g, unknown, or other
  misc_feature (491)..(491): n is a, c, t, g, unknown, or other
  misc_feature (502)..(502): n is a, c, t, g, unknown, or other
  misc_feature (527)..(527): n is a, c, t, g, unknown, or other
  misc_feature (541)..(541): n is a, c, t, g, unknown, or other
  misc_feature (581)..(581): n is a, c, t, g, unknown, or other
  misc_feature (630)..(630): n is a, c, t, g, unknown, or other
gcggtggcggccgctctagaactagtggatcccccgggctgcaggaattcgtctcacccctagaaaaactcgtgtccgatggctcgcccccgccgcctcctctgacggtctgactgacccccgcctccccggagagcggctccgctgtctcgccggatatggcgccgcctcgtccccctcctaacccggcgggggagcagcagccgcagctccacggggtggtcatcatcacgctccctcccgcggaccagccctccaagggcaagaccgtcaccgccttcgcctacaccaacgaccccccgccccctcgctcgcccccggatccggttatggggtacccggcggcaacggaggctaggcggcggccgaggcgggcgctctcgacgcggcgggtggcgacggcggcgctcgtgctgggcgcgctcgcggtcgccgcctactactgcttctactncgacgtggccgtgcagttcctggggatggagcagganggagagcaaangaacgagaccaggtctttcctgctngcgctctaccccanggcgcgtcagggccgcgccctgcgcgagttcggggacgtncagctcgccgccaggagggtagacgacggcgggaagaaagctaggaacn

SEQ ID NO: 52550 - protein, 157 aa, Zea mays
  misc_feature: Ceres CLONE 1469658-F
  misc_feature (99)..(99): Xaa is any aa, unknown, or other
  misc_feature (111)..(111): Xaa is any aa, unknown, or other
  misc_feature (115)..(115): Xaa is any aa, unknown, or other
  misc_feature (128)..(128): Xaa is any aa, unknown, or other
MAPPRPPPNPAGEQQPQLHGVVIITLPPADQPSKGKTVTAFAYTNDPPPPRSPPDPVMGYPAATEARRRPRRALSTRRVATAALVLGALAVAAYYCFYXDVAVQFLGMEQXGEQXNETRSFLLALYPXARQGRALREFGDVQLAARRVDDGGKKARN

SEQ ID NO: 52551 - DNA, 651 bp, Zea mays
  misc_feature: Ceres CLONE 1469660-F
  misc_feature: Encodes the peptide sequence at SEQ ID NO. 52552
  misc_feature (391)..(391): n is a, c, t, g, unknown, or other
  misc_feature (481)..(481): n is a, c, t, g, unknown, or other
  misc_feature (540)..(540): n is a, c, t, g, unknown, or other
ggagctccccgcggtggcggccgctctagaactagtggatcccccgggctgcaggaattcgtctcacccctagaaaaaggttagcagactgcagacctagcaggctagcaaccattctagctccgaattcggagcaggcgagggcgaactgaccgaggcgaggacgatcactgtccatgtccatggaggcggcggttggggcggagttcggacctcatctgcatcccgctctcgggttcagacacagccagcgccgtgtctttttttgctgttggcgcctgcatccgccccggccggcctcgcttggcctctgcggtggcgggggagcccgtccccgcggcgctatccccgtcgcggatggcgaccagcggcgggggggtgcgagagctcnaggcggaggcggaagcggaacctggatcgatcttgggtcctccgaggagcagcccccgcgaggtgagggaagagatgggccggtgcttcnacctcgtccgccgcctcggtaggggcgccgtctacctcggctcctccagggtccgccanggcaccggatttcctccaaacaccgagctcgccaaaagatagctcggttgctcggctggacaccatggacggaagccggcccggggctcctggatgctgccctccagggcg

SEQ ID NO: 52552 - protein, 108 aa, Zea mays
  misc_feature: Ceres CLONE 1469660-F
  misc_feature (72)..(72): Xaa is any aa, unknown, or other
  misc_feature (102)..(102): Xaa is any aa, unknown, or other
MSMEAAVGAEFGPHLHPALGFRHSQRRVFFCCWRLHPPRPASLGLCGGGGARPRGAIPVADGDQRRGGARAXGGGGSGTWIDLGSSEEQPPRGEGRDGPVLXPRPPPR

SEQ ID NO: 52553 - DNA, 660 bp, Zea mays
  misc_feature: Ceres CLONE 1469674-F
  misc_feature: Encodes the peptide sequence at SEQ ID NO. 52554
ctccccgcggtggcggccgctctagaactagtggatcccccgggctgcaggaattcgtctcacccctagaaaaagccaaaaaaatcctttcttgtctggggtccagctttgtcacgagccactgcatccaggaggaggaggcggcggcggcgttacctgccctgctccggtcgactggctcccgggagttcggagccgagatctcgccaggccccggtcggcggcggcgttgtgggaaacaggatgggggatctgcccgcgctgcgcctgtggctctgcttgctggcggcaatggcggcggccgcgtcggcgccgtggccggcggatgcgctggggatgaactggggcacgcaggccacgcacccgctgccgcccaagatcgtggcgcagctcctcagggacaacggcatcaagaaggtcaagctgttcgacgccgaccaggacacgctcagcgcgctcgccggcaccggcatcgaggtcatggtcgccatccccaacgtcatgctcgacaccatgacggactacgacaccgccaaggagtgggtgcgccggaacgtgtcccgctacaacttcgacggcggcgtcaccatcaagtacgtggccgtgggcaacgagccgttccttgcggcctacaacggcacgttcgacaaggtgacgttc

SEQ ID NO: 52554 - protein, 139 aa, Zea mays
  misc_feature: Ceres CLONE 1469674-F
  misc_feature: SWISSPROT Homolog: EC 3.2.1.39 Glucan endo-1,3-beta-D-glucosidase
MGDLPALRLWLCLLAAMAAAASAPWPADALGMNWGTQATHPLPPKIVAQLLRDNGIKKVKLFDADQDTLSALAGTGIEVMVAIPNVMLDTMTDYDTAKEWVRRNVSRYNFDGGVTIKYVAVGNEPFLAAYNGTFDKVTF

SEQ ID NO: 52555 - DNA, 664 bp, Zea mays
  misc_feature: Ceres CLONE 1469675-F
  misc_feature (614)..(614): n is a, c, t, g, unknown, or other
  misc_feature (616)..(616): n is a, c, t, g, unknown, or other
  misc_feature (664)..(664): n is a, c, t, g, unknown, or other
ggagctccccgcggtggcggccgctctagaactagtggatcccccgggctgcaggaattcgtctcacccctagaaaaattgacacaatccattattccttccccttcgtttcgtttattccccacttccacacggccacaccgccacagccgccgccgccggacggcgctgtccttccctgggaggcgctccactaggctcggctcagctcacgcgcggcggcggtgtccgtggctgctgggcttgcgcgcgcacctgattccgtgctgggcttcgcgaggtgctcctcgtgcgagacacacgcccgatgcggcggaatcgcgcggccggcgcccgagacccggcgtgattcggtggggaggctgggacgcggtgcttccgcgtgcgggaaccagtgacttttttattcttctcttccccagcggctcgggcggctagagggcgggccgcttggtgttcgtcagcgcgtgaggcggagattacccggcgccgatctggtgctcttgccgcccggagaagtggtgccgggggccattgccgggttctgattaggaggaagcggaggaggtaagtccctagtcttatggggctcgcgcccgcggagctggggcagntnacagtgggaaaaacttcccggggagcaaaaggactctgggggctggtn

SEQ ID NO: 52556 - DNA, 695 bp, Zea mays
  misc_feature: Ceres CLONE 1469681-F
  misc_feature: Encodes the peptide sequence at SEQ ID NO. 52557
  misc_feature (398)..(398): n is a, c, t, g, unknown, or other
aaagctggagctccccgcggtggcggccgctctagaactagtggatcccccgggctgcaggaattcgtctcacccctagaaaaaacacaccaccactccctccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaccacccgcaacaagtggtgtctctggtgatngccgctatttctcaaaagatgctgttcagatcataacaaaaatggctgctgccaatggagaaagaagtggttggggttggacaaaacaatctcctgtccacccccggctggatctgctggcctccgcggaagaattggtgccaatggatccaagggttatgggggcctttctttgggcagggaggcctaaacccaggtgggccctaggaggaatttcggaaaccaataacaaatggggaaaagggggggccccgctccctaaaccgggtaccccaaacaaattttcctctataaaag

SEQ ID NO: 52557 - protein, 162 aa, Zea mays
  misc_feature: Ceres CLONE 1469681-F
  misc_feature: SWISSPROT Homolog: EC 5.4.2.2 Phosphoglucomutase
  misc_feature (64)..(64): Xaa is any aa, unknown, or other
MGLFTVTKKATTPFDGQKPGTSGLRKKVTVFQQPHYLQNFVQSTFNALPVDQVPPATSGVSGDXRYFSKDAVQIITKMAAANGERSGWGWTKQSPVHPRLDLLASAEELVPMDPRVMGAFLWAGRPKPRWALGGISETNNKWGKGGAPLPKPGTPNKFSSIK

SEQ ID NO: 52558 - DNA, 418 bp, Zea mays
  misc_feature: Ceres CLONE 1469724
  misc_feature: Encodes the peptide sequence at SEQ ID NO. 52559
aaacttagaaaggggccggccggccggccgggatcgatgtcgaaaatgttccgcggcaacaacaaccctagtagcaattacgagctgccagtggagagcgtggtgagggtgaagaaggtggagaggatcgaggcgaacaacctggtcagcaagcccaagccgtcgcagaccaaggtgaccaggagcctgaccgtcagcgttgtccgggtcggggacgtggacgaaatgcccgacgacagccacagcagctttgtctcggtgcctattgctgcgcatacctaattaattaataagtgatcaccagttcaccaccgctcctgtctgtctgtcatatagtaaagccgttttcgtttcttgttgtataattaaataaccttatatatgcaacttttcgattttctaaaaaaaaaaaaaaaaa

SEQ ID NO: 52559 - protein, 81 aa, Zea mays
  misc_feature: Ceres CLONE 1469724
MSKMFRGNNNPSSNYELPVESVVRVKKVERIEANNLVSKPKPSQTKVTRSLTVSVVRVGDVDEMPDDSHSSFVSVPIAAHT

SEQ ID NO: 52560 - DNA, 633 bp, Zea mays
  misc_feature: Ceres CLONE 1469741-F
  misc_feature: Encodes the peptide sequence at SEQ ID NO. 52561
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
aagctggagctccccgcggtggcggccgctctagaactagtggatcccccgggctgcaggaattcgtctcacccctagaaaagcaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttcctcagtggttccctttaaccttaatgaaagaaattttttctctcccaaaaaaacctttttnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnt

SEQ ID NO: 52561 - protein, 59 aa, Zea mays
  misc_feature: Ceres CLONE 1469741-F
MKGDYYRYLAEFKTGAERKDAAENTMVAYKAAQDIALAELAPTHPIRLGLALNFLSGSL

SEQ ID NO: 52562 - DNA, 638 bp, Zea mays
  misc_feature: Ceres CLONE 1469743-F
  misc_feature: Encodes the peptide sequence at SEQ ID NO. 52563
ccccgcggtggcggccgctctagaactagtggatcccccgggctgcaggaattcgtctcacccctagaaaaaacttcaattggcgttggccgaagaagaggagaagcgaagcaagcaggcttcgagaacaagactgcagggggagggggaggaccaagcgaaaggggaactagagcaagatgggcggcgcactgctgcttgcgctcctcctcgtctctgctgctgccgcccctcaggaggacatcatcgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgctagatctgcatggtcccgttgcagcacaattgggaacatacttgatcaaggtcactgtggctcttgttgggcttttggtgctgtggagtgcctccaggaccgtttttgcattcacctcaacatgagcattttactttcagtcaatgacctactggcatgctgcggttttatgtgcggcgatgggtgtgatggaggctatcctatagag

SEQ ID NO: 52563 - protein, 153 aa, Zea mays
  misc_feature: Ceres CLONE 1469743-F
  misc_feature (19)..(61): Pfam Name: Propeptide_C1 Pfam Description: Peptidase family C1 propeptide
  misc_feature: SWISSPROT Homolog: EC 3.4.22.1 Cathepsin B
MGGALLLALLLVSAAAAPQEDIIETVNNHPSAGWTASRNPYFSNYTIAQFKHILGVKPAPQNALSNVPVKTYSRSLELPKEFDARSAWSRCSTIGNILDQGHCGSCWAFGAVECLQDRFCIHLNMSILLSVNDLLACCGFMCGDGCDGGYPIE

SEQ ID NO: 52564 - DNA, 632 bp, Zea mays
  misc_feature: Ceres CLONE 1469746-F
  misc_feature: Translation starting site: 136
  misc_feature (210)..(210): n is a, c, t, g, unknown, or other
  misc_feature (212)..(212): n is a, c, t, g, unknown, or other
  misc_feature (218)..(218): n is a, c, t, g, unknown, or other
  misc_feature (221)..(221): n is a, c, t, g, unknown, or other
  misc_feature (222)..(222): n is a, c, t, g, unknown, or other
  misc_feature (242)..(242): n is a, c, t, g, unknown, or other
  misc_feature (257)..(257): n is a, c, t, g, unknown, or other
  misc_feature (263)..(263): n is a, c, t, g, unknown, or other
  misc_feature (266)..(266): n is a, c, t, g, unknown, or other
  misc_feature (275)..(275): n is a, c, t, g, unknown, or other
  misc_feature (293)..(293): n is a, c, t, g, unknown, or other
  misc_feature (317)..(317): n is a, c, t, g, unknown, or other
ggagctccccgcggtggcggccgctctagaactagtggatcccccgggctgcaggaattcgtctcacccctagaaaaagcccacttctctcccacctcccctccactcttttgcctgtcgcggggttagaatcccatggcgctgtcgtccgagatccgcttcggccaccagatccccctatcccactgcgacactgactcctacgaagangnaagaanaannaagagaggaagacaggaagnatttccaggggggangaagangangaaatttgnttaaggttcccgtttttnttccggtgtttggtttcgggaaangaaggcaagggaagggtggtccccgggcccagaatgggggccggggccgcttcccgaagtccctccatgctgtggagaaaaaaacgccccggcgcccggggtgtggccaacccgaaaaaggaagaaagaagggggcaaatcccccccgggggtatgacgaaaaaggggggggcaacccgaagtgtgggggaatttttcccaggtaaacctttaaacgaattttttggggtttcttcgggcgcccccccttgaatacctacccccccagggccttcccccccccggccaaaggcccccgggagggcgaattttttg

SEQ ID NO: 52565 - DNA, 841 bp, Zea mays
  misc_feature: Ceres CLONE 1469748-F
  misc_feature (31)..(31): n is a, c, t, g, unknown, or other
  misc_feature (38)..(38): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (55)..(55): n is a, c, t, g, unknown, or other
  misc_feature (56)..(56): n is a, c, t, g, unknown, or other
  misc_feature (841)..(841): n is a, c, t, g, unknown, or other
aaataaggaggggggagagccggagaaaggngggaggngnggtnnnaccctgttnnttagaggaggtgctccccgtggtggccgctccactatagtggatgcaccccggtgcaggaagtagtctcacccctccaaaaagaagtcctgttcacaaagccggcgccttttgctccccaatctcatgtcctgcccacctctaagctcccaaggcgacgctgcggcggcgcgacaatcgcaacccctacacccggacttgtctacctggctcagactaaccctttccctcttttcttgcttacccccttcaggacacccggcagtgccaggtactgccccggcattggagatgtgattggaatgccacgagcgcccaccaaataaagactaggcgcaccccgcggagccctattggggttgggatgtgagttcccccgtggtgggggggtgggggacccggcccccccacccaccagtgtttgggttaggtgcgactcccccccaacctttcttttgttgagggtgtggccgaggggtctagccgagagaacacctctgcgatagtgggcctattctgtttccccccgcggtgtgggcgtgggccggcacacacaatgagatatacggtgtgacccccgtctccaaccatattcgttttttgtacagggggacttactcagaccccccacaaaaccttgggtctttgaggtgggtgtgggactcctgtgccccacccccctccactacaaatttgcacagggggaggtatacatggtgcccctcccccccctcctcatattatttggtgtctcacgtttgtgtactttcataaagtaaggagatn

SEQ ID NO: 52566 - DNA, 793 bp, Zea mays
  misc_feature: Ceres CLONE 1469749-F
  misc_feature: Encodes the peptide sequence at SEQ ID NO. 52567
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
gaagggggggagggcggggggcagaggccaatcccgttcctttgggagggnnnncaaagtgggggtctccgcggtggggggcgctctacaatagtgggtgcccccggctgcaggaatgtcgtctcacccctacaaaaaaatgaccactgtgccgcgccgtgctgaccgagctttctaccacacagaaagactatggccgcgtctgcgctgcaccgtaccaccgggttcctcgggaattccctgttcgcccccgccgccggcgtcgatgccgggggccgcatcaccatgaggcggaggtcgagaggattccgaagagcgtccggtacgggcgtgggcgcgagagttatgttggggggggtagccgagcagacgccggcgtaccggagcgtgcgagggttacggctgctatcgctgctgagtgcgggagttgttttttgggggcccggaacaccttctggttgggagccggtgggcagcacctcttttgggttgccggggggtggcgacgcgggggggacgtctgggcgggccggattccacggggggactcgcggcgttagggaggagggggccaagtaaagtatcggggtgtccgagcggggggggcccagagggggggggtacgcgcccaagatgagttggcctggctcttggcgcaggcgagtgtggagcgctccccgcaagggcgggggcccggcggaaaaatgcgggcgcaacaatccttaaatatttaggttggggggggggggcgggcgagcaagagttctgggtgtctggtagagcccgatggggg

SEQ ID NO: 52567 - protein, 128 aa, Zea mays
  misc_feature: Ceres CLONE 1469749-F
MAASALHRTTGFLGNSLFAPAAGVDAGGRITMRRRSRGFRRASGTGVGARVMLGGVAEQTPAYRSVRGLRLLSLLSAGVVFWGPGTPSGWEPVGSTSFGLPGGGDAGGTSGRAGFHGGTRGVREEGAK

SEQ ID NO: 52568 - DNA, 650 bp, Zea mays
  misc_feature: Ceres CLONE 1469760-F
  misc_feature: Encodes the peptide sequence at SEQ ID NO. 52569
  misc_feature (368)..(368): n is a, c, t, g, unknown, or other
  misc_feature (369)..(369): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (376)..(376): n is a, c, t, g, unknown, or other
  misc_feature (382)..(382): n is a, c, t, g, unknown, or other
  misc_feature (394)..(394): n is a, c, t, g, unknown, or other
  misc_feature (580)..(580): n is a, c, t, g, unknown, or other
tggagctccccgcggtggcggccgctctagaactagtggatcccccgggctgcaggaattcgtctcacccctagaaaaaatcctctcctcacgggctcacggccgggagcgagtagatggaagcaggcagcggcagaggaagcgtccacggccacgaccggcagcagcagcagcagacagcagagggtgaggatccgctgatctgaccagttccaaggcgcgcacgaggcgggagctctggaggccatggagagggaggccgccgatgaggaagaggaagaggtggcgtgcgactgctgcgggttcacggaggagtgcacgacgccgtacatcgcgggcgtgcgcgcgcggtacggcgggcgggacgnngnnnntngttctncggggaaacccncccggcaaggagctcggggcgcgcgtccccgcccatctctgccgccgaggcgctggaccggcacgcccgcgtctgccgcggggcgtccacgccgccggcgtcgcccgcgggcagcgccgacgacctcatcgccgcgctgcgcctgcttttgcgccgcaggctcgggtccccgccgcctgcgccggngccgaggaatgcgcgctccacgccgagcagcccgaggcgcgccgccgccgctggcatctccgtcgtggca

SEQ ID NO: 52569 - protein, 134 aa, Zea mays
  misc_feature: Ceres CLONE 1469760-F
  misc_feature (10)..(88): Pfam Name: DUF1677 Pfam Description: Protein of unknown function (DUF1677)
  misc_feature (41)..(41): Xaa is any aa, unknown, or other
  misc_feature (42)..(42): Xaa is any aa, unknown, or other
  misc_feature (43)..(43): Xaa is any aa, unknown, or other
  misc_feature (44)..(44): Xaa is any aa, unknown, or other
  misc_feature (46)..(46): Xaa is any aa, unknown, or other
  misc_feature (50)..(50): Xaa is any aa, unknown, or other
  misc_feature (112)..(112): Xaa is any aa, unknown, or other
MEREAADEEEEEVACDCCGFTEECTTPYIAGVRARYGGRDXXXXSXGKPXRQGARGARPRPSLPPRRWTGTPASAAGRPRRRRRPRAAPTTSSPRCACFCAAGSGPRRLRRXRGMRAPRRAARGAPPPLASPSW

SEQ ID NO: 52570 - DNA, 652 bp, Zea mays
  misc_feature: Ceres CLONE 1469775-F
  misc_feature: Encodes the peptide sequence at SEQ ID NO. 52571
  misc_feature (127)..(127): n is a, c, t, g, unknown, or other
  misc_feature (350)..(350): n is a, c, t, g, unknown, or other
  misc_feature (352)..(352): n is a, c, t, g, unknown, or other
  misc_feature (406)..(406): n is a, c, t, g, unknown, or other
  misc_feature (407)..(407): n is a, c, t, g, unknown, or other
  misc_feature (421)..(421): n is a, c, t, g, unknown, or other
  misc_feature (442)..(442): n is a, c, t, g, unknown, or other
  misc_feature (444)..(444): n is a, c, t, g, unknown, or other
  misc_feature (445)..(445): n is a, c, t, g, unknown, or other
  misc_feature (461)..(461): n is a, c, t, g, unknown, or other
  misc_feature (476)..(476): n is a, c, t, g, unknown, or other
  misc_feature (505)..(505): n is a, c, t, g, unknown, or other
  misc_feature (510)..(510): n is a, c, t, g, unknown, or other
  misc_feature (576)..(576): n is a, c, t, g, unknown, or other
aaatctggagctcaccgcggtggcggccgctctagaaatagtggatcctccggggtggaggagtttgtttcaccccttagaaaaaatcgagctcgaagcgaatccattcccgaatagcagctgaacngttacttttgcagctcgattcattctttagctgctcctagctcctagccctagctagtagctagccactccggtcgtgtagtcatcagccttctgatcgtcacccatggccactgccgaggtccagaccccgaccgtcgtggcgaccgaggaagcgccggtggtggagaccccggctccggccgccgccgtgcccgaggaggctgctcccgccgccgaggccnangtggaggagccagctgcccccggcgagaccgagccagctgccgccgctgacccnngagcgcccccgtgncggcggagaagagacgccaangnnagagagacgcaaggangcggagcccgacccngacccgggcggcgctgaaaagtgaaggangaagncgcagcgcccgctgcgaaacgaagcagaacggcagccgctgaaccccagctgctgctgctgctaangacccgccgccgcttaaccggcccctgaagaccccagaaagccaaaccgcccccttaggtgcccaaaaaggcaacc

SEQ ID NO: 52571 - protein, 86 aa, Zea mays
  misc_feature: Ceres CLONE 1469775-F
  misc_feature (40)..(40): Xaa is any aa, unknown, or other
  misc_feature (59)..(59): Xaa is any aa, unknown, or other
  misc_feature (63)..(63): Xaa is any aa, unknown, or other
  misc_feature (70)..(70): Xaa is any aa, unknown, or other
  misc_feature (71)..(71): Xaa is any aa, unknown, or other
  misc_feature (77)..(77): Xaa is any aa, unknown, or other
  misc_feature (82)..(82): Xaa is any aa, unknown, or other
MATAEVQTPTVVATEEAPVVETPAPAAAVPEEAAPAAEAXVEEPAAPGETEPAAAADPXAPPXRRRRDAXXRETQGXGARPXPGRR

SEQ ID NO: 52572 - DNA, 676 bp, Zea mays
  misc_feature: Ceres CLONE 1469779-F
  misc_feature: Encodes the peptide sequence at SEQ ID NO. 52573
tggagctccccgcggtggcggccgctctagaactagtggatcccccgggctgcaggaattcgtctcacccctagaaaaaaaattgttgacagtagcgtggacgcatcgtcatcaatcgagcagaggggagggagagagatgaaggagggcacggcgaactgcatcgacatcctcatcgccatcatcctcccgcctctcggcgtcttcctcaagttcggctgcaaggtcgagttctggctctgcctcctgctcaccttcctcgcctatctccccgggatcatctacgcgatctacgttatcaccaaggactagccagatagcgccgtaaaccgggacaaggtgagagagctagctgatcagccagcggaggtaatggagatgaacgtactgctgagatcactttaatttgccctgttgctcaatgtttctggatggagactggatctcagctgtgatgttgctatatactaccgattgatcctgaaatttgtcgcttttcgttcgtgtctgcatagtatgtgatgcatagtctggatcatttgtctcagactcttgtgctatcaaatgtgatgcatgcatgtgtttgctggatggacctcgtaactacttactaataagaactcgagacgctcgaggtacccaattcgccctatagtgagtcgtattacgcgcgctc

SEQ ID NO: 52573 - protein, 57 aa, Zea mays
  misc_feature: Ceres CLONE 1469779-F
  misc_feature (6)..(56): Pfam Name: UPF0057 Pfam Description: Uncharacterized protein family UPF0057
MKEGTANCIDILIAIILPPLGVFLKFGCKVEFWLCLLLTFLAYLPGIIYAIYVITKD

SEQ ID NO: 52574 - DNA, 686 bp, Zea mays
  misc_feature: Ceres CLONE 1469781-F
  misc_feature: Encodes the peptide sequence at SEQ ID NO. 52575
ctggagctccccgcggtggcggccgctctagaactagtggatcccccgggctgcaggaattcgtctcacccctagaaaaaaaaaaaaaaagaaaaaccgtctccctcctatcgcactcgcgtctctttcctattcgcgccgccgccgctgctgcaagcgccagctcgccgtcgtccgaatagtacactctaacgccgccatggggcgtatgcacagccgcgggaagggtatctcgtcgtcggcgctgccgtacaagaggacgcctcctacctggctgaagaccgccgcctccgacgtggaggagatgatcacaaaggcagcgaagaagggacagatgccgtcgcagatcggcgtcctgctccgtgaccagcacggtatcccccttgtcaagagtgtcaccggcagcaaaatcctccgcatcctcaaggcccatgggctggcacccgaaatcccggaggacctgtacttcctcatcaagaaggcggtggcgataaggaagcaccttgagaggaacaggaaggacaaagactctaaattcaggctcattcttgtcgagagcaggatccaccgccttgcccgctactacaagcgcacaaagaagcttccacccacgtggaagtacgagtcaaccactgcaagcactctggtggcctaagcgaggagctcagcgtacggcgcttgaagcc

SEQ ID NO: 52575 - protein, 151 aa, Zea mays
  misc_feature: Ceres CLONE 1469781-F
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
MGRMHSRGKGISSSALPYKRTPPTWLKTAASDVEEMITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 52576 - DNA, 634 bp, Zea mays
  misc_feature: Ceres CLONE 1469783-F
  misc_feature: Encodes the peptide sequence at SEQ ID NO. 52577
  misc_feature (338)..(338): n is a, c, t, g, unknown, or other
  misc_feature (384)..(384): n is a, c, t, g, unknown, or other
tccccgcggtggcggccgctctagaactagtggatcccccgggctgcaggaattcgtctcacccctagaaaaaagctacaaccgaagccaccaccagcagtccagcacgactagcggaataatatccaccggcgacgggaacgggaggcggcgcggccggagattcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgnacatcgctaaggagatccgtaaaaaacagagcgtcaccacccccanggtgattgatatgcttttctgtcacgcgacggaggagctgaacaacatagtcgaacatgcaaagcagcgccatcatgtgattggggcagtatgtgatcgggcaaaaagggctggtgcacaaactggggtcaaaagatctaggaactctgactttctgaaaaattcctcccaagcaattactccgaatgggggggaaatttaaaatccgggtaaaccccggggggggctctgaaaaaacaccctggggacc

SEQ ID NO: 52577 - protein, 137 aa, Zea mays
  misc_feature: Ceres CLONE 1469783-F
  misc_feature (19)..(89): Pfam Name: Complex1_LYR Pfam Description: Complex 1 protein (LYR family)
  misc_feature (56)..(56): Xaa is any aa, unknown, or other
  misc_feature (71)..(71): Xaa is any aa, unknown, or other
MAFTMRAVKVPPNSASLEEARHRVFDFFKQACRSIPTVMEIYNLDDVVTPSQLRSXIAKEIRKKQSVTTPXVIDMLFCHATEELNNIVEHAKQRHHVIGAVCDRAKRAGAQTGVKRSRNSDFLKNSSQAITPNGGEI

SEQ ID NO: 52578 - DNA, 681 bp, Zea mays
  misc_feature: Ceres CLONE 1469786-F
tggagctccccgcggtggcggccgctctagaactagtggatcccccgggctgcaggaattcgtctcacccctagaaaaaagccaagcaaataagacgacttggttcattgattcttgaagagatcgagcttcttttgcaccacaaggtccaggatgtcttgcaactgcggatcaagctgcggctgcggctcaagactgcaagtgcggcaagaagtaccctgacctggaggagacgagcaccgccgcgcaggccaccgtcgtcctcagcgtggccccggagaagaacgccgcgcccgagttcgtccaggccgcggcggagtccggcgaggccgcccacggctgcagctgcggtggcaactgcaagtgcgacccctgctactgctgatcacatcgatcgacgaccatggatatgattattatctatctagcttgcggcggtggttgaacaataataagcgaggccgagctggctgccatacataggtattgtgtgctgtgtgtgagacagacagaaacagagttcttcagtttgctatctctctctgcatgtttggcgtcagtctttgtgctcatgtacgtacgtgtgtctacctgcatgttggttgatccgattgcatctgctgtaccatatattaattggtccacgatgatatgatttgatactatatatatactaaaaaa

SEQ ID NO: 52579 - DNA, 667 bp, Zea mays
  misc_feature: Ceres CLONE 1469789-F
  misc_feature: Translation starting site: 132
  misc_feature (533)..(533): n is a, c, t, g, unknown, or other
aaagctggagctccccgcggtggcggccgctctagaactagtggatcccccgggctgcaggaattcgtctcacccctagaaaaaaccagccacacgagcgccctcacctgctcctgcgacaccacagaataatggagcggcagactcgattcgtcctgctcgtcttcgccatcggggctctcctcgccagctccgccgccgcggacttgtcggcggctgctggttccctgcacgcgctgccgctgcggcgcgtggaggacgacgacgcaagcagcttcgtggaggaggcggcgtacccgccgaggagggcgctgtacgggggcgggtccatcagctacggggcgctcaccgcgaacaaggccgtctgctacggctccgtgcgccgctcgtgggcaggcgtatacccgcggctgcctggccatctacgggtgccgaggtggccgttaattaaccagaagcagcgcgtagctagcagtcgatgtctgttaattacatgtctgtttcttgtgctgcttctcgtttttcttctaatncccttctcttgcttcaaacaagccaagatccgatccatatatacatgttgtcgctcccaaaaaaaaaaaaaaaacgagacgctcgaggtacccaattcgccctatagtgagtcgtattacgcgcgctcacctgc

SEQ ID NO: 52580 - DNA, 677 bp, Zea mays
  misc_feature: Ceres CLONE 1469795-F
  misc_feature: Encodes the peptide sequence at SEQ ID NO. 52581
  misc_feature (487)..(487): n is a, c, t, g, unknown, or other
ctccccgcggtggcggccgctctagaactagtggatcccccgggctgcaggaattcgtctcacccctagaaaaaacccccactactctctctcgccccaaaaccagatcgccacgacaagggcagagggccccggaggggcgcgtaacaatggcggcaggctaccgggccgaggacgattacgattacctcttcaaggtggtcctgatcggcgactccggcgtcggcaagtccaacttgctttcacgcttcacgcgcaacgagttcagcctcgagtccgagtccaccatcggcgtctagttcgccacccgctctctccaggtctacggcaaggtcgtcaaggcccagatttgggacaccgccggccaggaacgataccgtgcaatcactagtgcgtattaccgaggcgctgttggggcgttgcttgcatatgacgtcactcgccactcaacctttgataacgttgagcgttggctgaaggagctganataccacactgaccccaatatagttgttatgctggttggcaacaaatctgatctccgccgtcttgtagcagttcaaaccgacgaaggagaagcattcgcacagagggaatcgttgtacttcatggagacctctgcgcttgagtcgaccaacgttgagaatgcatttgcagaagtcctatctcaaatctac

SEQ ID NO: 52581 - protein, 49 aa, Zea mays
  misc_feature: Ceres CLONE 1469795-F
MAAGYRAEDDYDYLFKVVLIGDSGVGKSNLLSRFTRNEFSLESESTIGV

SEQ ID NO: 52582 - DNA, 680 bp, Zea mays
  misc_feature: Ceres CLONE 1469799-F
ctccccgcggtggcggccgctctagaactagtggatcccccgggctgcaggaattcgtctcacccctagaaaaagttggtttggaagttgatgaaggaaatgatgtgtgccctgctgtagcagaccctaatgggaaacatgaaactggagtaggtggatctttagggggagctgcagaatctgctatatgatagctgctgtatcattcagttggctgtttgcagattgattgatgatgatggagaatgctgaactggtgtttattatctccctttctgatttaggagttttatttgcagggcatgaagatcttcggagaactcgagtgctgttcggagcgctcatctgatatattaaaatgcttatgattccatgaagagttgttggagcacatttctgggatgtcggttgaagatacaaggaagtacacactcaagtaaagtccatatacaagactataaacaactcatcttctaggctcttgcatttgaactggaatgctttggctagtaaaattgtccaaatatgcttgtccaccttctgacgcactttgtctgtttgaagtcctgtttttgtatcttgtatcaggaatggttcaaaaagtttgacttgatataccatacttgtacactatcttttaacagtcacatggaattgtgatgtaagttttatatatcgtc

SEQ ID NO: 52583 - DNA, 659 bp, Zea mays
  misc_feature: Ceres CLONE 1469801-F
  misc_feature: Encodes the peptide sequence at SEQ ID NO. 52584
ctccccgcggtggcggccgctctagaactagtggatcccccgggctgcaggaattcgtctcacccctagaaaaatcaagttcttggactacaactgtagtgtggagtatcatgtgacgcacttcttggtgcacgaaagcaaggcgagaattgggcagaagcgcatgaagacgctacggatcgataccatccatcggagctcatcgagatggaaaggtgctgacgtgcttgtgttcaacactgcccattgatggtcacatcacgaaacacagtctggagtgaactattatcaagagggagatcatgtccatccccatctcgatgcctctaccgctttccaaagagcactaaccacctgggcatcctgggtcgacagtcacatcaatccacagctaactcgagtgttcttccgaagctcatccccgtcacatttcagtggtggggagtggaattcagggggacactgcagggagagcatgctgcccctcaatgacacccgtgctaggccggtgcctgagagaaacttgatcttggaacaggtcacgaagcagatgaagactcctgtgacagttctgaacgttactaatctgtctggcgtcaggatagatggtcacccatctgtatatggccggaagacggtaggtttaaccgcgtcgagcg

SEQ ID NO: 52584 - protein, 61 aa, Zea mays
  misc_feature: Ceres CLONE 1469801-F
MLPLNDTRARPVPERNLILEQVTKQMKTPVTVLNVTNLSGVRIDGHPSVYGRKTVGLTASS

SEQ ID NO: 52585 - DNA, 662 bp, Zea mays
  misc_feature: Ceres CLONE 1469804-F
ggagctccccgcggtggcggccgctctagaactagtggatcccccgggctgcaggaattcgtctcacccctagaaaaatcaagttcttggactacaactgtagtgtggaatatcatgtgacgcacttcttggtgcacgaaagcaaggcgagaattgggcagaagcgcatgaagacgctacggatcgataccatccatcggagctcatcgagatggaaaggtgctgacgtgcttgtgttcaacactgcccattggtggtcacatcacgaaacacagtctggagtgaactattatcaagagggagatcatgtccatccccatctcgatgcctctaccgctttccaaagagcactaaccacctgggcatcctgggtcgacagtcacatcaatccacagctaactcgagtgttcttccgaagctcatccccgtcacatttcagtggtggggagtggaattcagggggacactgcagggagagcatgctgcccctcaatgacacccgtgctaggccggtgcctgagagaaacttgatcttggaacaggtcacgaagcagatgaagactcctgtgacaggtctgaacgttactaatctgtctggggtcaggatagatggtcacccatctgtatatggccggaagacggtaggtttaaccgcgtcgagc

SEQ ID NO: 52586 - DNA, 640 bp, Zea mays
  misc_feature: Ceres CLONE 1469808-F
  misc_feature: Encodes the peptide sequence at SEQ ID NO. 52587
acccgcggtggcggccgctctagaactagtggatcccccgggctgcaggaattcgtctcacccctagaaaaaaccacacctccagtcctccactgacaagccgccgccgctcttccacctacctctccccggcctcgcacccatggccacggctttgatggttgcagccaccacctcctgctccccgggccgcgccgcgccgcgcctgaagccggtggcctcctcctcctccagcagcagcagcagcagctcggcgcggccgcggcggcccttggcgcagcagctcccgcgggtgctggcgacggcggcggcggcggcggtagcagccgcgccgctcccggcgctggcggagcagatggagaaggccgcactgtttgacttcaacctgacgctcccggcaatcgcgaccgagttcctgctgctcatggtggcgctggacaagctctacttcacgccgctaggcaagttcatggatgagcgggacgccaagatccgcggtgagctcggcgatgtcaagggcggctcccaagaagggaaccacctggagaacaagcggcgggccatctgaaggccgcccccccccaaaatgccgcggccctttaaaagatgaaaaaggagacccccgcgaaatgggaggcca

SEQ ID NO: 52587 - protein, 141 aa, Zea mays
  misc_feature: Ceres CLONE 1469808-F
  misc_feature: SWISSPROT Homolog: EC 3.6.3.14 H(+)-transporting two-sector ATPase
MATALMVAATTSCSPGRAAPRLKPVASSSSSSSSSSSARPRRPLAQQLPRVLATAAAAAVAAAPLPALAEQMEKAALFDFNLTLPAIATEFLLLMVALDKLYFTPLGKFMDERDAKIRGELGDVKGGSQEGNHLENKRRAI

SEQ ID NO: 52588 - DNA, 628 bp, Zea mays
  misc_feature: Ceres CLONE 1469809-F
  misc_feature: Encodes the peptide sequence at SEQ ID NO. 52589
ggatcccccgggctgcaggaattcgtctcacccctagaaaaaaaaccaaactcacacacacacacacacacgcaggcagcagtcaagcggccaacctctgcttcacaccgtacctacctgcgagccacgcccacgccgcagcccccgatgtcgtcgcagcgcccgggccgccaccagcgccgcgcgtcgcagagcgtgttcgtgctcccagagaacctggcctccctcgacgtctacgcggcggccgacgcgggcgccaaggccggcgggccacaaggcgccggcgccggcgccgagcagcaggcgaggccgcccgcggggcgtcaccaccgccgcgccatgtccgtggccgcggccgtggcctccagggaccttgagctgatcaaggaggacctcggcagctacaactacaaggtcggcgcctgagagagggagagagaggggagccggcactctgcgtcatgtgtatagagcttgcgggttaaccgtacccagagctggctttgatcgacgattaacagtggcttaattacatggtctctctcttgctccttttgtttgccctcacacgcatgtataatagtactagtagtactatgtaactttgttactacacagagaaatagtg

SEQ ID NO: 52589 - protein, 92 aa, Zea mays
  misc_feature: Ceres CLONE 1469809-F
MSSQRPGRHQRRASQSVFVLPENLASLDVYAAADAGAKAGGPQGAGAGAEQQARPPAGRHHRRAMSVAAAVASRDLELIKEDLGSYNYKVGA

SEQ ID NO: 52590 - DNA, 650 bp, Zea mays
  misc_feature: Ceres CLONE 1469817-F
  misc_feature: Encodes the peptide sequence at SEQ ID NO. 52591
  misc_feature (485)..(485): n is a, c, t, g, unknown, or other
ctccccgcggtggcggccgctctagaactagtggatcccccgggctgcaggaattcgtctcacccctagaaaaaaccacgcgaccacgcccccgctcctctcgtctctttcttcgcctcttccatcgcaggattcggcggccatgggcggcggctacggccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaaagaacatgcggaggcgaggcatcccatgaacgacctctaccagtgcttcccccacctcaagaattagtacgcagcataagcatatgatctgctcagctaagagacaagtactacctattatatatacgctgtgtgtcaattaatggttgtaggctgctggtgagcggctgcttcnttcgtgttgccccctcctgatatgtactggaacccttggcctggcaaggtcttgggctaaaaaccactgggtcctgttggaattcgaaaaaaaaaaaaaaaaaacgggggccccccgagggacccattttccccccatataggagaccattattcgcgccccccg

SEQ ID NO: 52591 - protein, 84 aa, Zea mays
  misc_feature: Ceres CLONE 1469817-F
  misc_feature (4)..(68): Pfam Name: DUF1909 Pfam Description: Domain of unknown function (DUF1909)
MGGGYGQKSKMARERNAEKNKGGKGSQLEANKKAMNIQCKICMQTFICTTSEAKCKRTCGGEASHERPLPVLPPPQELVRSISI

SEQ ID NO: 52592 - DNA, 641 bp, Zea mays
  misc_feature: Ceres CLONE 1469820-F
  misc_feature: Encodes the peptide sequence at SEQ ID NO. 52593
  misc_feature (525)..(525): n is a, c, t, g, unknown, or other
aagctggagctccccgcggtggcggccgctctagaactagtggatcccccgggctgcaggaattcgtctcacccctagaaaaaatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggggaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctangctagctgcagctcaggtgcttgtctgaggctgcctcctcattggcaccgcgattgcctgctgctggttgaatgtggtgatccacagtattattaccggacccttgctttggggaa

SEQ ID NO: 52593 - protein, 129 aa, Zea mays
  misc_feature: Ceres CLONE 1469820-F
  misc_feature (1)..(129): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
  misc_feature (121)..(121): Xaa is any aa, unknown, or other
MIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIAXLAAAQVLV

SEQ ID NO: 52594 - DNA, 687 bp, Zea mays
  misc_feature: Ceres CLONE 1469825-F
  misc_feature: Encodes the peptide sequence at SEQ ID NO. 52595
  misc_feature (376)..(376): n is a, c, t, g, unknown, or other
tggagctccccgcggtggcggccgctctagaactagtggatcccccgggctgcaggaattcgtctcacccctagaaaaataccgccgccgccccctacgccagcttcccagctcttcgtcaggcccttctccgtcaacgagcacccagcacatatcctgagcccctccacgcctcaacgatggcgggattcagaagccttgcacccaagaccaggaacctggtggtggctgggggcctgtcggccttcgtgctcggggtctactactacaccatgagagccgtgggaggcacggacgagctgcaggtggcgatcgacaagtttgaggagatgaagaagaaggacgctgccagaaactccagcacaggaggatcgtnaacgcggcgcccttctcgtctctgtactgaacctggatctgcaggctgacatgatacggtagtcaagtcgctcagtaggccagaacattgcgtgcctctacggggcaataaaaaagaggggaaaccccttaaacaaaaaagcttggcagcttgggttttaagggaaagatgaacacgccaaggggttttggcccaaggaataaaaaaaggggccgcaagggctcaaaaaaaaaaaaaaaaaaaaaaaggccccgaggaacccaatttccccccaataaggggagctaaattaacggggctgccctcgggga

SEQ ID NO: 52595 - protein, 81 aa, Zea mays
  misc_feature: Ceres CLONE 1469825-F
  misc_feature (66)..(66): Xaa is any aa, unknown, or other
MAGFRSLAPKTRNLVVAGGLSAFVLGVYYYTMRAVGGTDELQVAIDKFEEMKKKDAARNSSTGGSXTRRPSRLCTEPGSAG

SEQ ID NO: 52596 - DNA, 691 bp, Zea mays
  misc_feature: Ceres CLONE 1469827-F
  misc_feature: Encodes the peptide sequence at SEQ ID NO. 52597
ctggagctccccgcggtggcggccgctctagaactagtggatcccccgggctgcaggaattcgtctcacccctagaaaaaatcgatcctgtcctgtccagcaagggagacctggactggaggaggaggacctacctacccggcctccagctctctcgtctcttcctcctcctcctcgaagctccgatccgatcccccaatgtctgacagcagtccagctcccggcgcctactactccggccctcccgccgcgccgccgcccgagtctaagcccgttgacggcggccaggtcaacgccgatgttcctggctactactcctccgccactgctgcgaaatctggcgccggcggccagggcagctccgctgctcctaaggaatcgggcttcttcgccacctggtgtgggtgcttctctgggcgcgaaaacgcgagatagatagattcagtggttggaccgagaaccatggatgaatggatggaacatgcatgccccagtgattggttgcccccgatgaaagttcattttgtccgggattattttcccggaaaaaagaaaaggtttttttttccccaccggggaaccggggatcttgggcatttggacaaaaaccatttattgcgaccgggggtttattttgccccaaaaaaaaaaaaaaaaaaaaagcgctcgggggccccacttctcccctatt

SEQ ID NO: 52597 - protein, 78 aa, Zea mays
  misc_feature: Ceres CLONE 1469827-F
MSDSSPAPGAYYSGPPAAPPPESKPVDGGQVNADVPGYYSSATAAKSGAGGQGSSAAPKESGFFATWCGCFSGRENAR

SEQ ID NO: 52598 - DNA, 909 bp, Zea mays
  misc_feature: Ceres CLONE 1469877-F
  misc_feature: Encodes the peptide sequence at SEQ ID NO. 52599
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ccggggggagagcccgctcccacaccaatatnngnnnnnggccnnnnnnnaaaaactgggactccccgcggtggcggccgctctatactagtggatcccccgggctgcaggagttcgtctcacccctagaaaaagcggcaccccctccaccaccggccaccatgcagacgcagaccctcatcctacgcgccggcccctccgcccgacgctccaccccgccgccggccagcaccgtgcacctcgccgcctccggaaggtgcctgctgcgtgctcccagctcgctccgacgccgaagaacccgctctctcagggcctctgcctctctcgagcaggtcaaggaagtcgcccgctccccagctcccttccgcagggcaagagtagtcaagcccactagaacagaaggggagggaacaacagcaaatgggtcgccccatgtttgatccgggggaaaaacaaatttttggggggaaattaaaatggaaaaacccccccctctcaggggttttccccaaaaaaaaaaccaaaattttgggccactggaaaaagaaaaaaacgggggcactttcaccggtggacccctctaaaaaccggggtaaaaaaaaaggggaatcccccgccgatatcttgtggaatccaaacagtaaagcactccctaaacaacccttttatgaagggggtgcctttcaagcacccccaacaaataattcgggatacaaccgccttggggcgcactttcggaaatatttcggaggaagcgcagagggtctaaaacgcggggtccccgtaaacccatgggtggagggaagaaagagtcttctcataaacgggtgacacatactcaaggaagaaggggcgcgacctaccgccagtaaaagcaggcgggttgttatacgaaaataacaactctcg

SEQ ID NO: 52599 - protein, 92 aa, Zea mays
  misc_feature: Ceres CLONE 1469877-F
MQTQTLILRAGPSARRSTPPPASTVHLAASGRCLLRAPSSLRRRRTRSLRASASLEQVKEVARSPAPFRRARVVKPTRTEGEGTTANGSPHV

SEQ ID NO: 52600 - DNA, 796 bp, Zea mays
  misc_feature: Ceres CLONE 1469881-F
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
atttgttttttttatttnnnncaaccaccaacannnggggggccnnnncaaaactggagctccccgcggtggcggccgctctatactagtggatcccccgggctgcaggaattcgtctcacccctagaaaaatcgtcgtcgcacggattggcattggctgccctccggccctgttcctcgtcctcctcatcaaatcccgtctcctcagtcctcccaataatggtggcgtggtgagaaatccttccgtccggccgtcgtcttagaagatgaactgttcctcttgctgcgccgctgcaactccatcctctctcgcgttcctcgataggctcgcgacggggtttagatgctagctgcttcacaaccactctccatctgatggtgcttctcctgggctcaaaacagttttccacggatcacatatagccgtgccctcgccccgggttgtcttttccccaccacttttattttttccccctccttatgttcctttgtaacatcttttcccacttttttttgactctggccctcttttccccggcctctccataatccttcgcacgtaactggtctaattctacccctccacgtgagttccacctggtaccctgcttttcaacggacaccagcccttattaaatgggacccattctacaatgtcgctggcttgacccccccgaaacccacccccatgcttcgttatggtctcacagagcgggccccataccgttcctctggtcacccacgtgtaaactcccccgctcgtcaagcaatcgggccctcggagattggcgctgag

SEQ ID NO: 52601 - DNA, 635 bp, Zea mays
  misc_feature: Ceres CLONE 1469883-F
  misc_feature: Encodes the peptide sequence at SEQ ID NO. 52602
agtggatcccccgggctgcaggaattcgtctcacccctagaaaaatggttggaggcctcctgtgttagcagctgttgtatgcctatatctacatgaattatctcctgactactattggttcatggaggataaataaaaatagctggaaagagcccattgcatttctgtctactcttttggaagcagatgatcgtgctgttcgaatggctgctggtgaagcattggctttgtgctttgagttaaatctgcttgatgtttcttctcgtgaggatgatggtgttaacacaggaggaacaaatggttctaagaacaagcttttcttggatatgcaagcattaaaaacccaaaatatcaggtctggccactaatctctctactgaggctggggtgcaaggtgtacaaccagagaagatcatcatgttaaagtacgtaagcaggcaagttgacccgaagggtaggctgggattgggcggacacgtaattgcttcatgttttacggcttaaatctttattatataaattatcagtttacacgattctatatttaccttttccccttcgagaaaaaataaaattatacataaataggatttgaaccttattttttaaaaatctaatttcacaccccacctaac

SEQ ID NO: 52602 - protein, 91 aa, Zea mays
  misc_feature: Ceres CLONE 1469883-F
MNYLLTTIGSWRINKNSWKEPIAFLSTLLEADDRAVRMAAGEALALCFELNLLDVSSREDDGVNTGGTNGSKNKLFLDMQALKTQNIRSGH

SEQ ID NO: 52603 - DNA, 855 bp, Zea mays
  misc_feature: Ceres CLONE 1469887-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (487)..(487): n is a, c, t, g, unknown, or other
tggtttatttannnatnnnntcctacccacatcnnnnnannnnaannnnnnaaaactggagtcaccgcggtggcggccgctctatactagtggatcccccgggctgcgggaattcgtctcacccctagaaaaaatccaactctcaagcgtctctactcctcttcctcctctctctactctccaagttctcttctccgtcgaccgctctacacgtctcttgtcgacctggacaccgaggtggaacaacgaacccgtcccccagatggatccatggatcagcagctcgccctttctgagccttgacctgcgcgtcggtctgccacccctccccctcttccatcacggggggggggggccgtccgccttggactaggctcctacgatgctccacggagggaacacccgtctgccgggcacccctccttaccaccccccctaaagggggggggggggggtgggggggaggataatataaaaaaaaaaaaanaaaaaaccaaaaaaccccggcccccccccaccccaaagctagcttggttgtgaaggcggtggtcatgcccgagacgaccagcggcgcgctatgatccaggcgtttgaggtagggcggctccggggatcaagtcctcggcgcatacactccgtgtagtcggtgccacatgctacacaccacggccgcggacacatcgcgcggcgggcgtcgccggggggatggggggcgcttctcccgtcccttgtcgactctccgtcctccgcggggaacaggggcggctggtaggacctcgcgcggcgacgtatgttcgcgcccgcaccgccaccccggcgggcgtgccgactgcgccgcggtgtcgtgccggcccg

SEQ ID NO: 52604 - DNA, 697 bp, Zea mays
  misc_feature: Ceres CLONE 1469888-F
  misc_feature (697)..(697): n is a, c, t, g, unknown, or other
tggagctccccgcggtggcggccgctctagaactagtggatcccccgggctgcaggaattcgtctcacccctagaaaaactagaaaaaaccccacccgacccgggcacacaacaccaattcaccaaacttctcaagactgtcactgtccactccaccacctcacttgcgatgcgaacaagagcaaagccctgaaatccttctccccctgcacgcacctgcagacctgctctctcgcgcgcatctcccgtgcccctcactgtttagtggcgacgactgggcgacagtcgccgccgccgcccgctaggggccgtgcccctggtctccatctccgggcgcttccgcccacagatatgagcagttggcatttcgaatttgaaggcattattgataacccgggaaaaatggattgcccccctgacccttttagcttggtcaaatgggctacccaagtgccaggttcccaaaagctctattcacccgtctttgaaatgggaaaaaaaaagtcgggaaattggaaggttacccctgaaaggggacccccaaaggccccaaattttggcgcccgtgccctccccgggtggtggaggcccccccagaagaaaaatttttttaaaaaaaaaacctttcccaaaaaaaaaaatttttctcccaattttccccgggggttttcttttccccccgaaaaaaagaaagccn

SEQ ID NO: 52605 - DNA, 830 bp, Zea mays
  misc_feature: Ceres CLONE 1469892-F
  misc_feature: Encodes the peptide sequence at SEQ ID NO. 52606
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (23)..(23): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
ttttatctttcngaaannnagangcagctctataagagtgtnnnnnnnccccnnnnnnnncaaaactggagctccccgcggtggcggccgctctagaactagtggatcccccgggctgcaggagttcgtctcacccctagaaaaaagaggagagagtcgctcagcactgcacgactcctcccccatctaccactacctgtctacctacccagcccatcgatcacccctcgcaacgcagtggcgctggccaccaactccgccgctgccgcagcagctgccgtatccggcggcgcggcatcccagccgcaccgcgcggccacgttcctcccgctgaagaggcgcaccatctccgccatccacgccgccgagccgtctaagaacaacgggcccgcgcgtccccgcggccgccgcccgctaattcatctggcctctgccgggggccacggccggagaaagaatgccggtagttcccgggtaaaagtggggttaaccccaccaccctgggaaggtccgaaaggaaggggggcttgctagcctcccctaggagataccccgaaaaccccgggaagcgaaagctgggaaccaccgggtggcttccaaaaaccgctttcccgagaccgttttccccgccccggtttggcgcgtttccccccgggaaaaagggtggtgccccgccctctcaacggaacgccgcaatggcgcccgaagggcccggcccattggggccccggcggccccttctcatcggctaccaaggagggggggcggaactgggtactcccaagaaaggcttcaaagggggaggttcccgcacgtgctctccgcagaca

SEQ ID NO: 52606 - protein, 45 aa, Zea mays
  misc_feature: Ceres CLONE 1469892-F
MAPEGPGPLGPRRPLLIGYQGGGAELGTPKKGFKGGGSRTCSPQT

SEQ ID NO: 52607 - DNA, 661 bp, Zea mays
  misc_feature: Ceres CLONE 1469895-F
  misc_feature: Translation starting site: 147
ctggagctcaccgcggtggcggccgctctagaactagtggatcccccgggctgcaggaattcgtctcacccctagaaaaagatctcgcctcccgagccacacacgttgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctcctctgctctccaggcttggagcagtagctcgtcttctcagcacaaagccagccgcaacagatgtcatcggtatcgatctaggcactacgaattcctgcgtctccgtcatggaaggaaagacaccacgggtgattgaaaatgcagaaggcgcgaggacaacaccctccaccccctgccaacaatcaaaatggtgacctgttgattggtatcacagcgagccggcaggcagtaaccaatgccccagaacacaatccgtgggtcaaagcgtcttatcggtaggacttttgatgacccacagacccagaaagagatgaagatggtgccttacaagattgtcaaggcgcccaatggtgatgcctgggtcaagatgggtgcccagcagtactcccctagtcagattggtgcatttgttctc

SEQ ID NO: 52608 - DNA, 736 bp, Zea mays
  misc_feature: Ceres CLONE 1469901-F
  misc_feature (35)..(35): n is a, c, t, g, unknown, or other
cgggtttgtagtctctttccccctctaatatttangaagcggaccttctaccaaactggaactccccgcggtggcggccgctctatactagtggatcccccgggctgcaggaattcgtctcacccctagaaaataaaaatcctgaaaagccagcagctaaagcagatccagccaagaccactaacggtgttcccaatggtactgctcacagtaacagtggaactgtaccccttgcgtcgagccaacaaaattcatcactgacgcctgatggaacttatagggcgcccttgctaggtggagttccttctgctggttacctggacacgacttatgggtatgacagcacaggggcacacttcgcatggtatgatggctctgcttatgcaaatggacaacaaagaacagctacaactaaccattttccatcctcaacatttggtaatggtttcccagcaagaaataaaaacaccaccaccaccacaccgcagatgggtatgcagaataaaagacctacgactacttcaccgcctccctatttaccccaataggatgtaccctagctccccgaccgtacacccactaagggaaattcaataaaaactggcctttccctacggtagcaactggttatgattcccggaaaatatgggccgaatggggtccctgggaatggacaaaaaggtaacaggccctagggggccggtaatgggctactaatgggttattggccaccgaa

SEQ ID NO: 52609 - DNA, 1984 bp, Zea mays
  misc_feature: Ceres CLONE 1469904
  misc_feature: Encodes the peptide sequence at SEQ ID NO. 52610
agcatatcactcactcacactcacaactcacaagcaggcacagctagctgctcacagctatacatcggcgcatcgccattaccagcggcttgctttggttttctgattgattagctggttgttgtccagttagttcgagtagtagacgatgtactctctaccaggagcaaccatgtctgctgcacctgcacgcgtcatctcttcttcctcctcctccttcgtggagcctcttctccttgcagcagcttcgccggcggcggcggcggctgcaaacagccaccaccaagtccgccagcgcggccacttggtccgtactttggcggcatcatcgtcgtccaacacgctgctgcggagtgacttcgatctccaggagggcctgacgacggacgtgaaacggatgctgcgtcagcgtagcggcggcgggcgggagatgctggtcaccatcgacaacctcaagcgcctctgcatcgaccactacttcgaggaagagatcgagggcgccatggcgacggccgcctgcacgggtctcctccacagcgacgacctcttcgacgcaaccctcgcgttcaggctcctgagagaggcaggccatgatgtctcagcaaaagacgatgttctacggaggttcatcgacggcgtcagcggcgacttcaagatatctctgagcaacgacgtcagagggctcctgagcctgcacgacatgtcccacctggacgtgggaggggaggcggcgctgctccacagggccaaggagttctcgagcaggcacctcgcgtccgccgtcaggtacctggacgaccctagcctcgcggagtacgtgcggcagtccctggaccacccctaccacctcagcctcacgcagtacaaggccaggcatcacctccgctacctgcagagcctgccctgcagctgcagagtcgacgccgccgtggagagactcgcggttgccgagttccagctcaacaagtcgctgcatcagagagagatgcgagagattaaaaggtggtggatggacctagggttggctgaagaaatacctgtggtgcgggatcaggtgatgaaatggtacatgtggtccatggcagccctccaaggatcttccttctccagataccgggtcgagatcaccaagataatctcgcttgtttacgtcgtcgacgacatattcgacctagttggcaccttggaggagctctccgccttcaccgaggcagtcaaaatgtgggatactgtggctgctgattcacttcctagttgcatgagatcatgctataaggccctccacaccgttacgaacgagatcgcagagattgcccacaaggagcatggatctgaccctatcaatcgtctcaggaaagcatgggcggtgctgtttgacggtttcatggttgaggcgagatggctagcgaccgaccaggtccctatggcggaggactacctacgaaacggcgtcatcacatcaggagtgccactcacatttctgcacatattcagcatgctagggtatgatgacgatcgaagcaccgaggaagaagaagaagcgatcatcgaccacatgccctcgatcatctcctgcccggccaagatcctcaggctctgggatgacatgggcagcgcagaggatgaggctcaagaaggattcgatgggtcgtacagggacttctacctcatggagaaccctagccgcagccccggcgaggcggaagcgcacatgcgcagcctgatcatgagggagtgggtggagctcaacagggagtgcttctgcaggaggaccttcccctcggacatcgcgcaggtctgcttgaacaccgtgaggatggtcagcgtcatgtactcgtacaacaaggagcagaggcttcccgtcctcgaggactacgcgacgatgatgttggtggtttgatttgaagcatgcatgcatgcaatgctctctccgatccgcggatatgaaagtaaagtccttgtcatgcaaaaaaaaaaaaaaaaa

SEQ ID NO: 52610 - protein, 583 aa, Zea mays
  misc_feature: Ceres CLONE 1469904
  misc_feature (260)..(534): Pfam Name: Terpene_synth_C Pfam Description: Terpene synthase family, metal binding domain
  misc_feature (54)..(252): Pfam Name: Terpene_synth Pfam Description: Terpene synthase, N-terminal domain
  misc_feature: SWISSPROT Homolog: EC 4.2.3.13 (+)-delta-cadinene synthase
MYSLPGATMSAAPARVISSSSSSFVEPLLLAAASPAAAAAANSHHQVRQRGHLVRTLAASSSSNTLLRSDFDLQEGLTTDVKRMLRQRSGGGREMLVTIDNLKRLCIDHYFEEEIEGAMATAACTGLLHSDDLFDATLAFRLLREAGHDVSAKDDVLRRFIDGVSGDFKISLSNDVRGLLSLHDMSHLDVGGEAALLHRAKEFSSRHLASAVRYLDDPSLAEYVRQSLDHPYHLSLTQYKARHHLRYLQSLPCSCRVDAAVERLAVAEFQLNKSLHQREMREIKRWWMDLGLAEEIPVVRDQVMKWYMWSMAALQGSSFSRYRVEITKIISLVYVVDDIFDLVGTLEELSAFTEAVKMWDTVAADSLPSCMRSCYKALHTVTNEIAEIAHKEHGSDPINRLRKAWAVLFDGFMVEARWLATDQVPMAEDYLRNGVITSGVPLTFLHIFSMLGYDDDRSTEEEEEAIIDHMPSIISCPAKILRLWDDMGSAEDEAQEGFDGSYRDFYLMENPSRSPGEAEAHMRSLIMREWVELNRECFCRRTFPSDIAQVCLNTVRMVSVMYSYNKEQRLPVLEDYATMMLVV

SEQ ID NO: 52611 - DNA, 653 bp, Zea mays
  misc_feature: Ceres CLONE 1469909-F
  misc_feature: Encodes the peptide sequence at SEQ ID NO. 52612
  misc_feature (548)..(548): n is a, c, t, g, unknown, or other
ggagctccccgcggtggcggccgctctagaactagtggatcccccgggctgcaggaattcgtctcacccctagaaaaaaaatcaccaaagaaatcactccagaattttgaaaaggtgacggaaatagtgaggagcggagaacaccggaatgatccatcctcttgtgctttccctgcccttccccgctataatatcgagccctcgtcgccatcgtcaccacaccaccactccctcactgccctctcactcccgatccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcanaagatgctgttcagatcataacaaaaatggctgctgccaatggagtaagacgtgtttgggttggacaaaacagtctcatgtctactcctgctgtatctgctgtca

SEQ ID NO: 52612 - protein, 103 aa, Zea mays
  misc_feature: Ceres CLONE 1469909-F
  misc_feature (16)..(103): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
  misc_feature (69)..(69): Xaa is any aa, unknown, or other
MGLFTVTKKATTPFEGQKPGTSGLRKKVTVFQQPHYLQNFVQSTFNALPADQVKGATIVVSGDGRYFSXDAVQIITKMAAANGVRRVWVGQNSLMSTPAVSAV

SEQ ID NO: 52613 - DNA, 721 bp, Zea mays
  misc_feature: Ceres CLONE 1469911-F
  misc_feature: Translation starting site: 303
  misc_feature: SWISSPROT Homolog: EC 1.11.1.7 Peroxidase
  misc_feature (33)..(33): n is a, c, t, g, unknown, or other
  misc_feature (35)..(35): n is a, c, t, g, unknown, or other
  misc_feature (44)..(44): n is a, c, t, g, unknown, or other
ggttttgttcggcgggagggccaccccaagctnanaaaataaanaaacaagctggcgctccccgcggtggcggccgctctagaatagtggatcccccgggctgcaggaattcgtctcacccctagaaaaagtcccccccggcatccccgctgcccgcgaccataggccgttccgctccaccccgccgcgactttcgtcccagctccgccgcctctctcctcctgcgcctctaccccgccgctcgggccagctagcaggcatccactgcgccgcaaccgcgcgcagccagcagccagccagccatggagaagcgacggcgaggcggcggcgtgccgtccttggcggcggcggtgctggcggcgctcctggcggcggcctcgatgccgtcgccgccccgcgtggcggccgcgctgtcgccggactactacagggacagctgcccgggcctggagtcgatcgtgcgccaccaggtggcgaggaagaaaacgagacggtgggcaccatcccggcgacgctccgcctcgtcttcacgactggctggtcgggggctgcgacgccgccgtcctgatcgcgtccaagaacaacgacgcccgagaaggacccggccggacaacgaagccgctcgccgggcgaacggcttcgaaccccttcaaaccggggcaagggcggccggtcaaagaaaaaggtggccccgggcgtgggtggtccgggcgccgaacat

SEQ ID NO: 52614 - DNA, 666 bp, Zea mays
  misc_feature: Ceres CLONE 1469915-F
  misc_feature: Encodes the peptide sequence at SEQ ID NO. 52615
tccccgcggtggcggccgctctagaactagtggatcccccgggctgcaggaattcgtctcacccctagaaaaaccgggagccaccaccggttcgtgtcgggaccggaaaccacgatcagccttgcacagttcccggcttcccgccgccgccgccgcggggagcaccggccgttggttcttcgtctccgccccgcttacgagaagagcgacgcgtttccccttcgaaccctcgtgtaccgtgggtcatggtgacgcctcgtggtagcggcgggagatggtgaagatagtgacgtacaacgtgaatgggctgcggccgcgggtggcgcagcacggctcgctccgcctcctcctcgacgccctcgatgccgacatcatctgcttccaggagaccaaattgtcaaggcaggaccccatctgcggatgtaattatggctgatggatatgaggcttttgtttcatgcaaccgctcttcaaagggcgtggagcatactctggtgttgcaactttttgccgaagaacatcttctttttccagccaggaagttgcttttgccggtaagagctgaaagaagggttttactggacttccgggtctaatgcaaaaaaaaatcccaatttgttgggggatttccagcattggcactggccctcttggtgaaggaaggtt

SEQ ID NO: 52615 - protein, 53 aa, Zea mays
  misc_feature: Ceres CLONE 1469915-F
MVKIVTYNVNGLRPRVAQHGSLRLLLDALDADIICFQETKLSRQDPICGCNYG

SEQ ID NO: 52616 - DNA, 649 bp, Zea mays
  misc_feature: Ceres CLONE 1469920-F
  misc_feature: Encodes the peptide sequence at SEQ ID NO. 52617
aagctggagctccccgcggtggcggccgctctagaactagtggatcccccgggctgcaggaattcgtctcacccctagaaaaaacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgaggaggaggctgctgctgctcctcctgctggtgccgaggagcccgccgcggccgagcctgtcgccgaggcagaggctgctgctcccgaagagctcgccgcggacgagc

SEQ ID NO: 52617 - protein, 139 aa, Zea mays
  misc_feature: Ceres CLONE 1469920-F
MATAEVQTPTVVAAEEAPVVETPPPAVVPEESAPAEAEAEAEAAAPADPEELPAAEQQAAAEAEAAAPAGAEEPVAAEPAAEAEAAAPAGPEETPAVEQEAAAEEEAAAAPPAGAEEPAAAEPVAEAEAAAPEELAADE

SEQ ID NO: 52618 - DNA, 2642 bp, Zea mays
  misc_feature: Ceres CLONE 1469922
  misc_feature: Encodes the peptide sequence at SEQ ID NO. 52619
aacgttcccacagtagggatccctcctccattaatagggggggatgcgtgtcgcggctagccaagcgacgacgcgagctgcctcgctcctctggccagccactccaggtccagggcgaggcgccagagctgcatcgcgctggctagctagtagctaactagcctgggcgcctagcgctacaagaaacagagctgagtggcggggtacaagcgagcgcggtggacaaaaggctagccagagagacgatggacggcggcagcggaggaggggaggcgtggcgcggcgctgtgtcgccggcagcgcggtacgcggagtccggcggcgccagcctcacgtgggagaacctcacggcggtgctgccgggcggcggcggccgggccaccaagaagctggtgcaggggctgtacggctacgccgtgcccggccgcgtcgtcgccatcatggggccttccggctccggcaagtccacactcctcgactccctctccgggaggctggcaaggaacgtggtcctcaccgggaaggtgctgctcaacggcaagaagaggcggctggattacggcctcgtggcatacgtgacccaagagaacgtgctgctgggcacgctgacggtgcgcgagacggtgacctactcggccctcctccggctgccgtcgagcacgcgcaaggcggaggtgcggcgcatagtggacgagacgctggacgagatgggcctccgggagtgcgccgaccgccacatcgggacgtggcacctccgcggcatcagcggcggcgagaagaagcggctgagcatcgcgctggagatcctcacccgcccgcgcctcctcttcctggacgagcccaccagcggcctcgacagcgccgccgccttctccgtcgtccagacgctgcggcagctcgccgtcgacggcggccgcaccgtcgtctcctccgtgcaccagcccagcagcgaggtgttcgcgctcttcgacgacctctgcctcctctccagcggggagtgcgtctacttcggtgacgccaagctagcgacacagttcttcgcggaaacggggttcccctgtcccagccggaggaacccgtccgaccatttcctccggtgtgtcaactcggacttcgatgatgtcgccgccaccatgaaaggctccatgaagctgcgagcagaggcagagctcgatcccctgttgaagtactctacctcagagatcagggaacggctagtggacaagtacaggatctcggattacgccatgatggttaggagcacgatacacgagataaccaagattgagggtgtgatggaggatgtgatccgtggcagccaggcgagctggttgaagcagctccgcacgctgacaagccggtccttcaccaacatgtcccgcgacctgaactactactggctgcgcatcatcatctacatcgtgatggccatctgcctgggaaccatctactacgacgtgggcaccagctacacggccatccaggcgcgcgcctcgtgcggcggcttcgtgtcgggcttcatgaccttcatgtccatcggcggcttcccgtccttcatcgaggagatgaaggtgttcaccctcgagcgccagaacggccactacggcgtcgccgcctacatcatctccaacttcctctcctccatgccgttcctgctcgccgtgtcctgggccagcgcgtccatcacgtattggatggtcaagttccggccgggcttcagctacttcgccttcttcgccctcaacctctacggcggcgtctccgtcatcgagagcctcatgatgatcatctccgccctcgtgccaaacttcctcatgggcctcatccttggcgccggtgtcatcgggatcatgatgttgacctctgggttcttccgactgcttccggagctcccaaagatcttctggcggtatccagtgtcctacattgtctatgggtcatgggggttgaagggcgggtacaagaacgacttgatcgggctggagttcgagccgatgatgccagggcagccgaagctgaccggcgagtacatcatcaccgagatgatggggctgagcctgaaccactccaagtggctggacctcgccatgatcttcgtcctcctcttcgcctaccgcctcaccttcttcgtcgtgctcaaggtgaaggaggccgctgcgccatacatccgcgtcgcctacacacgattcaccgtcaagcgtctcgagcggcgcgcctccttcaggaagacgctggccatggcgtccatgtccaagcggcacaacccgccgcaccccatggccatccaggaaggactcagctcgcctatgccgtactgagctgagccgaggcgaaggagagagcggagggagacggaagtggtggtcgatatcacagttacttgtggatgtgcttacagatttgtccgttccattgtttagtttgtcagagagcgttgtcaaagataccccacgcgatagtcggtcttcagagcattcgtttcactgtaataactctgaacaccatacacatacaagatagtgctgctgtgcgtacttgtttttttttgtaaacatgaaaccaggcaatgatccttatattaagaaagtcacgcagtcaaaacttacttattattaaaaaaaaaataaaaaaaaaaaaaaaaa

SEQ ID NO: 52619 - protein, 690 aa, Zea mays
  misc_feature: Ceres CLONE 1469922
  misc_feature (60)..(250): Pfam Name: ABC_tran Pfam Description: ABC transporter
  misc_feature (364)..(576): Pfam Name: ABC2_membrane Pfam Description: ABC-2 type transporter
  misc_feature: SWISSPROT Homolog: EC 3.6.3.28 Phosphonate-transporting ATPase
MDGGSGGGEAWRGAVSPAARYAESGGASLTWENLTAVLPGGGGRATKKLVQGLYGYAVPGRVVAIMGPSGSGKSTLLDSLSGRLARNVVLTGKVLLNGKKRRLDYGLVAYVTQENVLLGTLTVRETVTYSALLRLPSSTRKAEVRRIVDETLDEMGLRECADRHIGTWHLRGISGGEKKRLSIALEILTRPRLLFLDEPTSGLDSAAAFSVVQTLRQLAVDGGRTVVSSVHQPSSEVFALFDDLCLLSSGECVYFGDAKLATQFFAETGFPCPSRRNPSDHFLRCVNSDFDDVAATMKGSMKLRAEAELDPLLKYSTSEIRERLVDKYRISDYAMMVRSTIHEITKIEGVMEDVIRGSQASWLKQLRTLTSRSFTNMSRDLNYYWLRIIIYIVMAICLGTIYYDVGTSYTAIQARASCGGFVSGFMTFMSIGGFPSFIEEMKVFTLERQNGHYGVAAYIISNFLSSMPFLLAVSWASASITYWMVKFRPGFSYFAFFALNLYGGVSVIESLMMIISALVPNFLMGLILGAGVIGIMMLTSGFFRLLPELPKIFWRYPVSYIVYGSWGLKGGYKNDLIGLEFEPMMPGQPKLTGEYIITEMMGLSLNHSKWLDLAMIFVLLFAYRLTFFVVLKVKEAAAPYIRVAYTRFTVKRLERRASFRKTLAMASMSKRHNPPHPMAIQEGLSSPMPY

SEQ ID NO: 52620 - DNA, 657 bp, Zea mays
  misc_feature: Ceres CLONE 1469925-F
  misc_feature: Encodes the peptide sequence at SEQ ID NO. 52621
cgcggtggcggccgctctagaactagtggatcccccgggctgcaggaattcgtctcacccctagaaaaaagccagcttggtcggttcgtttaccaccaaagcgccccgcaaaatctcgccgccgaccgccatggcagccgccgaggcgacgcgtccgctgctcgttgctatatctctcgccgtagccgcctgctgcctcgcgcagctggcggtgggggacacgaacggcgtctacgagccgtgcagtgacgcacggatccagcgcggggacggcttcaccttcggggtggtcttcgcgggatacaacgccttcttctccggcaacacacagctctccccctgcgaccgccgcctcaacctcgctgcctccgggcagctcgccgtcttccgccccaaggtcgacgagatctccctcctcaccatcaacaccactaccggattcaacccagtacttgagttcaacaaaggcagactccaaaacttgcactggaagaaggacggctgtggcgcttgctccggcaagtcgaacttcgtctgcctcggcaaacagacatgcgccatcaggacgcagagctgcaagagccaagggcccgtcgactgcagcgtcggcatccagctggctttctctggcacggacagcacgagtcggttctgaac

SEQ ID NO: 52621 - protein, 174 aa, Zea mays
  misc_feature: Ceres CLONE 1469925-F
MAAAEATRPLLVAISLAVAACCLAQLAVGDTNGVYEPCSDARIQRGDGFTFGVVFAGYNAFFSGNTQLSPCDRRLNLAASGQLAVFRPKVDEISLLTINTTTGFNPVLEFNKGRLQNLHWKKDGCGACSGKSNFVCLGKQTCAIRTQSCKSQGPVDCSVGIQLAFSGTDSTSRF

SEQ ID NO: 52622 - DNA, 643 bp, Zea mays
  misc_feature: Ceres CLONE 1469928-F
  misc_feature: Encodes the peptide sequence at SEQ ID NO. 52623
caccgcggtggcggccgctctagaactagtggatcccccgggctgcaggaattcgtctcacccctagaaaaaactagtatctataaacagagtgagagactggtagcagccgcatgtgctagagctagacagaagtcagtctccttcccctctctctagtgctcgccggctctttccgtcgccatggacgtcctcctctgctgctgcctgctgcttctcctggcctccgccgcgtccgccggcagcgagcggtgcgtgcggcaggggaaggcggcctactcttcctcgctctctccggcccctcacggtagcagcagcggagcgtgcgggtacggcgccatggccgccgagatcaatgggggtttcctcgccgccggcgggcccaggcagcaccgcgggggcctcggctgcggccgctgtttccagatgagatgccgagacgcaaggctgtgcagcgccgggggagtgcgggtggtgctgaccgacttccacaggagcaaccgtacggacttcctgctcgccgggccggcgttcgcgggcctagccaagcccgggatggcccaacagttgaacaggcgagacgccctctccgtagagtacaaaaggattccctgcgagtacaggagaagaacctgtcgatccg

SEQ ID NO: 52623 - protein, 153 aa, Zea mays
  misc_feature: Ceres CLONE 1469928-F
  misc_feature (62)..(139): Pfam Name: DPBB_1 Pfam Description: Rare lipoprotein A (RlpA)-like double-psi beta-barrel
MDVLLCCCLLLLLASAASAGSERCVRQGKAAYSSSLSPAPHGSSSGACGYGAMAAEINGGFLAAGGPRQHRGGLGCGRCFQMRCRDARLCSAGGVRVVLTDFHRSNRTDFLLAGPAFAGLAKPGMAQQLNRRDALSVEYKRIPCEYRRRTCRS

SEQ ID NO: 52624 - DNA, 621 bp, Zea mays
  misc_feature: Ceres CLONE 1469929-F
  misc_feature: Encodes the peptide sequence at SEQ ID NO. 52625
tggagctccccgcggtggcggccgctctagaactagtggatcccccgggctgcaggaattcgtctcacccctagaaaaagaaaaaaaaaccgccagacttcgcagtcctcctccactaccagagcatgcgcgttgcccccgcgacccgaaccgccgccgccgctcaccctccgagcgccttcctgctcctcctcggttgcgcgtccctcgcgatcggaggagcagccatggccggccacgtcctcggcggcgtgaaggagaacccagccgcggccaacagcgccgagtccgacgggctcggccgcttcgccgtcgacgagcacaacaggcgcgagaacgcgctgctggagttcgtgcgcgtggtggaagccaaggagcaggtggtggccggcacgctgcaccacctcacgctcgaggccgtcgaggccgggaggaagaagctctacgaggccaaggtctgggtcaagccatggctcgacttcaaggagctccaggaattcagccacaagggggacgccaccgccttcaccaacgccgacctcggcgcctagcaaggtggacatgagccctggtggcgtggagctccagtagaggatcctgtggtccaagatgctgcccacc

SEQ ID NO: 52625 - protein, 141 aa, Zea mays
  misc_feature: Ceres CLONE 1469929-F
  misc_feature (41)..(129): Pfam Name: Cystatin Pfam Description: Cystatin domain
MRVAPATRTAAAAHPPSAFLLLLGCASLAIGGAAMAGHVLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGA

SEQ ID NO: 52626 - DNA, 635 bp, Zea mays
  misc_feature: Ceres CLONE 1469935-F
  misc_feature: Encodes the peptide sequence at SEQ ID NO. 52627
ggagctccccgcggtggcggccgctctagaactagtggatcccccgggctgcaggaattcgtctcacccctagaaaaaaaaaaaaatacataaataagaaaataatggcactgatgcggtcctttaacagacaagggtcgactcataaggatggtttacgtattggacttaaagttggcaagcctgtggaaaatggtggggtggtcgagtacttctttgggagtgatgggaatgaacctctacactttgacaagttttctaaaattttgaaggaattgcatgatgagattattcaactggagttcagtcattatgatgtcaagtcgtctaaaacaataccagcaaaggattttgcattgtccatggttgcttctgctgacatgaaccatatcaacaaactgcttgatagagttgatagtttggtcaaggagccagatctgaaggacatacgcatcacctttgaggagtttaaggcatttgctgatttgcgacgaagattggagccactgtcgatggctatctttgcttacggtaaattgaatgggttattgacgaaggaggatctaaaacgtgcagcgcaacatgtttgcggggtcgacttaacagatagagtagtagacatcattttccatgtg

SEQ ID NO: 52627 - protein, 177 aa, Zea mays
  misc_feature: Ceres CLONE 1469935-F
MALMRSFNRQGSTHKDGLRIGLKVGKPVENGGVVEYFFGSDGNEPLHFDKFSKILKELHDEIIQLEFSHYDVKSSKTIPAKDFALSMVASADMNHINKLLDRVDSLVKEPDLKDIRITFEEFKAFADLRRRLEPLSMAIFAYGKLNGLLTKEDLKRAAQHVCGVDLTDRVVDIIFHV

SEQ ID NO: 52628 - DNA, 654 bp, Zea mays
  misc_feature: Ceres CLONE 1469940-F
  misc_feature: Encodes the peptide sequence at SEQ ID NO. 52629
  misc_feature (210)..(210): n is a, c, t, g, unknown, or other
  misc_feature (212)..(212): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (221)..(221): n is a, c, t, g, unknown, or other
  misc_feature (222)..(222): n is a, c, t, g, unknown, or other
  misc_feature (232)..(232): n is a, c, t, g, unknown, or other
  misc_feature (234)..(234): n is a, c, t, g, unknown, or other
  misc_feature (342)..(342): n is a, c, t, g, unknown, or other
  misc_feature (523)..(523): n is a, c, t, g, unknown, or other
  misc_feature (542)..(542): n is a, c, t, g, unknown, or other
  misc_feature (577)..(577): n is a, c, t, g, unknown, or other
  misc_feature (581)..(581): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (616)..(616): n is a, c, t, g, unknown, or other
  misc_feature (617)..(617): n is a, c, t, g, unknown, or other
  misc_feature (628)..(628): n is a, c, t, g, unknown, or other
  misc_feature (642)..(642): n is a, c, t, g, unknown, or other
ggatcccccgggctgcaggaattcgtctcacccctagaaaaacccaagtcctaagctagccagctgagctcgctcccagtccaagcgccggcgccaccaccgcagctgctcgctggtcaccatgagcaaggagaagcaccaccgcgactggatcctccggcgctgctgtggctccctcgccgcctgcatcctgacgctggccgccgtcgntncnnngggcnntttttttccnanattttcccgggggggagggtgggggggggctatattgttccctcgcgcgggggtggcgcccccaaaattatccctccttttctcccccctttggtggggagagggggncttttttttgtggggggcccgcccccccccctctttttcccccaaaaaaagagccccccccgggttccccccccttttttttccttaaaaccccccctttgtgcgctcccgggagggaacacacaagcgtgggggggaaaaaaacccccttggtggggcgcgcgccccccccccccatttngaaagaaacccaccttttnccaagacgggagaaaaaacccccccgtggcggggngagnttttttttccccccccccttagaagaaaacnnncnnccaccaaaggntgtggtggtagcanaaaataatattt

SEQ ID NO: 52629 - protein, 102 aa, Zea mays
  misc_feature: Ceres CLONE 1469940-F
  misc_feature (30)..(30): Xaa is any aa, unknown, or other
  misc_feature (31)..(31): Xaa is any aa, unknown, or other
  misc_feature (32)..(32): Xaa is any aa, unknown, or other
  misc_feature (34)..(34): Xaa is any aa, unknown, or other
  misc_feature (38)..(38): Xaa is any aa, unknown, or other
  misc_feature (74)..(74): Xaa is any aa, unknown, or other
MSKEKHHRDWILRRCCGSLAACILTLAAVXXXGXFFPXFSRGGGWGGAILFPRAGVAPPKLSLLFSPLWWGEGXFFLWGARPPPSFSPKKRAPPGFPPLFFP

SEQ ID NO: 52630 - DNA, 609 bp, Zea mays
  misc_feature: Ceres CLONE 1469944-F
  misc_feature: Encodes the peptide sequence at SEQ ID NO. 52631
  misc_feature (496)..(496): n is a, c, t, g, unknown, or other
ggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatcccactcctgtgggcgatgctgggcgcgctgggctgcgtggtcccagagatcctggccaagaacggcgtcaaagtcggcgaggcggtgtggntcaggactgggcgcaaatctttctcggaggcggcctggactaactgggggaccccaacctggtggacgcacagagcatccttggccatctgggcttgccaaggggtgctcatg

SEQ ID NO: 52631 - protein, 163 aa, Zea mays
  misc_feature: Ceres CLONE 1469944-F
  misc_feature (59)..(162): Pfam Name: Chloroa_b-bind Pfam Description: Chlorophyll A-B binding protein
  misc_feature (126)..(126): Xaa is any aa, unknown, or other
MAASALHQTTSFLGQALVSRAAGVDAGGRITMRRTVKSVPQSIWYGPDRPKYLGPFSEQTPSYLTGEFPGDYGWDTAGLSADPETFARNRELEVIPLLWAMLGALGCVVPEILAKNGVKVGEAVWXRTGRKSFSEAAWTNWGTPTWWTHRASLAIWACQGVLM

SEQ ID NO: 52632 - DNA, 851 bp, Zea mays
  misc_feature: Ceres CLONE 1469948-R
ccgattgggtacctcgagcgtctcgttttttttttttttttagccaacaaagcatcccagtaaacatgatccacaaggctgttctcatgtcaataaaataaaaccagcattctgctgcaagtaagatgatcacaaattggcagtcacatctacacatgccatggcagccctttggagggcaagaaagatcgcaaatcatatgcagcaaaccctctcaattaaccagttcttggtccagttctcttcacgtttacatatgcaattgcactgttgagaaacaaagaaacctaataactacaaccaccatgcgcctcctgctccaagatagcaagcaaatcatgctctcctggagctcagcagctttgcttcgtgctgccgtcggatgagtaaagcctgctggtaaaggttcatgtcgaggccatcgacgttccttccgatgcgcgcgagtagaatcgcatcatcaacttcacggatctgaagttcaccaatgaattggtacaccgagttcgtgcggaaactgacatccctcaaatgctgggtgtcaaccttcaaacttacgctgccgtcttgaatggtgacagtcgcggagtccacatcgaatgactggagacttcctgtgactcgaagggacgctccttgcttgaacatctctgaggatggctccagctcccgtagaataacaggcacccctggttttaggccagcagatgccatcttgaaatgagaactaatgaaacacaaaaaccgatgatgctatgcttccttcgagtcctgatgcactgcccactgagcacatatgccaggattccttttgggggggggggggatggtgggggaaaccccttttttcc

SEQ ID NO: 52633 - DNA, 655 bp, Zea mays
  misc_feature: Ceres CLONE 1469949-F
  misc_feature (229)..(229): n is a, c, t, g, unknown, or other
  misc_feature (230)..(230): n is a, c, t, g, unknown, or other
  misc_feature (440)..(440): n is a, c, t, g, unknown, or other
  misc_feature (533)..(533): n is a, c, t, g, unknown, or other
  misc_feature (538)..(538): n is a, c, t, g, unknown, or other
ggagctccccgcggtggcggccgctctagaactagtggatcccccgggctgcaggaattcgtctcacccctagaaaaagaccaaccatcgcccgcccagcagcagcacggtcccacgccaggactcgacccacgcgcggctagctaagctcccgccgccatgatcacggccctgcaggtctccggcggcggcctgccgctcctgttcgcccggcgccggaggcgggagnnaaggacagccacagacgggcggccaacagaaccgccgccgcaaagggcaaggcaggccgccgcggggccaacgaggcacagcaggggaccagggaagacgagaggagaggagggcagcagacaggcaaagagcccccaggagagggaagagaacgaccccaacgggaaaaaaaggggggaccacccccaacaggaggacccacggaagangcggcgaacgaccgcgcccgagccagccggaacagcccgaagacaagcagaagcccagaaaccagcccagccacaaggggaagaggaagcacnagacnggcaccccaaacacgcgacgaaggagaaggggggagcagacgagcgagaacaccaggaaaagggaagggaaaacaaccccacgcgaggagacacccagcagagaccaggacaaagaa

SEQ ID NO: 52634 - DNA, 842 bp, Zea mays
  misc_feature: Ceres CLONE 1469950-F
  misc_feature: Translation starting site: 182
  misc_feature (28)..(28): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
aatttcttttttgttttttgtgttgtcncnccgggcnnccctggtaannnnnaaatattgtgggactacacgcgggggggggccgctctagaactagtggatcccccgggctgcaggaattcttctcacccctagaaaaagtcctccctagcaaacctaacgtaccctcttccgcgccgccatgtctgggaggaagaagacgcggcagcccaaagaggagaacgtgacgcttggccccgctgtccgcgagggagaacacgtctttggcgttgcgcacatcttcgcctccttcaacgacactttcatccgtgtgacggatctggctggaagggagacgcatcatccgcatcagtggggggcatgaaggttaaagctgatcgtgaggactcctcctcttatgctggtatgcttgcctcaaagggatgtcacgaaaagaatggatggacccttgagaattactgcgttgggcgccttatagctcccctgctcccagggtgggaaactaagacccagagccagcttgggcccttgggtggcttctctccgtggttccttggagatcttcttggcccgcacactctgtcgcgtagagagatcttgagccgtcaatttgaaggaaatgggaaacttggtaggtccccccgtaggggacaggcactacgggcgttatgagggttgggctaggtataacactgatagggacgtgcttgttgtatttctccgagagcccctgggcagctggcggtccccttgtgttcggaaaggtaatgtcaacgtttctaaggtgtttgggcctgggagtttgtaaactagatcgtgaaacgtggaatgaactggggtta

SEQ ID NO: 52635 - DNA, 630 bp, Zea mays
  misc_feature: Ceres CLONE 1469954-F
  misc_feature: Encodes the peptide sequence at SEQ ID NO. 52636
  misc_feature (405)..(405): n is a, c, t, g, unknown, or other
gcggtggcggccgctctagaactagtggatcccccgggctgcaggaattcgtctcacccctagaaaaagctctcctcggcccaccgatccacgccccgcacgcacacgacccgcagaccgcaccctgtcggcgagctcgctcccgttcccgtccgctgctctccgctcgacgccgccgtcttccgcgcagctagtgtctacactcccggcgacgatggcggaggacttggttttggacacggcgatccgagactgggtcctgatcccgctctccgtggttatggtcctcatcggcgtgctccgctactttgtctccaagctcatgcgctccccggcgacctctccgtctcccgaccccaagctcgttaaggaagggcaggtggtcatcagggcgaggaacctgantgacaacgcacagttcatcccggccaaggcttttcagggcacgcaaagtttattacacaaacgagggaaaatggatttactttcttgtccaaaaggatgaccccgcaaaagggtcaggcagccctgtttttctgatcccaaaatgggcctgggaactgattgaaaaaaaacccttccctgaaaagttccccaaaaccttacattttgcatgggggaaactttttc

SEQ ID NO: 52636 - protein, 96 aa, Zea mays
  misc_feature: Ceres CLONE 1469954-F
  misc_feature (64)..(64): Xaa is any aa, unknown, or other
MAEDLVLDTAIRDWVLIPLSVVMVLIGVLRYFVSKLMRSPATSPSPDPKLVKEGQVVIRARNLXDNAQFIPAKAFQGTQSLLHKRGKMDLLSCPKG

SEQ ID NO: 52637 - DNA, 823 bp, Zea mays
  misc_feature: Ceres CLONE 1469958-R
ccgattgggtacctcgagcgtctcgtttttttttttttttttgctttagagaaatttttaacaacttaacacggggtttctttttccacaaatattcaggcatgtcacggttccaacaaagttatagggctgtctgacgcccctgggagatgatccctgggacgaaggaacagacggtctttttatcccagcagtcccaaaaacaaaacaaatttataggttcattaccggtccctataaaaaattggcctaccctgaaacatggcaatctctagctgcccctgtcccaggcaaaagctaaccttttctatatctgggaccccccgggggggcaccaaaaacgggaacaactctgctgctcttcgtccccccagaaacagctcattcacacttgattgatttgtatatggggcggacaaaaaacaggggggcgcggaagccccccctcccgagcttcaagaaaaatgcatagcaaatgcgggccatgtacccaaaaaaaaaaaatgtctgcatgaagccaaacatgtcggatcccgcatagtagtagtacaggcagtacccgtacacaaaaaacccagttgatcccccgcaaaggaatgacccccaccaccactcagggtcttcagcagcaagctggaagtatgtcagtgcaacagtgatgaacgcggggacaataggggggatgatgaagacaataaacagaatgctgaaaatggggggagaccctggggccccaaaccctagcaaagatgtagtatagctcactgtatatggggcctaaaaaggcaagaaccccgccatacgcatcctgggggatgggtca

SEQ ID NO: 52638 - DNA, 654 bp, Zea mays
  misc_feature: Ceres CLONE 1469958-F
  misc_feature: Encodes the peptide sequence at SEQ ID NO. 52639
ctccccgcggtggcggccgctctagaactagtggatcccccgggctgcaggaattcgtctcacccctagaaaaaacatactcatcgtcgtctgtgttcttgggggttggcgtgaacgggcccgatgccgaatcgtgctccttgcgagcctcgccgataccccgctcccctcgcctcgcttctggatgcagatctttgtgaagaccctccccggccagactatcaccctcggaggtggagtcttctgatccccttgacgatgtcaaggctgagatgcccgacgaggagggcatccctcctgacgcgcagcggcttatctctctccggggagccgcgtgaggaccgacgcgcacttgctgactactgcatccggaaggagtccaccctccgcttggtgctgcgacttacgggaggaatgcggatctttgtctagaccttgagtggcctgacgatcacccttgaggtggagtcctcttacacctgtgactgtgtcaaggcctagatcctggacaaggagggcctcccacctgaccagcgacgtctcatctttgccggccagctgctggaggatgggaggacccttggtgactactgcctcctgaaggagagcaccctccacttggtgctgcgtcttatgggtggtatgcagatcttt

SEQ ID NO: 52639 - protein, 57 aa, Zea mays
  misc_feature: Ceres CLONE 1469958-F
MSRLRCPTRRASLLTRSGLSLSGEPREDRRALADYCIRKESTLRLVLRLTGGMRIFV

SEQ ID NO: 52640 - DNA, 674 bp, Zea mays
  misc_feature: Ceres CLONE 1469961-F
  misc_feature: Encodes the peptide sequence at SEQ ID NO. 52641
  misc_feature (168)..(168): n is a, c, t, g, unknown, or other
  misc_feature (379)..(379): n is a, c, t, g, unknown, or other
  misc_feature (391)..(391): n is a, c, t, g, unknown, or other
  misc_feature (393)..(393): n is a, c, t, g, unknown, or other
  misc_feature (397)..(397): n is a, c, t, g, unknown, or other
  misc_feature (449)..(449): n is a, c, t, g, unknown, or other
ccgcggtggcggccgctctagaactagtggatcccccgggctgcaggaattcgtctcacccctagaaaaagccccgcacgcacacgacccgcagaccgcaccctgtcggcgagctcgctcccgttcccgtccgctgctctccgctcgacgccgccgtcttccgcgcanctagtgtctacactcccggcgacgatggcggaggacttggttttggacacggcgatccgagactgggtcctgatcccgctctccgtgggtatggtcctcatcggcgcgctccgctagtttgtctccaagctcatgcgctccccggcgacctcttcgtctcccgaccccaaactctttttgtccccccccgctgggggacagacggggggancttaaaaaccancncacntttcctcccggccaaggataaaagaggacgcaggttgatggcgcgggccgantacaatggattacttcctggtgccaaggaggaagctgccaaacgctagggcccccatagtttggagatccaaaatgggcccggggcatgctcgacaaaaacttctcccctacatgtcccccggaccgtagcgttggggggcggggactatctgcttttacgatcgccttggaaccaaaacccacttccatttaagtttggggtgcgtggccacctttccgactgg

SEQ ID NO: 52641 - protein, 30 aa, Zea mays
  misc_feature: Ceres CLONE 1469961-F
MAEDLVLDTAIRDWVLIPLSVGMVLIGALR

SEQ ID NO: 52642 - DNA, 646 bp, Zea mays
  misc_feature: Ceres CLONE 1469964-F
  misc_feature: Encodes the peptide sequence at SEQ ID NO. 52643
acccgcggtggcggccgctctagaactagtggatcccccgggctgcaggaattcgtctcacccctagaaaaaacgggtttgcagctgacgctctccatcctcgttcttctcgctccgttcctctttccctcctcccctccgtcttggttcttcacacctggttcttctgtctcccgttgtctctatcgtctgctccggtgaacccgcatcgttcctattccttgtgctgcttccgtcgtcggctccagtaaatcactttgttcgccagctcgagatcgtggacggcttgctaaaatcagttaccataaacatgagagcattctcagtgacaaatagagcattttctattctctctatattaacaaaccatggaagacaatcctcagtaccatcttccctacttacctaccccgaacaacatcttatcacaagatgacgtacttggccttacaaccacgcaccagcgacatcattttccaaattatccacttctagcagccaaacaaacatggcccgacgattgctagcatatcccggtgtgccacagaatacagaggcggatgaacactacacagatcaacttaacaagaaggagctatcctcaccatcgaaaatgatgaagcacacccaagttgacaaagtccta

SEQ ID NO: 52643 - protein, 41 aa, Zea mays
  misc_feature: Ceres CLONE 1469964-F
MRAFSVTNRAFSILSILTNHGRQSSVPSSLLTYPEQHLITR

SEQ ID NO: 52644 - DNA, 654 bp, Zea mays
  misc_feature: Ceres CLONE 1469967-F
  misc_feature: Encodes the peptide sequence at SEQ ID NO. 52645
tggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctactaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccagaccctgtcgcaccacgaggcgccgtcaacgagtcgggttgtttgggaatgcagcccaaatcgggcggtaaactccgtccaaggctaaatacaggcgaggctgcttcgcaacggtgccgcggcttcggacagggctctcgcgacgcgatcggccatggcggcgtctctgcgggcctcgtcctccctccgctcgcgcctcctctcgttctcctcggggtgttctctgtgtccgtggcgtctcctcctctcctcacctgtccactcggacgccccccaccagaccgaaaccctcgctttcgacgagatccaactgtcgccggagaagcctgctaccgccactgc

SEQ ID NO: 52645 - protein, 62 aa, Zea mays
  misc_feature: Ceres CLONE 1469967-F
MAASLRASSSLRSRLLSFSSGCSLCPWRLLLSSPVHSDAPHQTETLAFDEIQLSPEKPATAT

SEQ ID NO: 52646 - DNA, 632 bp, Zea mays
  misc_feature: Ceres CLONE 1469985-F
  misc_feature: SWISSPROT Homolog: EC 3.2.1.23 Beta-galactosidase
  misc_feature (292)..(292): n is a, c, t, g, unknown, or other
  misc_feature (293)..(293): n is a, c, t, g, unknown, or other
  misc_feature (524)..(524): n is a, c, t, g, unknown, or other
  misc_feature (527)..(527): n is a, c, t, g, unknown, or other
aagctggagctccccgcggtggcggccgctctagaactagtggatcccccgggctgcaggaattcgtctcacccctagaaaaatacctttctcggccttttggctaagatcaagtgtagtatctgttcttatcagtttaatatctgatatgtggaccatgtgtccacttcgatattaaatttattttttgtgggggaggaatcacaacagtggcttgccactgggttcctcaagcgtcgtccggccgttgcactattggctggaccaggcgcaccccaattaaaaaggtganngacattctgggatacgaaaaatttgaaaaaaaaaaaaaacgagacgctcgaggtacccaattcgccctatagtgagtcgtattacgcgcgctcactggccgtctttttacaacgtcgtgactgggaaaaccctggcgttacccaacttaatcgccttgcagcacatccccctttcgccagctggcgtaatagcgaagaggcccgcaccgatcgcccttcccaacagttgcncancctgaatggcaaatggaaatggtaagcgttaatattttgtaaaaattcgcgttaatttttttgtaaatcagctcatttttttaaccaatagccagaaatcggcaa

SEQ ID NO: 52647 - DNA, 651 bp, Zea mays
  misc_feature: Ceres CLONE 1469986-F
  misc_feature: Encodes the peptide sequence at SEQ ID NO. 52648
  misc_feature (415)..(415): n is a, c, t, g, unknown, or other
aagctggagctccccgcggtggcggccgctctagaactagtggatcccccgggctgcaggaattcgtctcacccctagaaaattatcccgctgccaatggcgatggcgatcccgttctacatcggatcctacttcgccatcgacatgtttctgggcagcatgatcctcttcgtgtgggagcggctgaacaaggcgaaagcggacgcgttcggacctgcggtcgcgtcggggctgatctgcggagatggcatctggaccctgccgcagtccattctggctctgggcaaagtgcagcctccaatttgcatgatgtttttgtccagatcgaccaatgcaaggtggacagcttcctcggcttgtcatgattttacatagaatgacgagtgggcacacgctctcatcctgtattcattgnttcaaaaatttaatcaccgagatactgaattgtactagaagagaagagttttgctgtgaggtgacaaatcttcgtccgtatagtcagttcgtttcaggagaagttttaaaaaaaaaaaaaaaacgagacgctcgaggtaccccattcgccctatagtgagtcgtattacgcgcgctcactggccgtcgttttacaacgtcgtgactgggaaaaccctggcgttaccaacttaatcg

SEQ ID NO: 52648 - protein, 92 aa, Zea mays
  misc_feature: Ceres CLONE 1469986-F
MAMAIPFYIGSYFAIDMFLGSMILFVWERLNKAKADAFGPAVASGLICGDGIWTLPQSILALGKVQPPICMMFLSRSTNARWTASSACHDFT

SEQ ID NO: 52649 - DNA, 648 bp, Zea mays
  misc_feature: Ceres CLONE 1469987-F
  misc_feature: Encodes the peptide sequence at SEQ ID NO. 52650
  misc_feature (284)..(284): n is a, c, t, g, unknown, or other
  misc_feature (289)..(289): n is a, c, t, g, unknown, or other
  misc_feature (351)..(351): n is a, c, t, g, unknown, or other
ggagctccccgcggtggcggccgctctagaactagtggatcccccgggctgcaggaattcgtctcacccctagaaaaactcactcgcctcaactcgcctctgaaagttcggagacgccggcccatccgcctccctctccgcctcccatccccaaggacaatagttttcaagtggcaatggcggaccagactaaccaacccactgtccttcataagctcagtggccagttccacctgcctaatctgctactaccaatcgaagatttaagacgcttttcttgctcncttcntggctctggccatagcggtcatcctagttgttatgttcaagagggcatgaaatagccatgantatcttcacgctatcaggtacccatttcaccctatagagagtactattacgcgcgctgactggcagctcttttacaacgtgtagagtggaaaaaccgtgcttgtccccagataaagcgccttgcaacgctaccccttttctacagctgggtgaatctcgaatagtcccgcaccgatcgcccttcccacagttgcccaccctgaatggcgaatgaaattgaaagcgtcaatattttgctaaaatccgcgttcactttttgtgaatcagctcattttttaaccaggaggccgatttcgg

SEQ ID NO: 52650 - protein, 31 aa, Zea mays
  misc_feature: Ceres CLONE 1469987-F
MANEIESVNILLKSAFTFCESAHFLTRRPIS

SEQ ID NO: 52651 - DNA, 651 bp, Zea mays
  misc_feature: Ceres CLONE 1469993-F
  misc_feature: Pfam Name: PSII Pfam Description: Photosystem II protein
  misc_feature (335)..(335): n is a, c, t, g, unknown, or other
  misc_feature (627)..(627): n is a, c, t, g, unknown, or other
  misc_feature (640)..(640): n is a, c, t, g, unknown, or other
ggagctccccgcggtggcggccgctctagaactagtggatcccccgggctgcaggaattcgtctcacccctagaaattggttagcgacctcccattttgttctaggattcttcttttttgtgggccatttgtggcatgcaggaagagcccgagctgctgcagcaggctttgaaaagggaattgatcgcgatttggaacctgttctttacatgacccctcttaactaagattttttatttatacctgttctagtttttttctgttctggctcggttattccatctagccgagccattcatgcttttttatgaaagaatgatataaggggggctgcncaaagaaaaacatagatagaaagaagcaaatgtattcaatatacaaaaggagagagagggattcgaaccctcgatagttcctagaactataccggttttcaagaccggagctatcaaccactcagccatctctccacagcccaatccctattttattcctacaaatagaacatagctatatgaaatgatctactaactcatctcagatgcaagtccactttcaatatatctctgtataaagcggtaaggaaaaagttttaataaaaagagaatcaatggattcatgattaancccctcctacttnctgtattttcc

SEQ ID NO: 52652 - DNA, 616 bp, Zea mays
  misc_feature: Ceres CLONE 1469994-F
  misc_feature (256)..(256): n is a, c, t, g, unknown, or other
  misc_feature (466)..(466): n is a, c, t, g, unknown, or other
  misc_feature (586)..(586): n is a, c, t, g, unknown, or other
  misc_feature (616)..(616): n is a, c, t, g, unknown, or other
ggagctccccgcggtggcggccgctctagactagtggatcccccgggctgcaggaattcgtctcacccctagaaaaaggactcctctgcaaataaagccatcgggggagtgactgactgagtcagtgagtgggtgtgaggagagctttgaggggaggggagctagctagctactgcctactggaggagggcttcctccgacgccggacatgggggaggtgaagcacctgtgccctgccaagttcaggagggcgtcntggtggacgacgtgctcagggcatgaccgacctcgccgcgggatggacacggtcaagtctttcgagtggggcagacgtgctgaaccagagatgctgacgcagggcttcacgcacgtctctcgctcacttcgcctccgcgcgactcgccgctactggccacacagcacaccgcgttcgcgcacctcatgccgcatcgacagtgctctcgcnacttcccctctcgtcccaagctccgcgcggcatgactgcttgccctctccatcgccggccctgtaccctccccttttcagctccaacagatcacgtgtccctgcgcccgcgtgctggganaaaacctagactgctatggcctatggctgn

SEQ ID NO: 52653 - DNA, 655 bp, Zea mays
  misc_feature: Ceres CLONE 1469995-F
  misc_feature: Encodes the peptide sequence at SEQ ID NO. 52654
  misc_feature (460)..(460): n is a, c, t, g, unknown, or other
  misc_feature (655)..(655): n is a, c, t, g, unknown, or other
ggagctccccgcggtggcggccgctctagaactagtggatcccccgggctgcaggaattcgtctcacccctagaaaaaacccagcaacaagcaacctcgtccccaaacaagcaaccaccgcctccccgatctcgtcgagaggaagcccaatcccgaaaccgccgccctattccaatggcgcccaaggccgagaagaagcccgccgccaagaagcctgcggaggaggagccggcggcggagaaggccacggcggggaagaagcccaaggctgagaagcggctccccgcgggcaagtccgcaggcaaggagggtggcgagaagaaggggaagaagaaggcaaagaagtcggtggagacgtacaagatctacatcttcaaggtgctgaagcaggtgcacccggacattggcatctcgtccaaggccatgtccatcatgaactccttcatcaacgacatcttcnagaagctggcggcggaggcggccaagctggcgcggtacaacaagaagcctaccattacgtcccgcgagatccagaccctcgttcgcctcgtcctccccggcgagctcgccaagcacgccgtctccgagggcaccaaagccgtcaccaagttcaccagctcctaggcgagcgatgcgacgtgcactcgtctcctcn

SEQ ID NO: 52654 - protein, 149 aa, Zea mays
  misc_feature: Ceres CLONE 1469995-F
  misc_feature (56)..(126): Pfam Name: Histone Pfam Description: Core histone H2A/H2B/H3/H4
  misc_feature (96)..(96): Xaa is any aa, unknown, or other
MAPKAEKKPAAKKPAEEEPAAEKATAGKKPKAEKRLPAGKSAGKEGGEKKGKKKAKKSVETYKIYIFKVLKQVHPDIGISSKAMSIMNSFINDIFXKLAAEAAKLARYNKKPTITSREIQTLVRLVLPGELAKHAVSEGTKAVTKFTSS

SEQ ID NO: 52655 - DNA, 655 bp, Zea mays
  misc_feature: Ceres CLONE 1470008-F
  misc_feature (322)..(322): n is a, c, t, g, unknown, or other
  misc_feature (397)..(397): n is a, c, t, g, unknown, or other
  misc_feature (491)..(491): n is a, c, t, g, unknown, or other
tggagctccccgcggtggcggccgctctagaactagtggatcccccgggctgcaggaattcgtctcacccctagaaaaaagctctctctagcattacccggcggcggaagcgtaagcgcaaaacgaagcaagcggccgccctggtgaaggacgcacgggacagcggcgtcaggctctacgtccggggcaccatccttggatacaagaggtccaagtcgaaccagtacgagaccacgtctctcgtgcagatcgagggggtgaacaccaaggaggatgtcgcgtggtacgctggcaagcgcatggcgtacattctacagccaanaccaagagcaatgagacccgctacaggtgcatctgggggcaaggtcacccgtccgcacggaaaactcgggcgtcntccgtgccaagttcaagtccaacctcccgcctgagtccatggggcgcagggtcagagtgttcatgtacccgagcagcatctaaggttttgtggnagtaaagatggactaaaaatggccatgtgtttatttctcacttttctctgaactaaaaatggcttgtgtgggtaacttaaattggtccagtgctgaccctgtgggggttgtccaaaattttgtggcgaacggatgaacttattgcgtatggttatccccccaca

SEQ ID NO: 52656 - DNA, 635 bp, Zea mays
  misc_feature: Ceres CLONE 1470016-F
  misc_feature: Pfam Name: YDG_SRA Pfam Description: YDG/SRA domain
  misc_feature: Pfam Name: JmjC Pfam Description: JmjC domain
  misc_feature: SWISSPROT Homolog: EC 2.1.1.43 Histone-lysine N-methyltransferase
  misc_feature (463)..(463): n is a, c, t, g, unknown, or other
  misc_feature (481)..(481): n is a, c, t, g, unknown, or other
  misc_feature (538)..(538): n is a, c, t, g, unknown, or other
tccccgcggtggcggccgctctagaactagtggatcccccgggctgcaggaattcgtctcacccctagaaaactttacatccctactaaatggtggcactacgtcagatctcttcccaccagcttctcggttagcttttggtggcactacaaggttgttgactactggctcgaccgtggaaaatctgggtttgatgtttataagtgtagactgttgcgcattgagggccaagaacccatgggtactgtgaattatcgagtagctgacagcagccttagatgtgtcaagctagtagtttctttgcaacacttaccgagcactggcagtagctctggtgattgtgctgtctcgctgagaagatgctcaagttaccagtgcaacatcacttgaagcgtcaacatcactggactcagagggtcattcggtactgctagttggatctgctttgttgtgtttaacctcngccaaaggcttgtgggtngtcggatcaatgcctttctgcaaagcttctttttgacccttggagtctagatattcntaatctcgttatcagttcttctaggccacctagttgtaacttgggaccacctattcatggatgtgtcacagtgccaaaaaaaaaaaaaaaacgagac

SEQ ID NO: 52657 - DNA, 649 bp, Zea mays
  misc_feature: Ceres CLONE 1470022-F
tccccgcggtggcggccgctctagaactagtggatcccccgggctgcaggaattcgtctcacccctagaaaaaagtaagacgggtttctggtgtcaatttgcgttctagagtgttttttctttgtatatcattgctatctcgtggttgtcgtttggttagcatgcctggccaggttattaatactaacagtgtgcgtctataaacatgtgttcctacattgccacatgctgaggcaatctgtatacagctggctcgaggtggtcagctgcgtctaccacagtgagcatacgtgtatggataaatcttctgtgatagcgttctatgattattgcgagaaaaaaaattaaaaaaacgagacgctcgaggtacccaattcgccctatagtgagtcgtattacgcgcgctccctggccgtccccaaattcgcccatgagtgagagaatttaggcgtgcccatggtcagtcgtttttacagcacatcgccctgtaaaacacctggcgtaccccagtttatgcgcgctgcgatcacccttcccttacgctgctgggcctagaatgaaaatgcccaattgcaatcgcccttccttaagtttagctccgccgtaattgttaaatgaaatctgctcacttttattattctgtaagaat

SEQ ID NO: 52658 - DNA, 648 bp, Zea mays
  misc_feature: Ceres CLONE 1470026-F
  misc_feature (318)..(318): n is a, c, t, g, unknown, or other
  misc_feature (362)..(362): n is a, c, t, g, unknown, or other
  misc_feature (422)..(422): n is a, c, t, g, unknown, or other
tggcggccgctctagaactagtggatcccccgggctgcaggaattcgtctcacccctagaaaaacgcacgaccccgacaaccagttcaaggtcggcgacgtcgtcgagctccaaccctcccgtcccatctccaagaccaagcacttcctcgccatcccgctcccgccccgcgacactcgccgcaagtctcagctcctaccgccgctccagtccgacgacgaccaggagccgtcctcgcgagagtgattgattgtgattgattgctgcctgtctatggcttcgtcgtaagctcctctccatcagaggtgctgctttccnattccaaatgcgaatccatgtgtgtttttgtcagactatttccnttttcttttcgatcaagggctttagcccaatttcatccgaaatagctggtgcccttggtnggaactgatccatgggatatagctgcatattccccatccaaaaaaaaaaaaaaaaacgagacgctcgaggtaccccaatccgccctatagtggagtcgaattaccgcgcgctcactgggccgtgtttttacaacggcgtgacttgaaaaaaccctgggcgttaccaaattaaacccctttgggaaaaatcccccctgtcgcaggtggggaaaaaacaaaaaggccc

SEQ ID NO: 52659 - DNA, 654 bp, Zea mays
  misc_feature: Ceres CLONE 1470044-F
  misc_feature: Encodes the peptide sequence at SEQ ID NO. 52660
  misc_feature (383)..(383): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (397)..(397): n is a, c, t, g, unknown, or other
  misc_feature (400)..(400): n is a, c, t, g, unknown, or other
  misc_feature (417)..(417): n is a, c, t, g, unknown, or other
  misc_feature (553)..(553): n is a, c, t, g, unknown, or other
ggagctccccgcggtggcggccgctctagaactagtggatcccccgggctgcaggaattcgtctcacccctagaaaaactagaaaaacgagccctctgaaacagcccggcatcagctcctgcatgcccgtcgattccttcggtgttggtaacggtcatccgttttcgtgtccttgtttttcctggaagcaaaagccttgcgttctgtatgagacttctgtataccatttcccctctctctttttcccaatctctgccgtagtcctgcactcctgctactgctgtaaactagaacttattttgctgtttgtctcgtggcattgtcgagtcgcttatgtgtctatggcatgctagttgggagaagcctaatggaccttaacttantccnnnnnctaagnatnagtccaaccaatactgngtggaacaaaacagcatcttggttcggctatttaactttgataaaaaaaaaaaaaaccgtggggttttggggggcccattcccctttaaaataacttccttttccccggcctgcctcaagggtggtataaaccccntactttacgggggaaccccgcggggggcccccctcctccctgcggtgggaatttttaccccgttgcccggttggggcggatttttcgaaaaagggtcgggg

SEQ ID NO: 52660 - protein, 76 aa, Zea mays
  misc_feature: Ceres CLONE 1470044-F
MPVDSFGVGNGHPFSCPCFSWKQKPCVLYETSVYHFPSLFFPISAVVLHSCYCCKLELILLFVSWHCRVAYVSMAC

SEQ ID NO: 52661 - DNA, 667 bp, Zea mays
  misc_feature: Ceres CLONE 1470046-F
  misc_feature: Translation starting site: 97
  misc_feature: SWISSPROT Homolog: EC 3.2.1.23 Beta-galactosidase
  misc_feature (89)..(89): n is a, c, t, g, unknown, or other
  misc_feature (634)..(634): n is a, c, t, g, unknown, or other
aagctggagctccccgcggtggcggccgctctagaactagtggatcccccgggctgcaggaattcgtctcacccctagaaaaaccctanaaaaagaatgaagtgggcagagtccaatggctacaagggttcttttgatgaaatctgcaaacttgaaggactcaaagagtacatcctgaaagagctggcagccgttgcgcaaaagaacagctacgaggcttcgagtacatcagaggcgtagtgttggatcctgtgcccttttgactcgagagggatttggtgactgccacaaaaaaaaaaaaaaaaacgagacgctcgaggtacccaattccccctatagtgagtcgtattacccgcgctcactggccgtccttttacagcggcgtgactgggaaaaccctggctttacccaacttaatccccttggagcacatccccctttcggcagttggggtaatagcaaaaaagcccgccccgatcccccttcccaatagttgcccacccggaaggggaaaaggaaatttgaacccttaatatttttgttaaaattcccgtaaatttttgtgaaacccccctcatttttttaacccaaagggccaaaaccgggaaaatccccttataaatccaaaaaaatnccccgggaaatggggttgaatgtttgttccccg

SEQ ID NO: 52662 - DNA, 677 bp, Zea mays
  misc_feature: Ceres CLONE 1470055-F
  misc_feature: Translation starting site: 150
  misc_feature: Pfam Name: Ribosomal_L30_N Pfam Description: Ribosomal L30 N-terminal domain
  misc_feature (230)..(230): n is a, c, t, g, unknown, or other
  misc_feature (525)..(525): n is a, c, t, g, unknown, or other
  misc_feature (631)..(631): n is a, c, t, g, unknown, or other
aagctggagctccccgcggtggcggccgctctagaactagtggatcccccgggctgcaggaattcgtctcacccctagaaaattttccttcctcctcccacctcggcggccggcctcctcttctcttcacccacacgctggtcatagagatgtcggctgcagaggcgaaggcggcggcggtcccggagtctgtgctgcggaagcgcaagcgggagggagcatgggcagcngacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaagaccccgcagatcttgcagctcctgcgattgaggcagatctttcacgggtgtcttcctcaggggtaacaaggcnaccattaacatgctgcgcagggtggagcccatatgttgcgtaccgataccccaacctgaagagcgttaggaagttgatctacaagaagaggtacggggaagctgancaaagcaaaggatttccctttagccacaaccgggtcatcggaggag

SEQ ID NO: 52663 - DNA, 643 bp, Zea mays
  misc_feature: Ceres CLONE 1470056-F
  misc_feature: Encodes the peptide sequence at SEQ ID NO. 52664
  misc_feature (338)..(338): n is a, c, t, g, unknown, or other
ggagctccccgcggtggcggccgctctagaactagtggatcccccgggctgcaggaattcgtctcacccctagaaaaagacgtcacgcctgcgcggctgcgcccaccatggacgaggaggagttccggcgcatgctcgacctcttcccggtcgtccgctcccgagactactgctgctccgatcttggaactccagcagaggaaccagacagcgatcacgagttcaggaggcaactaagggcgataataaggactcgtccggtggacgagatatgtttatgcagaaattgaagatggctgcggagaataagattggagcgacaaaggcagagttcttcntgcagacattcgaagaagttcatgagaaacttgttcacagagagctgaatttgggatgctgctagaagttcctgagcgcatatgagagctgatgatgaacaataggtagatgctgctaaagggtcggtagttgccaatgatctggaaattttgtgatgctgtgagattttgatcacaggcaaactttttacaacaggtagatgctgttgagcgcatactgataccgcctgattggtcaccctcgcccgtaccagctcgtatgcagccaggctgtccggttattttgggcgtacaggtgatgcacc

SEQ ID NO: 52664 - protein, 43 aa, Zea mays
  misc_feature: Ceres CLONE 1470056-F
  misc_feature (23)..(23): Xaa is any aa, unknown, or other
MFMQKLKMAAENKIGATKAEFFXQTFEEVHEKLVHRELNLGCC

SEQ ID NO: 52665 - DNA, 654 bp, Zea mays
  misc_feature: Ceres CLONE 1470057-F
  misc_feature: Encodes the peptide sequence at SEQ ID NO. 52666
  misc_feature (223)..(223): n is a, c, t, g, unknown, or other
  misc_feature (654)..(654): n is a, c, t, g, unknown, or other
ggagctccccgcggtggcggccgctctagaactagtggatcccccgggctgcaggaattcgtctcacccctagaaaaaggccaaaccagcacccgccgccgacagggaacatcgccggccgagatcggctgcacatctgtgctgcttcagggcgccggagttcgcgtcgtcgttcggtaacttgcggggtcaatgggaggaggaaaagacagcatgacgagangcgacagggctcttctcgaacatgatgcacggcgttgcccggtgtcatgggtacccccaccagggataccctccgcagggctaccccaccgcaaccaggagcatacccgcctcccccaggggcgtatcctcctcctccaggggcatatcctccctcacctggggcatacccaccacaatatgggtaccctcagccaggtggctacccacctcaaggtggatatcctcctgcaggctaccccggctcatctcaccaggttatggggagcagcacgggggggggcaacggggccacatggggacgggggcaatgctaccagggagtgctgccccggccccttccccttaatgaacacacaagtttcctcatgggcatagcggaaacggtggacatgggggcctttgaagtttagggcccggtggtcacgcccn

SEQ ID NO: 52666 - protein, 121 aa, Zea mays
  misc_feature: Ceres CLONE 1470057-F
MGTPTRDTLRRATPPQPGAYPPPPGAYPPPPGAYPPSPGAYPPQYGYPQPGGYPPQGGYPPAGYPGSSHQVMGSSTGGGNGATWGRGQCYQGVLPRPLPLNEHTSFLMGIAETVDMGAFEV

SEQ ID NO: 52667 - DNA, 797 bp, Zea mays
  misc_feature: Ceres CLONE 1470058-F
  misc_feature: Translation starting site: 135
  misc_feature (1)..(1): n is a, c, t, g, unknown, or other
  misc_feature (2)..(2): n is a, c, t, g, unknown, or other
  misc_feature (191)..(191): n is a, c, t, g, unknown, or other
  misc_feature (410)..(410): n is a, c, t, g, unknown, or other
  misc_feature (421)..(421): n is a, c, t, g, unknown, or other
  misc_feature (475)..(475): n is a, c, t, g, unknown, or other
nncctggagctccccgcggtggcggccgctctagaactagtggatcccccgggctgcaggaattcgtctcaccccttagaaaaacccacgcatactcttctcccccccagtccggaccccggaggagccaagccatggcgtccacctcctgctgcctcctccaccagtcaaccgcccgcctcggcgcgtcnccgcgcctggccgccgccccgccgcgcagcgcccaggtgctcgtctgcagggcccggaagcaggaagccgccccggaccagagcgacttcttcggcccgcgccggggtgggggctccttcgcgggggttcacggcccccgccgggccccagggtggggtccccccccgccgcggtttacgggccccgcgggggaacccccccccgggccaccccacatnccaatacaccnaaataaaccccccccccccgggcgggggggggtggtggcgagggtggggtggtnccccgctcccagggggggaccccccgcggccgaggggggcggggggtgtccccccgcgggccgggggcgctcgcgcggtgtgcgggggagactcccgcgcgggcgcggcgcgtgccgtctgtctttcctgggtttgggtcggtcgcgggcgcggggggctgggagaaggcgccgtccgcccccggccgggggctgctttcgccgggggggactgctccctctcgccgagggcgtcgggtggcggggcggcggggccgcgcgggccgccgcggtgccggtgggcggtcggggcgtgatggggggggcgggaggggccgggggg

SEQ ID NO: 52668 - DNA, 613 bp, Zea mays
  misc_feature: Ceres CLONE 1470064-F
  misc_feature: Translation starting site: 165
  misc_feature: SWISSPROT Homolog: EC 2.5.1.18 Glutathione transferase
ccccgcggtggcggccgctctagaactagtggatcccccgggctgcaggattcgtctcacccctagaaaaatcttcacttatccgaggttccgtgcagcagtggaaaaagcagattttagcagagcagcgagggtcggagaagcctccccagcttcgaatcgctatgcagcccgtcaaggtgtacgccgaccggcggtcgcaaccctcccgagctgtcatcatcttctgcagggtgaaccagatcgatttcgaggagtcacggtggatctgttcagtctcagcacctcacacccgaattcaaaaaaataaacccaatgggacaggtacctgcaattgttgatggagattcaaactatttgaaagtcctggccatttgaggtttcttgcatccgttttccctggagtagctgaccacgggatcctttctaacttgtcccccaaagccaaaattggagcccaccttggagattggcatccctccaaattttggcgggggggggggccaccacccccctttggtaaaggcccaccggggattttggccccccccttccccttgggggccctttcccaacaaaaagatcttttggggggggggggttggtggaaaaa

SEQ ID NO: 52669 - DNA, 635 bp, Zea mays
  misc_feature: Ceres CLONE 1470065-F
  misc_feature: Encodes the peptide sequence at SEQ ID NO. 52670
  misc_feature (568)..(568): n is a, c, t, g, unknown, or other
tccccgcggtggcggccgctctagaactagtggatcccccgggctgcaggaattcgtctcacccctagaaaaagctctctccctctcgtcgctttctttcctggtcgcgccgcccttcatcaggtctcctccgccttagccggtgaagagcgaccaggcccaataaataatcaccatggctcatcaaaagcgtgaaggcagctacgccgatgatgatagtacatccaagcgcatcaaaggcaccgacactgcttctgaaacgggggacagtgtagagtctagtgtttcacagcaaatggatgctgaagctaggaggacctgccaaaaggaaagcgaagcaccatcggacaaatgcgtttcagatggggaatgcgctgcaaactctaaggttttgggtgagcagaagatggtattgactgttgtcgaggctgatgcggcggacgacaagggttgcaggcacactatggaggacgcctgggtggtgctccccaatgctggtgcagaatccccaggaagcttgaggtgcgtacattttgcgatttatgacgggcatggtggtcgcttggcngcagaatatgcacagaagcatttgcatcagaatgtcatcgctgcaggattaccacgtgagttgatgg

SEQ ID NO: 52670 - protein, 153 aa, Zea mays
  misc_feature: Ceres CLONE 1470065-F
  misc_feature: SWISSPROT Homolog: EC 3.1.3.16 Phosphoprotein phosphatase
MAHQKREGSYADDDSTSKRIKGTDTASETGDSVESSVSQQMDAEARRTCQKESEAPSDKCVSDGECAANSKVLGEQKMVLTVVEADAADDKGCRHTMEDAWVVLPNAGAESPGSLRCVHFAIYDGHGGRLAAEYAQKHLHQNVIAAGLPRELM

SEQ ID NO: 52671 - DNA, 633 bp, Zea mays
  misc_feature: Ceres CLONE 1470070-F
  misc_feature (253)..(253): n is a, c, t, g, unknown, or other
  misc_feature (379)..(379): n is a, c, t, g, unknown, or other
  misc_feature (408)..(408): n is a, c, t, g, unknown, or other
  misc_feature (472)..(472): n is a, c, t, g, unknown, or other
ctccccgcggtggcggccgctctagaactagtggatcccccgggctgcaggaattcgtctcacccctagaaaaaactcgctcccttccccgtgcttcccgccgtcgtggagaggtcacgcggctggttcccgccgcttccggacgggttccgagggaggaggatcagctgccgcgatgttcctcaggatctctcgtcttcggggcgcggcttctgcgcgagtctgggagcgagacgagagctggaaatttgcntagcagtccaggcattttgtatcaagctcatcttaaccagcattcgaccagagtgcggaatgtccttttttctcactgcacaagtggtgatcaggatgaaagcagtcaggcaaaggataaaatctncgtaacatttgtttaacaggatggctcanaaaagacaatacgtgttccagttggaatgtccatgttagaagctgctcatgaaaaatgacatanagctttgaggagcatgtgagggttcacttgcgtgttctacttgtcatggtatagtaatggatgtaaactactataacaaatttagagatcccgcagatgaagaaaatgatatgcttgactttgcatttgggctcacagagacatctcgcctcgggtggcaa

SEQ ID NO: 52672 - DNA, 844 bp, Zea mays
  misc_feature: Ceres CLONE 1470071-F
  misc_feature: Encodes the peptide sequence at SEQ ID NO. 52673
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (51)..(51): n is a, c, t, g, unknown, or other
  misc_feature (52)..(52): n is a, c, t, g, unknown, or other
  misc_feature (477)..(477): n is a, c, t, g, unknown, or other
gggtttgccccccctncttnnnccccccnnnnnnnnnnnggggcctctctnngggaaggtggtgctccccgcggtggcggccgctctagaactagtggatcccccgggctgcaggaattcgtctcacccctagaaaatcgacagtcgacactcgagagtcgagaccctctcccagcatcaacccgccccgcgctgccctcgtcccgatctccgacccaaatagcggagggaccatggccggaataaggcttacgcccgaggaacccgagatgcccgttgggacgtcaccccgtccccatttcccacccttggtggccgcggcacgcgctggcgtgttttgtcgcggagggggggggggccagcggaggacgtttttttgttttgttgtggcgggggtgagaagggggcctcttttttttttccccccccgggggggcccgaaaggggggggtacttctttcttttttcactttatanccccgcccccccccttggctagtcacttgttgtggtggtgggtgtggggtctgtggggtgttgttttatatcactgacaaccctcccgccgcggacactcgtcatgtcacccgggcggtgtgcttgcacgctgtcggttgggtgtgtggtttgggtgaattgctacgtgagcgttaggttgggaggggggcgtgacgtggccgactgtagttctgtgcggcgtgcagtggggtttggtagtgtggcgtctcggtacggtggttgtgttgttgggacgtcggttgggtgtcacggtcgggcctgagatgtggttggcagctcggggcgttcgggggtggttggggggatggtatcacacgtgctcccg

SEQ ID NO: 52673 - protein, 106 aa, Zea mays
  misc_feature: Ceres CLONE 1470071-F
  misc_feature (82)..(82): Xaa is any aa, unknown, or other
MAGIRLTPEEPEMPVGTSPRPHFPPLVAAARAGVFCRGGGGGQRRTFFCFVVAGVRRGPLFFFPPRGGPKGGGTSFFFHFIXPPPPLASHLLWWWVWGLWGVVLYH

SEQ ID NO: 52674 - DNA, 658 bp, Zea mays
  misc_feature: Ceres CLONE 1470074-F
  misc_feature: Encodes the peptide sequence at SEQ ID NO. 52675
  misc_feature (434)..(434): n is a, c, t, g, unknown, or other
  misc_feature (560)..(560): n is a, c, t, g, unknown, or other
  misc_feature (561)..(561): n is a, c, t, g, unknown, or other
  misc_feature (575)..(575): n is a, c, t, g, unknown, or other
  misc_feature (594)..(594): n is a, c, t, g, unknown, or other
  misc_feature (652)..(652): n is a, c, t, g, unknown, or other
ctccccgcggtggcggccgctctagaactagtggatcccccgggctgcaggaattcgtctcacccctagaaaaaaaacccggcgaactccgggcagggctcacgtcgccgatcccgctcccggattctctttgccgccgcgaggagacggcgtccagtccaggccttcagcagctccgtctccgtgtgtatctgatcgggggattctttgcttgagaaactgctagcatgggcgcggtgcttggacggcatgacacgcacaagcggagttcccatggttcgaagctggaggtaaagatggtcgacgctatgcagcagagagcatcgcatggaacctcgctgaaatcgttcgatagcattatcatgaagttccccaaaatagacgagagtttcagaaaatgcaagactatcttcgaacagtttgatgaagattcntatggcgaaatagataaagaggaactgaaacattgttttcaaaagctggaaatctcattcacagaggaggagatatgtgatctctttgaagcttgcgatataaatgaagatatgggcatgaagttnncacgagtcattgtncttctgtgccttgtctatnctctcaatgaagcagctgtctcggaagcaaagataagatgggactaggaaatcttgangccacc

SEQ ID NO: 52675 - protein, 137 aa, Zea mays
  misc_feature: Ceres CLONE 1470074-F
  misc_feature (57)..(85): Pfam Name: efhand Pfam Description: EF hand
  misc_feature (111)..(111): Xaa is any aa, unknown, or other
  misc_feature (112)..(112): Xaa is any aa, unknown, or other
  misc_feature (123)..(123): Xaa is any aa, unknown, or other
MGAVLGRHDTHKRSSHGSKLEVKMVDAMQQRASHGTSLKSFDSIIMKFPKIDESFRKCKTIFEQFDEDSYGEIDKEELKHCFQKLEISFTEEEICDLFEACDINEDMGMKXXRVIVLLCLVYXLNEAAVSEAKIRWD

SEQ ID NO: 52676 - DNA, 631 bp, Zea mays
  misc_feature: Ceres CLONE 1470075-F
  misc_feature: Encodes the peptide sequence at SEQ ID NO. 52677
  misc_feature (412)..(412): n is a, c, t, g, unknown, or other
  misc_feature (631)..(631): n is a, c, t, g, unknown, or other
gagctccccgcggtggcggccgctctagaactagtggatcccccgggctgcaggaattcgtctcacccctagaaaaatcgccgcctccatcgctacacaccacgacgcagcgcccgattccgccggccagcaacgatgcagagctccctcgcccggccgccggtactggccggatgcggcgagagacggggcctggcagccgtggcacggtgccgcgctgaggcggcggcgcccgtgtggacggcgtccagggcgcctgtggggccgtacaccgggagggacccggaggtgaagaagcccgcgtggctgcggcagcgcgctgcgcagggggagaagtacgctcgcctgcgggagtccatcggcgagctcaagctcaacaccgtctgcgtcgaggcacaatgccccaacatcngcgagtgttggaacggaggtggaggggccggcggcaaaggggacggcatcgcgacggccaccatcatggtgcttggtgacacctgcacgcgcgggtgtcgattctgcgctgtgaagaccagcaacaaaccgcgcccgctgatcccctggagcctctgaacacggctttgggctgttgcagctggggatttatgtgtgctaacagtgtcgatagagatgn

SEQ ID NO: 52677 - protein, 144 aa, Zea mays
  misc_feature: Ceres CLONE 1470075-F
  misc_feature: SWISSPROT Homolog: EC 2.8.1.8 Lipoyl synthase
  misc_feature (93)..(93): Xaa is any aa, unknown, or other
MQSSLARPPVLAGCGERRGLAAVARCRAEAAAPVWTASRAPVGPYTGRDPEVKKPAWLRQRAAQGEKYARLRESIGELKLNTVCVEAQCPNIXECWNGGGGAGGKGDGIATATIMVLGDTCTRGCRFCAVKTSNKPRPLIPWSL

SEQ ID NO: 52678 - DNA, 655 bp, Zea mays
  misc_feature: Ceres CLONE 1470076-F
  misc_feature: Translation starting site: 181
  misc_feature (281)..(281): n is a, c, t, g, unknown, or other
  misc_feature (492)..(492): n is a, c, t, g, unknown, or other
ctccccgcggtggcggccgctctagaactagtggatcccccgggctgcaggaattcgtctcacccctagaaaaccccaatatatcccccatctcttcgactcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccngcacatgatcgaggatgactggcgcgacaacggcatccctcttcctaacgtcaactccaagatcctatccaaggtaatcgagtactgcaaacagcacgtacatgcccgcgcagccgcagccgccgcctcgaaggccggttccgacgacgtgggtggccgctccgccaacagcaccgccgcctccggtgagggactcaagaactgggatgcngacttcgtcaaggtcgaacaggccacggcttttcgacctcatcttgggtgcaaactatctgaacatcaagggtctgctcgaactgacctggcagactgttgctgacatgatcaagggcaggacaccagaagagattccgcaggacctccaacatcaggaatgg

SEQ ID NO: 52679 - DNA, 643 bp, Zea mays
  misc_feature: Ceres CLONE 1470077-F
  misc_feature: Encodes the peptide sequence at SEQ ID NO. 52680
  misc_feature (327)..(327): n is a, c, t, g, unknown, or other
  misc_feature (359)..(359): n is a, c, t, g, unknown, or other
  misc_feature (366)..(366): n is a, c, t, g, unknown, or other
ctccccgcggtggcggccgctctagaactagtggatcccccgggctgcaggaattcgtctcacccctagaaaaacttgcattcacacactcgattccgctgctctctccctcttcctctcccccgcggcggagccataaaccctaggcctcgccgtcgtcggaggcgccgccgcgatgtcgcactttggaaggacgggtccgccggacatccgcgacaccttctcgctgctcgtcctcacatcagcttccgaacacggccgacgacccttttccgctcttcgagcgctgcggcaaggtcgtcgacgtcttcatcccgaggaccgcangaccggggactcgaggggttttgcgttcgtgncgtacangtacgccgacgaggcgcagaaggctatagatcggctcgatggccgtaatgtggatgggaggaacatcatgttgcagtttgcaaagtacggccccaatgctgtgccaatccacaaaggaagggtcaaagagggggttgagaaatcaagagacaggtcaaggagccgtagtccaagggcaagggccgagaccgagatgatagaaggcgaaatccccacaggagcaggagcaggagcaaagaaagacctgtccatgatagagatagggactttcgtcgtc

SEQ ID NO: 52680 - protein, 156 aa, Zea mays
  misc_feature: Ceres CLONE 1470077-F
  misc_feature (51)..(51): Xaa is any aa, unknown, or other
  misc_feature (62)..(62): Xaa is any aa, unknown, or other
  misc_feature (64)..(64): Xaa is any aa, unknown, or other
MSHFGRTGPPDIRDTFSLLVLTSASEHGRRPFSALRALRQGRRRLHPEDRXTGDSRGFAFVXYXYADEAQKAIDRLDGRNVDGRNIMLQFAKYGPNAVPIHKGRVKEGVEKSRDRSRSRSPRARAETEMIEGEIPTGAGAGAKKDLSMIEIGTFVV

SEQ ID NO: 52681 - DNA, 635 bp, Zea mays
  misc_feature: Ceres CLONE 1470078-F
  misc_feature: Encodes the peptide sequence at SEQ ID NO. 52682
ctccccgcggtggcggccgctctagaactagtggatcccccgggctgcaggaattcgtctcacccctagaaaaagcgattagcgcggcggcagggcaggcatggagaaggaggcggcggcggagctggagatccctggtgagtgccagtacacgggggatccagtgttggtgcgaccgagccagccgacgccgcgccacaccttgcacctctccaacctcgacgaccagcggttcctccgtttctccatcaagtacctgtacgtgttcggcgccgacgccgccgtgcccgccgacgcgctgcgggcggcgctcggcagggtgctcgtcgactactacccgctcgccggccggctccgcccgagcgccgaggaggaggggaagctcgtcgtggactgcaatgccgagggcgccctcttcgccgagggccgcctcccgggcctcgccgccgccgacttcctccgcggcagcgaccggccgcacaagtcctggaggaagctgcactacaggggtggaggcgcagagcttcgtcgccgtgccacctctcgtcgtccaggtcacttggctcgcgtgcggcggcatggtcctctgcaccgccatcaacccactgctctgcgacggatcggcaccgcgcagt

SEQ ID NO: 52682 - protein, 178 aa, Zea mays
  misc_feature: Ceres CLONE 1470078-F
  misc_feature: SWISSPROT Homolog: EC 2.3.1.162 Taxadien-5-alpha-ol O-acetyltransferase
MEKEAAAELEIPGECQYTGDPVLVRPSQPTPRHTLHLSNLDDQRFLRFSIKYLYVFGADAAVPADALRAALGRVLVDYYPLAGRLRPSAEEEGKLVVDCNAEGALFAEGRLPGLAAADFLRGSDRPHKSWRKLHYRGGGAELRRRATSRRPGHLARVRRHGPLHRHQPTALRRIGTAQ

SEQ ID NO: 52683 - DNA, 640 bp, Zea mays
  misc_feature: Ceres CLONE 1470080-F
  misc_feature: Encodes the peptide sequence at SEQ ID NO. 52684
  misc_feature (171)..(171): n is a, c, t, g, unknown, or other
  misc_feature (278)..(278): n is a, c, t, g, unknown, or other
gcggtggcggccgctctagaactagtggatcccccgggctgcaggaattcgtctcacccctagaaaaacggttctcctctctgtctctcgcgcaaggatctcgttctccgcggcagctggtgtttcgctcccttctcgccctcccgacgctggttgcagccggcgccggcnccgcaaacgctaggtgctgaggccttcgcagtgtcttcgacggcgacgagcacgtaccagcatcatgtcggaaaagagtcgcctggcaggacgattgattgataccngcagcagaggggtaccatgtagtccctctagttgaggatccccagagccatcctgaaatcctcgtggatggggaatcggagggctactctgacatttcgtggggttcagcaacgtcggggctaccctgacacccatctgcttgaggaacctaggggctaccctggtggtcttggtggccaaccataggggctatcctgggaagtcgtgggggtagataaacccagggccctatcctgagctccatcaaaggctcaacgcttgagggggggtccctccccccttaccaagctgcctttcaagggataaccccgagttaacggaaatttaaactccggaagctttccggacattaaccgcgctg

SEQ ID NO: 52684 - protein, 39 aa, Zea mays
  misc_feature: Ceres CLONE 1470080-F
MGNRRATLTFRGVQQRRGYPDTHLLEEPRGYPGGLGGQP

SEQ ID NO: 52685 - DNA, 645 bp, Zea mays
  misc_feature: Ceres CLONE 1470081-F
  misc_feature: Encodes the peptide sequence at SEQ ID NO. 52686
  misc_feature (408)..(408): n is a, c, t, g, unknown, or other
  misc_feature (489)..(489): n is a, c, t, g, unknown, or other
ccccgcggtggcggccgctctagaactagtggatcccccgggctgcaggaattcgtctcacccctagaaaactcgtttttctctctcctgcgctgcgccgtccttcacctccgccgccgaatccgagactctgatctcgggttcaccgcagcgcacagagcacccccgactcccgtcccgatccgcgctctcctctacgacgcttcagtcatggcaggaatggcacccgagggttctcagtttgatgctaagcactatgattctaaaatgcaggagctgctgagcactggtgagactgaggagttcttcacttcatatgatgaagtttttgaaagttttgatgacatggggccttcaagagaatcttttgagaggcatttatgcatatggttttgagaaaccatctgncattcagcagagaggaattgttcccttctgcaaggggcttgatgtcattcagcaagcacaatctggtacaggaaagacagncacctttctgtctgggatcttgcagcagcttgactatggtctggttgaatgccaggcccctggtcttgctcccacccgtgagcttgcacagcaaattgagaaaagtatgcgcgcacttggtgactaccttggtgttaaagtccatgcatggcgtgg

SEQ ID NO: 52686 - protein, 109 aa, Zea mays
  misc_feature: Ceres CLONE 1470081-F
  misc_feature (31)..(31): Xaa is any aa, unknown, or other
  misc_feature (58)..(58): Xaa is any aa, unknown, or other
MMKFLKVLMTWGLQENLLRGIYAYGFEKPSXIQQRGIVPFCKGLDVIQQAQSGTGKTXTFLSGILQQLDYGLVECQAPGLAPTRELAQQIEKSMRALGDYLGVKVHAWR

SEQ ID NO: 52687 - DNA, 642 bp, Zea mays
  misc_feature: Ceres CLONE 1470083-F
  misc_feature: Translation starting site: 142
  misc_feature (642)..(642): n is a, c, t, g, unknown, or other
ctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacgggctgggacaccgcggggctgtcggcggacccggagacgttcgccagaaccgggagctgggagtgatccactcccgctgggccatgctgggcgcgctcggctgcgtcttcccggagctgctcgcccgcacggcgtcaagttcggcgagccgtgtggttcaaggcggctccagatcttcagcgaggtggactggactacctcgggaacccgagcctcatccacgcgcggagcatcctcgccatctgggccttgcaggtcgtgctcan

SEQ ID NO: 52688 - DNA, 649 bp, Zea mays
  misc_feature: Ceres CLONE 1470088-F
  misc_feature: Encodes the peptide sequence at SEQ ID NO. 52689
  misc_feature (647)..(647): n is a, c, t, g, unknown, or other
  misc_feature (649)..(649): n is a, c, t, g, unknown, or other
ctccccgcggtggcggccgctctagaactagtggatcccccgggctgcaggaattcgtctcacccctagaaaaagcaaccgtcccacacgagcaaagagccctcgttcccctcctcttccgctcgagtccatcgccgtcgccgtcgccctgccctcgtatctcctcccacgacaccggtgaccaccacaggccaccgtcctgatcctcatccgggtcatccccaggcaggcaggtcggcgaggagggcagcaagaccgagccatgcgggggctcgggacgtgaacgggacaggaccccaaaatctcagatccttcctgctcgcccgcccgtgcccgtcggcgcgtctttcttgccgtccgcgccccacctccgccctctcctcctccaggggaatcagatatgccacacgctgcgcgatggtgttgtgggtcttcggctacggctccctcatctggaacctcggcttcgacttcgacgacaaaatcctcggcttcatcaagggctacaaccgcacctttaatctcgcttgcattgaccacagaggcacagcggagcatccggcgaggacctgcacgcttgaaaccgacgacgaggcgacgacgaggccatatgctggggaattgcatattgtgtcaagggtggtcanan

SEQ ID NO: 52689 - protein, 76 aa, Zea mays
  misc_feature: Ceres CLONE 1470088-F
  misc_feature (3)..(75): Pfam Name: ChaC Pfam Description: ChaC-like protein
MVLWVFGYGSLIWNLGFDFDDKILGFIKGYNRTFNLACIDHRGTAEHPARTCTLETDDEATTRPYAGELHIVSRVV

SEQ ID NO: 52690 - DNA, 871 bp, Zea mays
  misc_feature: Ceres CLONE 1470090-F
  misc_feature (43)..(43): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (408)..(408): n is a, c, t, g, unknown, or other
taggttggccccaagctcctcccggtgcgcccccccgcggggnttnnnnnnnnnaaannnggggctccccgcggtggcggccgctctagaactagtggatcccccgggctgcaggaattcgtctcacccctagaaaaacttcccctcgctcgactcgatccgcagcaagctaagcgcaaccgaccagctacgcaacccatggctttcgcttcctcgaatgccaagcagagcctctacccggatgtggaccagtcccaccctgatctcaatacccctttcttctccgcacccaccacctccacctgcgccggcgccggcgccgccacgggcaactccctctaccccaccgtcgaccccaacgagctcgcacagaacctcttcccccagacggtcgaagaggaacgcggnacccgccaccgccccaccacaggagggaggaaccatccatccgctgtccccctggggggggaaagtttcaaccgtgggccccccccgcgcggaaccgaaaggggttgaagttgcgggcggcggggggacggcctcctcccactcccgggggggccctccccggccgagggggggggaagccaactttccggggcggcgcggatggcctccccccccgcccctcgtgagccccacggacaaaaaccccacggaccgaaacgggcgccgcgggcgccccgccgtttgcggggattggggcccacggggaggtggggggggggacctgaaagggccggggggggaccagaagccgcaggacacccccaagcccacgggggccctccctggccccgcccacgaaaggtgcccggggacggagtaaaagacatggaacaccccagtacggggaagacaggcgcggatg

SEQ ID NO: 52691 - DNA, 696 bp, Zea mays
  misc_feature: Ceres CLONE 1470093-F
  misc_feature: Encodes the peptide sequence at SEQ ID NO. 52692
  misc_feature (287)..(287): n is a, c, t, g, unknown, or other
  misc_feature (290)..(290): n is a, c, t, g, unknown, or other
tccccgcggtggcggccgctctagaactagtggatcccccgggctgcaggattcgtctcacccctagaaaaaaaccaagaacaaaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgtggatcctgtatncgntagtccttgcctgcaaggtcttggttgttttgttttggtggccaagcatccaatgttctgcttcttgatccaaatcttgaaaaatcgcgaatcgtcttctttcggttcggaccggaattttagggcaacattgatgggaggggggcggggtttttctggggtttgagcccccggccccacccccgaggggagaaatttcccccccccaaaaaattttgggaccctttcccaaattttttgggaacctctttaaaaattccccccccgagaaaagcgggggtttccttccccctttttaaaaaaaaaaaaaaaaattggtccccccccctgggggggggctcttttccagaggggggggccccccccggggggggccccaaaaataaaaaaaaaagaattttggggg

SEQ ID NO: 52692 - protein, 35 aa, Zea mays; identical to SEQ ID NO: 7877
  misc_feature: Ceres CLONE 1470093-F

SEQ ID NO: 52693 - DNA, 663 bp, Zea mays
  misc_feature: Ceres CLONE 1470094-F
  misc_feature: Encodes the peptide sequence at SEQ ID NO. 52694
ctccccgcggtggcggccgctctagaactagtggatcccccgggctgcaggaattcgtctcacccctagaaaaagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgcctacaaactccctcatggatgcacgggcgcaacaacggcaagaaggtcatggctgcccgcatcatcaagcataccctggagatcattcagctggtcaccgatgccacccccctccaggtcgtcgtcgacgcgatcatcaacagggggcccccgtgaggatgccacccgtattgggttcccctgggggttgggaaaaggcaggcccttgaatatcccccccccctggaggaggggaaaacagggccatcttacctccctcccccactggggggccaggggaaaagtgtctttcccggaaaaacaaaaa

SEQ ID NO: 52694 - protein, 117 aa, Zea mays
  misc_feature: Ceres CLONE 1470094-F
  misc_feature (44)..(115): Pfam Name: Ribosomal_S7 Pfam Description: Ribosomal protein S7p/S5e
MAEVEQQQDTPKLFNRWTFDDVQVNDISLNDYLAVNATKHAMYLPHTAGRYSKKRFRKAQCPIVERLQTPSWMHGRNNGKKVMAARIIKHTLEIIQLVTDATPLQVVVDAIINRGPP

SEQ ID NO: 52695 - DNA, 643 bp, Zea mays
  misc_feature: Ceres CLONE 1470098-F
  misc_feature: Encodes the peptide sequence at SEQ ID NO. 52696
  misc_feature (236)..(236): n is a, c, t, g, unknown, or other
tccccgcggtggcggccgctctagaactagtggatcccccgggctgcaggaattcgtctcacccctagaaaatcctgtctccgtcttctcaccaccgctgcctccgcggtttcgcttccccccgtcttcccaagcctttgcttcgctcttcgcttcggattccctctgctcatggccgggagagggaaggcgatcggctcaggggccgccaagaaagccatgtccaggagctccanggccgggctccagttcccagtgggaaggatcgccaggttcctcaaggcccggcagtacgccgagagggtcggcgccggcgcccccgtctacctcgctgccgtgctcgagtatcttgctgctgaggtaaagaagacttccaattttgcggtggtagtgttcgatttggttttgagcactaggaattttgggtcctgtggtttcctgtcgtggaaattgcccctgatactgtagaacagctggggggatttcagatgacgatctagatttcggcgattgctatgctaggtcactgtggaaccagtgaggattttgaccgactaaaccggtgggactctctgcctgctcgttcgtgcaggttctcgagcttggccgggacgcggcctcggacaacaagagacccgcatcc

SEQ ID NO: 52696 - protein, 98 aa, Zea mays
  misc_feature: Ceres CLONE 1470098-F
  misc_feature (19)..(84): Pfam Name: Histone Pfam Description: Core histone H2A/H2B/H3/H4
  misc_feature (22)..(22): Xaa is any aa, unknown, or other
MAGRGKAIGSGAAKKAMSRSSXAGLQFPVGRIARFLKARQYAERVGAGAPVYLAAVLEYLAAEVKKTSNFAVVVFDLVLSTRNFGSCGFLSWKLPLIL

SEQ ID NO: 52697 - DNA, 704 bp, Zea mays
  misc_feature: Ceres CLONE 1470099-F
  misc_feature: Encodes the peptide sequence at SEQ ID NO. 52698
  misc_feature (677)..(677): n is a, c, t, g, unknown, or other
agagctggagctccccgcggtggcggccgctctagaactagtggatcccccgggctgcaggaattcgtctcacccctagaaaaaatcgacccgagatctatcattcgcattctctgcggtgcagctcaggggtgcggtctgtggcgcctcctctccaagcagactatcacctggcggaagctgggccgctccgctgcttcggcaatggcgcactctctccgtgatcggatccctcctctggctccacctcatccccgccgtggcgcaggcgccgagaactattcccgcgacctctgccacaccatcgactccggactcaacgatgacccctgcctgaccttggactccggcgtgtgtttcgaggcctgtcgcggtctcgactccggccgcaccaacgaccacggcctccctcactactcttggtgccccgacgactcgtatagcaccgagtactgtggctccactaacaacacctgtgaacaccaaagttgtggcgcgatactcgtcgcaggatcttagcacgctctggccaccaggctcctccatggatctcggcagacatccgccaggtcaggactagcggcctcgaccgcaatgtccccgctcatgaagatccccccagatgggctgtcttcttttcaggacccttagcggagagctacttctgggcttgcggntgaccctacagaggggcaggccggacg

SEQ ID NO: 52698 - protein, 104 aa, Zea mays
  misc_feature: Ceres CLONE 1470099-F
MAHSLRDRIPPLAPPHPRRGAGAENYSRDLCHTIDSGLNDDPCLTLDSGVCFEACRGLDSGRTNDHGLPHYSWCPDDSYSTEYCGSTNNTCEHQSCGAILVAGS

SEQ ID NO: 52699 - DNA, 683 bp, Zea mays
  misc_feature: Ceres CLONE 1470107-F
  misc_feature: SWISSPROT Homolog: EC 3.2.1.23 Beta-galactosidase
  misc_feature (188)..(188): n is a, c, t, g, unknown, or other
  misc_feature (445)..(445): n is a, c, t, g, unknown, or other
  misc_feature (518)..(518): n is a, c, t, g, unknown, or other
  misc_feature (582)..(582): n is a, c, t, g, unknown, or other
agagctggagctccccgcggtggcggccgctctagactagtggatcccccgggctgcaggaattcgtctcaacccaacttaatcgccttgcagcacatccccctttcgccagctggcgtaatagcgaggaggcccgcaccgatcgcccttcccaacagttgcgcagcctgaatggcgaatggaaattngtagcgttaatattttggtaaaattcgcgttaaatttttgttaaatcagctcattttttttaccaataggccgaaatcggcaaaatcccttataaatcaaaagaatagaccgagatagggttgagtgtttttccagtttggacaagagtccactattaaagacgtggactccaagtcaaagggcaaaaaacctctatcagggcgattgccactacgtgaaacatcaccctaatcattttttttggggcgaggtcccntaaaccactaatcggaaccctaaaggggacccccgatttatagcttgaccgggaaaagccccccaacttgccnaagaaaggaaggggaaaaaaccgaaagggggcgggcccctaaggccccctggaaaatttaaccntttccccttttccctaaaacccacccacacccccccgcccctttaaatgccccccccttaccgggggcgccggcaagggggggcctttttttttcggggaa

SEQ ID NO: 52700 - DNA, 643 bp, Zea mays
  misc_feature: Ceres CLONE 1470108-F
  misc_feature: Translation starting site: 151
  misc_feature (165)..(165): n is a, c, t, g, unknown, or other
  misc_feature (643)..(643): n is a, c, t, g, unknown, or other
aaagctggagctccccgcggtggcggccgctctagaactagtggatcccccgggctgcaggaattcgtctcacccctagaaaatctcgatccggaaacctctcaaaccctagccgcctcctgcaagtttcagagctcaggaatctgcgccatggcgagtgagacngagaccttcgcatttcaggctgagatcaaccagctgctctcactcatcatcaacaccttctactccaacaaggagatcttcctccgcgagcttatctccaactcttccgatgcgctggacaagatcagggtcgagagtctcactgacaagagcaagctcgatgcgcagcctgagcttttcatccactttgtcccagacagggcacgaacacgctctccatcatcgacagcggcatcggcatgaccaagtccgacgttgtcaaacacctcggtcccatcgccaggtccggacgaaggagttcatggaaaccccttgctgccggccctaatgtgtccatgattggcccgttcggcgtctgtttttacttctgctacctcgtccccaaaaagagtttcgtgccccccaagcccaacgattgacaagccgttccgggggggaatccccaaggggggggggtctttcacctgttaccccggan

SEQ ID NO: 52701 - DNA, 672 bp, Zea mays
  misc_feature: Ceres CLONE 1470127-F
  misc_feature: Encodes the peptide sequence at SEQ ID NO. 52702
  misc_feature (672)..(672): n is a, c, t, g, unknown, or other
aaagctggagctcaccgcggtggcggccgctctagaactagtggatcccccgggctgcaggaattcgtctcacccctagaaaaaactagtctcacgtggtcatcactcaccgcgccgccgccgccgccaccgccagcaatggcgcgccgcctcttctgtgccacgagaacgctcctccttcctgccccagctcccgtgccggcgcccacctctgcgtcttctgcagcggccgcggaagcgtcggcctcgctcctgccactgctcccctgcaagcggagaaagaaactcctgaggaagctcaaacagcccacggtcgcgcctatcgagccggaggccgcgcgtcgcgttccggccctcgacgccgtgctcgaccgcgatacggccttccgcttcctccacggggcgcgctcgttcctggcttccctcccgcctccgcacgggatccccctttgcgagggtggaaagctgtacgcgagctcggcttcccccgcggccgaaagtgtcccgctcccctacgcgccacccgctgctgttccacctccccagtcgtggactcccgttccgcacctcgggctcacgcggttcatggtctcccctcctgaaggaagagggccgaatccaaaaagaacttccttcctttgcgggggggctccaagtcagggaagctcctcn

SEQ ID NO: 52702 - protein, 178 aa, Zea mays
  misc_feature: Ceres CLONE 1470127-F
MARRLFCATRTLLLPAPAPVPAPTSASSAAAAEASASLLPLLPCKRRKKLLRKLKQPTVAPIEPEAARRVPALDAVLDRDTAFRFLHGARSFLASLPPPHGIPLCEGGKLYASSASPAAESVPLPYAPPAAVPPPQSWTPVPHLGLTRFMVSPPEGRGPNPKRTSFLCGGAPSQGSSS

SEQ ID NO: 52703 - DNA, 686 bp, Zea mays
  misc_feature: Ceres CLONE 1470130-F
  misc_feature: Encodes the peptide sequence at SEQ ID NO. 52704
aaagctggagctccccgcggtggcggccgctctagaactagtggatcccccgggctgcaggaattcgtctcacccctagaaaaagaaagcctaatgcacttaacatcgccgcggagttgctccgcgcccccgacgcctgtgattatgagcaggagcaagaggggttcggaatggccgagtctgagaaccacacggcgcataaccagtcgttcaaggcgcacaagaacggcatcaagaagcccaagcgcctccggcagacctccaccaaggggatggaccccgagtttctgaggaacttgaggtactcaaggaagggtaataagaagagttgtgaggctgagtcagacgagtgagatgatgcctgagtttgtggcgacaaatgcatctcttgtatccttacggacatactcccccactctttttgacatctgtctgattccaagagattcatcaattggtactgaactgatgtttttttgtcttgttgcctatctggagtttagttaactcacatcatcacgttgtgtcctctgagaatcgggcacttactgtatcagaaagcaaacaacacgcaatgccgtcacgagtgtcgaacctcaaaaaatccctggtcacctcactactctgcatctcggcattgtctgcatcgccatggccatgcatcgcagtgggtcatctgggccgcg

SEQ ID NO: 52704 - protein, 60 aa, Zea mays
  misc_feature: Ceres CLONE 1470130-F
  misc_feature (3)..(42): Pfam Name: Ribosomal_L29e Pfam Description: Ribosomal L29e protein family
MAESENHTAHNQSFKAHKNGIKKPKRLRQTSTKGMDPEFLRNLRYSRKGNKKSCEAESDE

SEQ ID NO: 52705 - DNA, 646 bp, Zea mays
  misc_feature: Ceres CLONE 1470134-F
  misc_feature: Encodes the peptide sequence at SEQ ID NO. 52706
  misc_feature (487)..(487): n is a, c, t, g, unknown, or other
  misc_feature (597)..(597): n is a, c, t, g, unknown, or other
  misc_feature (638)..(638): n is a, c, t, g, unknown, or other
ctccccgcggtggcggccgctctagaactagtggatcccccgggctgcaggaattcgtctcacccctagaaaaaaaaaaaccccaaactcctctgggctcttgtcctccctccctctccagccgccgccgccgccgccgccgccgcccagagccgagcatgccgggtgccttccactccctcctccttcccctcaaacggaagcgcaaatccaaacgccgcagcagacgcggtcaccgaaaggagaacaaccccaacatatccaagaaccacctcgccgccgctggagacccgtccttccacctgaaaagctgcacctctgtctcccccagagacatcggactccttgtccagccgctcggcaacctcttcctctccgccaccccgcgagctaacctccgggacgcggggctcggcgcgctccggcctcttccagacgacctgctcctcgacgtccttggcttgctccccgcgcgcgacctcgcggngctctcgggtgcgtccaaggcgctctacgtcgtcgcctcccacgacccgctctggcggaccctcgtcctcgacgagctcgggcggcgcctcgacttcggcgggatctggncgcgcaactacatcggcgccgcctccgggggccaggcctanctcatccc

SEQ ID NO: 52706 - protein, 162 aa, Zea mays
  misc_feature: Ceres CLONE 1470134-F
  misc_feature (110)..(110): Xaa is any aa, unknown, or other
  misc_feature (147)..(147): Xaa is any aa, unknown, or other
  misc_feature (160)..(160): Xaa is any aa, unknown, or other
MPGAFHSLLLPLKRKRKSKRRSRRGHRKENNPNISKNHLAAAGDPSFHLKSCTSVSPRDIGLLVQPLGNLFLSATPRANLRDAGLGALRPLPDDLLLDVLGLLPARDLAXLSGASKALYVVASHDPLWRTLVLDELGRRLDFGGIWXRNYIGAASGGQAXLI

SEQ ID NO: 52707 - DNA, 644 bp, Zea mays
  misc_feature: Ceres CLONE 1470144-F
  misc_feature: Encodes the peptide sequence at SEQ ID NO. 52708
  misc_feature (138)..(138): n is a, c, t, g, unknown, or other
  misc_feature (286)..(286): n is a, c, t, g, unknown, or other
  misc_feature (299)..(299): n is a, c, t, g, unknown, or other
  misc_feature (432)..(432): n is a, c, t, g, unknown, or other
  misc_feature (453)..(453): n is a, c, t, g, unknown, or other
  misc_feature (464)..(464): n is a, c, t, g, unknown, or other
  misc_feature (466)..(466): n is a, c, t, g, unknown, or other
  misc_feature (468)..(468): n is a, c, t, g, unknown, or other
  misc_feature (569)..(569): n is a, c, t, g, unknown, or other
ctccccgcggtggcggccgctctagaactagtggatcccccgggctgcaggaattcgtctcacccctagaaaaatctcccttcggttccccaattcgaaatcgaatcgggtcggtcttgccgtgcgtgcgtggctgcncgagcgactcgactgcacccccggctcttccaggtcccacacactggcgcgccgccgccgggtcctcctagggtttcggccgcgatgtcgctcccgccgagcgagcgggagcagatgcggaagggcaactaccagcagacggtggacncggaggagagccnccgccgccgcgaggggcagatggtggacatccgcaaggccaagcgcggaggaaagcctccagaagaagcgccgcgatgggtttcccgcctccgccgctggggtgcccgccatgggccactccaccgcgctcancaaaaactcgatggcttcccngcaatgtgaangncntccactccaacgacccctccgtggagcttgaggccaccaccaagttcaggaagctgctttctttaaaacgtagtcccccatcgaaaaggtgatcaccccanggagtggggcccctatttcattgattttctttaccgtgaaggaccttcccccaactccgttttgaggctgcatgg

SEQ ID NO: 52708 - protein, 79 aa, Zea mays
  misc_feature: Ceres CLONE 1470144-F
  misc_feature (22)..(22): Xaa is any aa, unknown, or other
  misc_feature (26)..(26): Xaa is any aa, unknown, or other
  misc_feature (70)..(70): Xaa is any aa, unknown, or other
MSLPPSEREQMRKGNYQQTVDXEESXRRREGQMVDIRKAKRGGKPPEEAPRWVSRLRRWGARHGPLHRAXQKLDGFPAM

SEQ ID NO: 52709 - DNA, 664 bp, Zea mays
  misc_feature: Ceres CLONE 1470146-F
  misc_feature: SWISSPROT Homolog: EC 1.2.1.70 Glutamyl-tRNA reductase
aagctggagctccccgcggtggcggccgctctagaactagtggatcccccgggctgcaggaattcgtctcacccctagaaaaaagtttggctccaagcagcacaaggcctttcttcctcctctgcagccaactcgtcccctcgggccaacgcgaggccaaaaccaatcacatctcctccccctgaccccctcccaccaccgaggacccttccccaagaactgccccgagtcctggagcgggagagaggtcgagggaggagtccaataagagtttctcctcgcctctctctctttctgctcgaaaaattattgtcgcattggtttggttcccttgccaaaggaggcggctttctgtcctcgctgatctaacatgatggcgagcaccgcgtcagcgaccgccgccgccgccgtggcattcggggcagccgccaagccgcggggaccggcggcggcgctccgcgcaagagtgcctgccggcggcagggcgcgctccggcatgggtggtgcgctgcgacgccggcgtggaagcccaggcgcaggcggtggccaaggccgccagcatcgccgcgctcgagcagttcaagatctccgcagaccggtacatgaagggaaagagtagcgtagctgtgataggtctcagtgtacacccagcaccagtggagag

SEQ ID NO: 52710 - DNA, 821 bp, Zea mays
  misc_feature: Ceres CLONE 1470148-F
  misc_feature: Encodes the peptide sequence at SEQ ID NO. 52711
  misc_feature (36)..(36): n is a, c, t, g, unknown, or other
gttccctacggcattcccctacctcccctacccccnccgccccttcctcaaactggaactccccgcggtggcggccgctctagaactagtggatcccccgggctgcaggaattcgtctcacccctagaaaaatcggccagtacagtgcccaggcggttagggtttcgcccaccacatcgacctacggcgacggccaaacagcaggcgcagccatggcctcccccggcggcggcatgggagcggcctaggcacggccatggcggccggaagcacggccccctgagcgagccccccggcggcgcatgttctggcggcgcgcggttccggttaggcgggcgcggcggcccggtaacgtgcggctccggccacgcgggcgcggtggctccggccagttattgataatgggcatggtgatctcggccataggctcttatgtcacctgcgcgcaaggaagcccaccccccccaagcgggacaacccaaaattggtgatgggtctgctcgtgtcccgcggcatctcttatctttccgtaggatcgtcttcagggcggatcgaccgagaggcgtggcacatctctcttcaagaaccttgcttggagcctcataacgcacccttgaagtttgttgagggctaattaacctccctggtcccctctcgggacattggttcccacgcccatagattctatcaatataatggccccgtttcctttgatcaattctatactttctagaaaatctctgtttgtacagctggccaccccacgtgaaatttgggtatagtggatccgttcgctttatttttttactgtcccgtctcgt

SEQ ID NO: 52711 - protein, 62 aa, Zea mays
  misc_feature: Ceres CLONE 1470148-F
MFWRRAVPVRRARRPGNVRLRPRGRGGSGQLLIMGMVISAIGSYVTCAQGSPPPPSGTTQNW

SEQ ID NO: 52712 - DNA, 1092 bp, Zea mays
  misc_feature: Ceres CLONE 1470151
  misc_feature: Encodes the peptide sequence at SEQ ID NO. 52713
tctcatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcggcgcaccctccctacgctgagatgattgtagaggcgatcgctgccctcaaggagaggaaggggtcgagctcggtggccatcagcaagtacgtcgaggggaagcacggcggcaagctccccaccaacttccgcaagcagctcaccgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaagcccaaggccaaggccaaggccaaggccaagcctgtcgctcctgccgccgcgtcgcccaagccccgcgggcgccctcccaaggtcgccaagacctccgccaaggcctcccccgccaaggcagccaagaaggcggctgctcctgccaagaagggaaaggcagcggcggctcctaagaaggtggcaaccccgaagaaggctgctgctgctgccgctccggtcaggaagggcgtggccaggaaggccaagaagtagtctgcccgccttgtcgctggcgagatccccccctcaattccgcctatagattcccctctttcatggattttgatccaatcgtaatattgtcagtagctctagattcgtcggtagctccagcatgagtgtcggtggtagttctgtgcctgtaaaaacttgggatggttgatcgcgtgtgatcagccgtcatgctcctccagtctctatgaacaagctaagctataatagtattttgcttcctaaaaaaaaaaaaaaaaa

SEQ ID NO: 52713 - protein, 246 aa, Zea mays
  misc_feature: Ceres CLONE 1470151
  misc_feature (54)..(124): Pfam Name: Linker_histone Pfam Description: linker histone H1 and H5 family
MSTEEAVVAEVPVTEVPAEVPAAQVAEAPKAKKAPKEKKAPKEKKPSAAKKPAAHPPYAEMIVEAIAALKERKGSSSVAISKYVEGKHGGKLPTNFRKQLTVQLKKLAAAGKLTRVKNSFKLPATDAKPKAAKPKAPKAAPKPKPSPKAKAKTAAKPKAASPKPKAKAKAKAKPVAPAAASPKPRGRPPKVAKTSAKASPAKAAKKAAAPAKKGKAAAAPKKVATPKKAAAAAAPVRKGVARKAKK

SEQ ID NO: 52714 - DNA, 638 bp, Zea mays
  misc_feature: Ceres CLONE 1470157-F
  misc_feature: Translation starting site: 177
  misc_feature: SWISSPROT Homolog: EC 2.3.1.119 Icosanoyl-CoA synthase
  misc_feature (467)..(467): n is a, c, t, g, unknown, or other
  misc_feature (468)..(468): n is a, c, t, g, unknown, or other
  misc_feature (484)..(484): n is a, c, t, g, unknown, or other
  misc_feature (492)..(492): n is a, c, t, g, unknown, or other
  misc_feature (493)..(493): n is a, c, t, g, unknown, or other
ggagctccccgcggtggcggccgctctagaactagtggatcccccgggctgcaggaattcgtctcacccctagaaaaaactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtgggggggaggccacctacgnnactcgcaccgtgctcngcttcctnncgcgtctcgcctttcacatctccgtctacatcatgtccaggcccaggcccgtgtacctcatcgacttcgcatgctacaagccggccgacgagctcaaggtgtccaaggcggagttcatcgacctggcgcgcaagtccggccagtt

SEQ ID NO: 52715 - DNA, 676 bp, Zea mays
  misc_feature: Ceres CLONE 1470162-F
  misc_feature: Encodes the peptide sequence at SEQ ID NO. 52716
  misc_feature (416)..(416): n is a, c, t, g, unknown, or other
aagctggagctccccgcggtggcggccgctctagaactagtggatcccccgggctgcaggaattcgtctcacccctagaaaaagcccacttctctcccacctcccctccactcttttgcctgtcgcggggttagaatcccatggcgctgtcgtccgagatccgcttcggccaccagatccccctatcccactgcgacactgactcctacgaggaggaggaagaagaggaggaggaagacgaggaggagttcgagggggaggaggaggaggagatggatgaggtgacggtttcgtctccgctgctgcttccggcaacggaggccaggggaggggtgtccgtggtcgagatggtggcgggggcgctccggaagtcgctcatgctgtgcagcagcagcgccggcgccggcgtcccctanccggaacaggaggaggacggggcgactcccccgggtggtatgcagataggggggccaacggatgtgcggcacgtctcgcacgtcaccttcgaccgcttcgttgggcttctcggcctccccgctgacctcgaagccgacctgcctcgccccgtgccgagcgccagtgtgagcgtatttggagtttcacccacttccctgcagtgctcgtatgaaagaaaagaaaacagggtgccaactatcctcttgactattcaaaaaaa

SEQ ID NO: 52716 - protein, 178 aa, Zea mays
  misc_feature: Ceres CLONE 1470162-F
  misc_feature (107)..(153): Pfam Name: PBD Pfam Description: P21-Rho-binding domain
  misc_feature (92)..(92): Xaa is any aa, unknown, or other
MALSSEIRFGHQIPLSHCDTDSYEEEEEEEEEDEEEFEGEEEEEMDEVTVSSPLLLPATEARGGVSVVEMVAGALRKSLMLCSSSAGAGVPXPEQEEDGATPPGGMQIGGPTDVRHVSHVTFDRFVGLLGLPADLEADLPRPVPSASVSVFGVSPTSLQCSYERKENRVPTILLTIQK

SEQ ID NO: 52717 - DNA, 743 bp, Zea mays
  misc_feature: Ceres CLONE 1470166-F
  misc_feature: Encodes the peptide sequence at SEQ ID NO. 52718
  misc_feature (329)..(329): n is a, c, t, g, unknown, or other
  misc_feature (359)..(359): n is a, c, t, g, unknown, or other
  misc_feature (418)..(418): n is a, c, t, g, unknown, or other
  misc_feature (460)..(460): n is a, c, t, g, unknown, or other
aaagctggagctccccgcggtggcggccgctctagaactagtggatcccccgggctgcaggaattcgtctcacccctagaaaaaatctccagcggcttcttccaaagctccaactacgacgagaaccgccactcctcgaaatctccaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtncaggataggattggctacagcatgatcacngacgcagaggagaaagggctgattactccaggcgtgagtgttctgatttgaccaactanccgcaacccgggcattggactggccctttattgctgctggcnagggctacaaacttaccctcccaatgcccgccctcctggaccgtggagagggagatccttttgtgaaggtttttggggggtgaaattttccttttggaaacccctccttggaaaaaaaaaggggttttctaaaaaaggggaaaaaaaacaccaaaaaaccccccccctcccacccctttcccatttttagaaacccccctccccccaaaaatttctttttaagaacccggggggggttaaatttggaaaaccccccccgaaaaaaaatttttggttttttttt

SEQ ID NO: 52718 - protein, 74 aa, Zea mays
  misc_feature: Ceres CLONE 1470166-F
  misc_feature: SWISSPROT Homolog: EC 2.5.1.47 Cysteine synthase
MGEASPSIAKDVTELIGNTPLVYLNKVTDGCVGRVAAKLESMEPCSSVQDRIGYSMITDAEEKGLITPGVSVLI

SEQ ID NO: 52719 - DNA, 685 bp, Zea mays
  misc_feature: Ceres CLONE 1470167-F
  misc_feature: Encodes the peptide sequence at SEQ ID NO. 52720
  misc_feature (627)..(627): n is a, c, t, g, unknown, or other
aaagctggagctccccgcggtggcggccgctctagaactagtggatcccccgggctgcaggaattcgtctcacccctagaaaaaatcagtagctagctgttcgaagctttcagccgagcaccatcgtcacagtcagtagccaagcatatttctttctccgagtgatttgcgctgagcgatcagttcatccagagcgagcggagctgagctgagctgagctgagcgagcttgcgttgcttgagagaccctgctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcggctacctgggaaagaagaccgacgaggccaagcacaaggccggcgagacgacggaggccaccaagcagaaagccagcgagacgacggaggcgaccaagcagaaggccggcgagacgacggaggccgccaggcagaaggcagccgacgccatggaggcagccaagcagaangccgccgaggccgggcagtacgccaaggacaccgtcgtctccggcaaggacaagtcca

SEQ ID NO: 52720 - protein, 143 aa, Zea mays
  misc_feature: Ceres CLONE 1470167-F
  misc_feature (74)..(117): Pfam Name: LEA_4 Pfam Description: Late embryogenesis abundant protein
  misc_feature (124)..(124): Xaa is any aa, unknown, or other
MASHQDKASYQAGETKARTEEKTGQAVGATKDTAQHAKDRAADAAGHAAGKGQDAKEATKQKASDTGGYLGKKTDEAKHKAGETTEATKQKASETTEATKQKAGETTEAARQKAADAMEAAKQXAAEAGQYAKDTVVSGKDKS

SEQ ID NO: 52721 - DNA, 649 bp, Zea mays
  misc_feature: Ceres CLONE 1470170-F
  misc_feature: Translation starting site: 209
  misc_feature (458)..(458): n is a, c, t, g, unknown, or other
  misc_feature (482)..(482): n is a, c, t, g, unknown, or other
  misc_feature (507)..(507): n is a, c, t, g, unknown, or other
ctccccgcggtggcggccgctctagaactagtggatcccccgggctgcaggaattcgtctcacccctagaaaaaagcgccggcggactccgctcgcacgccatactcagcctactccgtcttcccctgtctagcagacaccctcttcccctctccactcccaatcttatcgtcgcctccctcgacgtcgctgctgcctccacttcaccatggcgcttcacgccccggtcctcgttctgaaggactcgctgaagcgggagtctggcgcgaaggttcaccaagccaacatccaggcggccaaggctgtcgctgacatcatacgcactacattgggtcccagatccatgctgaaaatgcttctggatgctagtggaggtatttgtggtactaatgatggtaaatgcattttgagggaaatagacattgcacaccctgctgccaagtctatgatcgaactangtcgtacacaggatgaagaaagtnggtgatggcactacatctgtcattngtctagctggagagatgctacatggtgcacaggcattcatcggacagaactaccatccaactggtatttgccgagcatatacaaaagcgcttgatgatgctatggctgtacttgacaaaattgcaatgggctgtgatgtgaa

SEQ ID NO: 52722 - DNA, 659 bp, Zea mays
  misc_feature: Ceres CLONE 1470176-F
  misc_feature: Encodes the peptide sequence at SEQ ID NO. 52723
  misc_feature (180)..(180): n is a, c, t, g, unknown, or other
tggagctccccgcggtggcggccgctctagaactagtggatcccccgggctgcaggaattcgtctcacccctagaaaaaatgcgaatactgctggagttggcctaacccaacgaccagacgcaacacgacggcgacggccatggcttcgccggacctcgccgccggcgacggcagctacnactttcaccttcgctctctctccgcggcctcacgggactccgctgcggcctccgaccccgcctctgaccccaacctcctccaatctgttaggagggtgtgcgagatgtgccgaacggcgaaggaagccaaggacgagatggtggccccggcgttccccgtgatggggcagctatttcagcgatgcgccgccgctcccacgcagggccgttgcctccaccggcgtgctgctcctcaccattttgcaattcttcttggattttggggaagctgtttttcatgatgctgatgggaccttgaaaaccttcttcgcttctgcttaagtagggagtttgccaatcctttttgttgcagaaccgcccatttgaattcctttggaacaaaacagaacaagatccttaagccccttttcccatttggattccacagttcctatcctttggtggtaaaacctttattgctcccaacggggaaggagctg

SEQ ID NO: 52723 - protein, 106 aa, Zea mays
  misc_feature: Ceres CLONE 1470176-F
  misc_feature (14)..(14): Xaa is any aa, unknown, or other
MASPDLAAGDGSYXFHLRSLSAASRDSAAASDPASDPNLLQSVRRVCEMCRTAKEAKDEMVAPAFPVMGQLFQRCAAAPTQGRCLHRRAAPHHFAILLGFWGSCFS

SEQ ID NO: 52724 - DNA, 682 bp, Zea mays
  misc_feature: Ceres CLONE 1470183-F
  misc_feature: Encodes the peptide sequence at SEQ ID NO. 52725
aagctggagctccccgcggtggcggccgctctagaactagtggatcccccgggctgcaggaattcgtctcacccctagaaaaagttccccctgcctaggccgccgccggggaagcggggaaaaagatcccgtcccaatggctctcctcccccaaatcctccactctcctcaccccgcgctcgccgccgccgcctcctcctctcgcgcattctgccgagcaccacgccacctccatgtctcagcgtcccggggccggggccgcggccgcctcgccacggcggcgggggcgtccgggcccggaccatcatcgccggagccatctccccctgagtccgacgacgggctggtggagctcccgctgttccctctcccgctcgtgctcttcccggacgccacgcacgcgctgcacatctcccaccatcgctaccgcatcatgatgcacacggtgctgcagaccgacctccgcttcgggatcgtcttcgtcggcaactcggggtccgccgcggagtggggctgcgtcggggaggtcgtcaaacacgagcgcctcgccgacgaccggttcttcctcatctgcaagggccagcagcggttccgcgtcgcccgcatcgtgcgcaccaagccctacctcgtcgacgccgtgcagtggctcgaggaccgctcgcccgcagagcccccggcgccc

SEQ ID NO: 52725 - protein, 83 aa, Zea mays
  misc_feature: Ceres CLONE 1470183-F
  misc_feature: SWISSPROT Homolog: EC 3.4.21.53 Endopeptidase La
MMHTVLQTDLRFGIVFVGNSGSAAEWGCVGEVVKHERLADDRFFLICKGQQRFRVARIVRTKPYLVDAVQWLEDRSPAEPPAP

SEQ ID NO: 52726 - DNA, 661 bp, Zea mays
  misc_feature: Ceres CLONE 1470185-F
  misc_feature: Translation starting site: 184
  misc_feature: SWISSPROT Homolog: EC 2.3.3.1 Citrate (Si)-synthase
  misc_feature (264)..(264): n is a, c, t, g, unknown, or other
  misc_feature (281)..(281): n is a, c, t, g, unknown, or other
  misc_feature (316)..(316): n is a, c, t, g, unknown, or other
aagctggagctccccgcggtggcggccgctctagaactagtggatcccccgggctgcaggaattcgtctcacccctagaaaaaaaagcgtccaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaagaggcggcngggctggagaggtcccnggtatcggcgccggcgcccgggccccgcgccggcncgcttgccgtggtggacgggaggaccgggaagcggcacgaggtcaggtctccgaagacggcaccgtgcgcgccaccgacttcaagaagataccactggaaaagacgacaggggtcttaagatttatgatccctgggtaccttaacactgccccctgttcgctcggtcatctggctacatcgatggagatgagggaatccttcgctataggggttatccaatcgaagatttggctgaaaacagctcgtttgttgaggtggcctaccttttaatgatgggaaccttgcctactcaaagtcaatgggcaggtgggaatttcctattcccaacatccggctttcccaag

SEQ ID NO: 52727 - DNA, 695 bp, Zea mays
  misc_feature: Ceres CLONE 1470196-F
  misc_feature: Encodes the peptide sequence at SEQ ID NO. 52728
aaaagctggagctccccgcggtggcggccgctctagaactagtggatcccccgggctgcaggaattcgtctcacccctagaaaaaaaaaaaattgattcagaggagttctgcatcgagaaagtggagttcgatgacaagaaggacaagaaggtggtggtggtgcgtgggaagttcgacgccgagaagctctgcaagaaggtgtggtccaaggccgggaagatcgtgaaggggattgtcatcgctgaggtgtggccaataccagccccgcccaaggagtgcaagcctgaggcaccgaaatgttgcgactgtgagaagtgcaagcccaagcccaagcctgagcccaccgaatgttgcgactgtgagaagtgcaagctcagcccaagcctgagccacgaaatgttgcactgtgacaaccccagccccagcctgagcttcccaaacagaaaatgctgcagtcgctgttgtcatggcaggcctaacctggaccccaaaccccgaattgttgggctggttccccctgaaatccggaaaaaaggaaaaaaaaaagggaaaaaaaagggccaaaaaagcccgggcccggcccaaaggggaaaacattttgggccctcaccgaaaccctgttgaaaaccccggtattttccaaatttgggcggggggaaaccccccccccaaaaaaaaggccatggtgtcccca

SEQ ID NO: 52728 - protein, 207 aa, Zea mays
  misc_feature: Ceres CLONE 1470196-F
KAGAPRGGGRSRTSGSPGLQEFVSPLEKKKIDSEEFCIEKVEFDDKKDKKVVVVRGKFDAEKLCKKVWSKAGKIVKGIVIAEVWPIPAPPKECKPEAPKCCDCEKCKPKPKPEPTECCDCEKCKLSPSLSHEMLHCDNPSPSLSFPNRKCCSRCCHGRPNLDPKPRIVGLVPPEIRKKGKKKGKKKGQKSPGPAQRGKHFGPSPKPC

SEQ ID NO: 52729 - DNA, 703 bp, Zea mays
  misc_feature: Ceres CLONE 1470197-F
  misc_feature: Encodes the peptide sequence at SEQ ID NO. 52730
aaagctggagctccccgcggtggcggccgctcttacatagaggagcccccgggctgcaggattccctctcacccctagaaaaaactctcctctctgattgtgttcttgggcgtatttggccccacccccaaaccgaatcgctctcctcgcgagcctgcgccaatgccccactccgctgacctcgcttcaagatggaccatctttgggaagaccctcaccgggaagactatcaccgtcaaggtggagtcctctgacgccattgacgatgtcaaggctaacatccatgacaaggagggcatccctcctgaccagcagcggcttatcttcgacggcaagcagcttgatgacggacccacacttgctgactactgcatcaagaaggagtcaaccctctacttggtgctgcgacttacccccaccacgcagatctttgtcaggaccttgactggagagacaaacctccttgaatgggagtcctcagacaccattgactatgtcaaggcgcagactcaggactagggaggcatcccacctggaacagcaacgtctcatctttcctgacagcaatctgaggataggaaggaccctttgctgactacaacatccggaggggagagccccctccaattggagctggggcctcaaggggggtattgccaaatctttggaaaaaccctagcggggaggaccaatgcctcttgga

SEQ ID NO: 52730 - protein, 118 aa, Zea mays
  misc_feature: Ceres CLONE 1470197-F
  misc_feature (16)..(84): Pfam Name: ubiquitin Pfam Description: Ubiquitin family
MPHSADLASRWTIFGKTLTGKTITVKVESSDAIDDVKANIHDKEGIPPDQQRLIFDGKQLDDGPTLADYCIKKESTLYLVLRLTPTTQIFVRTLTGETNLLEWESSDTIDYVKAQTQD

SEQ ID NO: 52731 - DNA, 689 bp, Zea mays
  misc_feature: Ceres CLONE 1470199-F
  misc_feature (165)..(165): n is a, c, t, g, unknown, or other
  misc_feature (247)..(247): n is a, c, t, g, unknown, or other
  misc_feature (248)..(248): n is a, c, t, g, unknown, or other
  misc_feature (351)..(351): n is a, c, t, g, unknown, or other
  misc_feature (352)..(352): n is a, c, t, g, unknown, or other
  misc_feature (360)..(360): n is a, c, t, g, unknown, or other
  misc_feature (413)..(413): n is a, c, t, g, unknown, or other
  misc_feature (456)..(456): n is a, c, t, g, unknown, or other
  misc_feature (459)..(459): n is a, c, t, g, unknown, or other
  misc_feature (500)..(500): n is a, c, t, g, unknown, or other
  misc_feature (524)..(524): n is a, c, t, g, unknown, or other
  misc_feature (530)..(530): n is a, c, t, g, unknown, or other
  misc_feature (531)..(531): n is a, c, t, g, unknown, or other
  misc_feature (662)..(662): n is a, c, t, g, unknown, or other
ggagctccccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggnggtagtactacacggcctctctcccggcagggcccgaaaggaggcaccacatgccccccttcttctcaagacccgcgtgacnntgacatgccaacgcggggaaggccaagccgtgcggcggcgtaccaggagcccgtggtacagaccccaacccgcctgctgtaccctggggcccactgtcctcgnngagccggncgagctaccttggaccgggcgaattccccgggggactaccgctcgggcacaanactgcgcgggcttgtcgcgacccctgagacgttcgcagaaccnggnagctggagtgatccactcccgctgggcatgctggcgcgctncgctgctctttcccgagctgtcgnccgcanncgctcagttcggaccagggcgtgtggttcagggcggctcccaatctttcgcgaaggtggactgactacctcaggaacccgagcctcatcactcgcagagatactcgcccatctggccctgccagacgtgcntcatggacgccgtcgagggctaaccgc

SEQ ID NO: 52732 - DNA, 697 bp, Zea mays
  misc_feature: Ceres CLONE 1470201-F
  misc_feature: Encodes the peptide sequence at SEQ ID NO. 52733
  misc_feature (386)..(386): n is a, c, t, g, unknown, or other
  misc_feature (412)..(412): n is a, c, t, g, unknown, or other
  misc_feature (470)..(470): n is a, c, t, g, unknown, or other
  misc_feature (503)..(503): n is a, c, t, g, unknown, or other
aaagctggagctccccgcggtggcggccgctctagaactagtggatcccccgggctgcaggaattcgtctcacccctagaaaaaatcccattctcgaagccgctgcggcacgcgtcccgcttctggtttgcttgcctcccagatcttgccaactaattggaggcacgcatcccgcaacgcgccgtctcgacggcggatcgttttcttctgcttctactgcgtgatctttgggcaagaagataagacacgtccaagcgtcgccacaaccaagggcggcttggttgcagtcaagatggggaaggacggagaatctgccaagctgaaggaggagaagaagtccaaggaagagatccatctgaaggtcaagagcaaggacgagcggtccngcgagaaagacggcaaggaggaggtncgagtagagattgaggcccaagtttgtgagaaggaagaggtcaaaagactcggtgacngtgcgggaagaaaaggtaccaagaagaaggatnccaaggaggaagacaagaaaaaggagggagggtggtgaggattcagggaaggccaagggaagacaaaaaagattaagccaaggaattcggaaggcaagggccccagttgaaaaaggaaaaaaaagatggttcttgggaaaccaccgaacgccaaagaaaagggccaaaaaaaaaaaaggtaaaaagggccaggt

SEQ ID NO: 52733 - protein, 82 aa, Zea mays
  misc_feature: Ceres CLONE 1470201-F
  misc_feature (32)..(32): Xaa is any aa, unknown, or other
  misc_feature (60)..(60): Xaa is any aa, unknown, or other
  misc_feature (71)..(71): Xaa is any aa, unknown, or other
MGKDGESAKLKEEKKSKEEIHLKVKSKDERSXEKDGKEEVRVEIEAQVCEKEEVKRLGDXAGRKGTKKKDXKEEDKKKEGGW

SEQ ID NO: 52734 - DNA, 683 bp, Zea mays
  misc_feature: Ceres CLONE 1470205-F
  misc_feature (380)..(380): n is a, c, t, g, unknown, or other
  misc_feature (387)..(387): n is a, c, t, g, unknown, or other
  misc_feature (395)..(395): n is a, c, t, g, unknown, or other
  misc_feature (407)..(407): n is a, c, t, g, unknown, or other
  misc_feature (413)..(413): n is a, c, t, g, unknown, or other
  misc_feature (415)..(415): n is a, c, t, g, unknown, or other
  misc_feature (418)..(418): n is a, c, t, g, unknown, or other
  misc_feature (454)..(454): n is a, c, t, g, unknown, or other
aaagctggagctccccgcggtggcggccgctctagaactagtggatcccccgggctgcaggaattcgtctcacccctagaaaaagccaatgctgcgccgcaacccaacccgcatcgagctcacctcctccgaccgcgacgagctcgaagaccacctccgcgccgccgcggcgagctccgcggcagccgccaccaccaaggatccttccggttacaccactccgtctccagtccttggcccgcagacctccaatcccctgctccaattcctccacccgaagcccggcgccgcgccatccaagtcccaacgcatcggcatcggcctctccacccgccggctcccggcccgaaaccgcgaccacccatccaccccatggaggntgagatncagctccngctccccgaagntcgcgngnacngcggcttgtcgggtttctggggccccggcttcgccnacccagggccaggggaacttcttcttgaacgacccccgggcacgtttgaaaccccaccgccgggttccggtccgctttaagaaggggccaaaaacggggggccttgggcggcgtctttcggttaaagccccccccgggaaaggggccgggtccaccccctccaggaaacgaaggaacccttggagcccggttttccgttccttgggcaaaaaacccccccccctggggg

SEQ ID NO: 52735 - DNA, 639 bp, Zea mays
  misc_feature: Ceres CLONE 1470212-F
  misc_feature: Encodes the peptide sequence at SEQ ID NO. 52736
  misc_feature (233)..(233): n is a, c, t, g, unknown, or other
aaagctggagctccccgcggtggcggccgctctagaactagtggatcccccgggctgcaggaattcgtctcacccctagaaaaaaccaccagcggtcaatttcgacgcctggagtcaaccggccgagtcgtccacctacgccttcacagttcacacgcgcggcggcggcggcggcggtggagcgggtgatgagggaagtggcgtgaaccaccgaatctcgcggtcgcggagcnggcgtcgcgggcgaacgagccccggtctctctcttctctgcgcgcaacctttccaaggaactcctctgatgctacagtaataatagaagaaagatggacctgctcagcatcattctagttatagcatctctgctcccattcgcagcatctgatggtcaaggtgatgccttgtacgatatgaagctgaaactaaatgctactggcagtcagctttctgactgggaccaaaatcaagtcaccccatgcacctggaattctgttatttgtgacacaacaaccatgttgtgcagtaacattggcttctatggggtttactgggagtctgtcacaagaatcggagatctggaggtattaaatggtctgtcctttgctgtaacaacatctctggtggcataccagaagattt

SEQ ID NO: 52736 - protein, 104 aa, Zea mays
  misc_feature: Ceres CLONE 1470212-F
  misc_feature (19)..(59): Pfam Name: LRRNT_2 Pfam Description: Leucine rich repeat N-terminal domain
  misc_feature: SWISSPROT Homolog: EC 2.7.11.1 Non-specific serine/threonine protein kinase
MDLLSIILVIASLLPFAASDGQGDALYDMKLKLNATGSQLSDWDQNQVTPCTWNSVICDTTTMLCSNIGFYGVYWESVTRIGDLEVLNGLSFAVTTSLVAYQKI

SEQ ID NO: 52737 - DNA, 716 bp, Zea mays
  misc_feature: Ceres CLONE 1470224-F
  misc_feature: Encodes the peptide sequence at SEQ ID NO. 52738
aaagctggagctccccgcggtggcggccgctctagaactagtggatcccccgggctgcaggaattcgtctcacccctagaaaaaaactcctctaccagccggcgcacgccgacgccgacgccgacgggcacagtactagcgaccgagctgcgagcgacgccagggcatgggtgacactggatcgcacatggcccactggggcgggctctacagtcggggcggccgcagcgacgtggtcccgcctgctacgacggagacggtgacgacggcaggatgcggccggccggtgtcgagcccgatgtcggctgggtcgtgtgccagctcgagctgtactgcgctcctgacctgggtcgggagtgcatggcagtagcctgaacaagaccacagggttgaagtttgaagacttccgggcccccgaccccgcaatttttcactgggccccatcgaataacctggcaaggagaccccatttgccgggtaccgggcgggggccaaaggttcccgccccagagcgaaagggggggctggtttaataattggggggtccaaaaaagggggagagacccgggggggcctttcccaaaagtgtgccaaaatgtgggttttccccccaaaaaaacaaaccaagggctgttgggggggggcccctaaaaaacccccggggaaaaagacccccccccctcctccgtgggagcgttctcaacggggggttgtgg

SEQ ID NO: 52738 - protein, 67 aa, Zea mays
  misc_feature: Ceres CLONE 1470224-F
MGDTGSHMAHWGGLYSRGGRSDVVPPATTETVTTAGCGRPVSSPMSAGSCASSSCTALLTWVGSAWQ

SEQ ID NO: 52739 - DNA, 705 bp, Zea mays
  misc_feature: Ceres CLONE 1470226-F
  misc_feature: Translation starting site: 137
acagctggagctccccgcggtggcggccgctctagaactagtggatcccccgggctgcaggaattcgtctcacccctagaaaaaaccagcggcatctatagcaaccgggccagcactttcacgctcagctccagcaatggatgcctccaccatggcgatctcctccacgagggataggccggcacccccatcaaggtgggctccttcggcgagggccgcatcaccatgtgcaagaacgagggcaaacccaaggtggtgcgctccgggagcccctggtacggagcccgaccgcgtcaagtacctcagccccttctccggcgagcccccgagctacctcaccggcgagttccccggcgactacggatggaacaccgactggctgtccgccgaccccgagacctacgccaataaccaccagcaccacgcgatccactcccgctggcacatgcacggcgcgctcggctgcaacatccccgagctgctctcccgtaacggcgtcaagttcaccgaggccgtctggctcacagccggctcccacatcttcagcgatggcggactggactacctcagcaacccagtctgatccaactcaaagcatcctcgtcatctgggcctgccaggaagtgctcatagatgctcgtaagggctactgcattgccggcgggccactcagcgaggtcatcaacccgctgtaccctggaggca

SEQ ID NO: 52740 - DNA, 736 bp, Zea mays
  misc_feature: Ceres CLONE 1470230-F
  misc_feature: Encodes the peptide sequence at SEQ ID NO. 52741
  misc_feature (377)..(377): n is a, c, t, g, unknown, or other
ggagctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcangggaggcatgcagatctttgtgaaaaccctgatctcccacactatcaccctcgaggtggagtcctctgacaccattgacaacgtcaaggtcaagatccaggacaggaagggcttcccttcagaacaggaagcggctcttctttgctgggctagcacttgaggaaaggggccacgcttggcgaattacaacatccaaaaaggaaaaaccccccccattggggggcgcgccctcggggggggggatggcaaaattttttgaaaaccccttgaccggaaaaaacataacccctctaaagggggaggctttttaagaaacgcctttcaaaacactcttaagggcacaaatatcccacggcacg

SEQ ID NO: 52741 - protein, 126 aa, Zea mays
  misc_feature: Ceres CLONE 1470230-F
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (74)..(74): Xaa is any aa, unknown, or other
MQIFVKTLTGKTITLEVESSDTIDNVKAKIQDKEGIPPDQQRLIFAGKQLEDGRTLADYNIQKESTLHLVLRLXGGMQIFVKTLISHTITLEVESSDTIDNVKVKIQDRKGFPSEQEAALLCWAST

SEQ ID NO: 52742 - DNA, 709 bp, Zea mays
  misc_feature: Ceres CLONE 1470232-F
  misc_feature: Encodes the peptide sequence at SEQ ID NO. 52743
aagctggagctccccgcggtggcggccgctctagaactagtggatcccccgggctgcaggaattcgtctcacccctagaaaaaatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaagaccccgagcacgcgcacaggcacaagatcacggaggaagtcgctgcccgcggcgccgtcggcgccggcggctacttattccccgagccccccgagaagaagaaggaccaccagggccgccaaggaggcttaacggccaaaaaaagccccaccccctcttccgggtgaacgtaattcccggccgggcggcgaacggaaaagttattagttcccggggaaaaaaacccaaaaccggtttaaatccgaccggccgggccggggaaattgaagggggccacaaaaagggccccc

SEQ ID NO: 52743 - protein, 132 aa, Zea mays
  misc_feature: Ceres CLONE 1470232-F
  misc_feature (41)..(120): Pfam Name: ABA_WDS Pfam Description: ABA/WDS induced protein
MSEEKHHHFFNHHKKDEEQPAGEYGYSETEVVTATGEGEYERYKKEEKEHKHKQHLGEAGAIAAGAFALYEKHEAKKDPEHAHRHKITEEVAARGAVGAGGYLFPEPPEKKKDHQGRQGGLTAKKSPTPSSG

SEQ ID NO: 52744 - DNA, 693 bp, Zea mays
  misc_feature: Ceres CLONE 1470233-F
agagctggagctccccgcggtggcggccgctctagaactagtggatcccccgggctgcaggaattcgtctcacccctagaaaaactcccgcacagacgccgacagctctcacttccgtccgatacatccaagaaacaacgcggaggcagccaccctggctgtcggaaagaacggcagaatctccaagggagagatgggaggcaagactcagaccgtccatcgcgtttctctcccaggtgttcgccatgacgtgcgagcgctccaaccgagtgcctcgcgagcggcgtaggtcagactctcctattccgtactgggcgccctcgattgctgctacaggatctgaaccacagagctctttgatgatcgcctagctgatcttcagggctaacgcaagatcaatctatacgcgataatcacgcctccccacttcaacatgtgtagggctggaatgtgctcacgaacttgtggggtaggaattttacccctgatacactgctacccatatcgactaaacgctgaaccttcatcgtcagcctggttaatgtaagaacaaccgactactacatgtgtccctgggtcagccactgctccatgaacagacgcctgaccaggtcaacacaacctgctatgctctgcatccacatccgtctcatccgcatcagatggtgagatatgatccaacggcttctgatg

SEQ ID NO: 52745 - DNA, 713 bp, Zea mays
  misc_feature: Ceres CLONE 1470249-F
  misc_feature: Translation starting site: 397
  misc_feature: SWISSPROT Homolog: EC 3.2.1.14 Chitinase
aaagctggagctccccgcggtggcggccgctctagaactagtggatcccccgggctgcaggaattcgtctcacccctagaaaaaacctcacaatcaagctgccccgcagcaacgaacactaaccttggcagaacgaagctgaagtaattctgtgtgaacccattatggcaaacgcgccgaggatcctggtcctcggcctggtgctggcgctcctgtgcgctgacgtcagcccggacgccgcgcacaactgcggctgccagcctaacttctgctgcatcaagatctgctactgcggcacgaacgaccactactgccgcgacctgagccactcgggcccgtgcctctcggacatcttcctcctgcgcatgggcatgcgcaagcagtggcggtgcgaacatgcctaacctggtcagcgacgcgttcttcaacggcatcaagaaccacgcctgcagcgggtgcgacggcaagaacttctacatcccgagcgcgttcctgaacgtcgtcaacaagtactccggcttcgactatggcaagacggaggtggagggcaagctcgacatcttcgccttcttcgcgcacgtcacgaacgagaccggacatttctactacgtcagcgagatcaacaaaagcaacgcctactgccacgaagcaacaggcagtggccgtgtgctgcggcgcagaattactatgaggacgtgccgctgctgatctcc

SEQ ID NO: 52746 - DNA, 593 bp, Zea mays
  misc_feature: Ceres CLONE 1470259-F
  misc_feature (157)..(157): n is a, c, t, g, unknown, or other
  misc_feature (361)..(361): n is a, c, t, g, unknown, or other
gctctagaactagtggatcccccgggctgcaggaattcgtctcacccctagaaaaaatacctcacctccgccgtcgcctcccctcatccctccaccggcccgtttgaccctctccctggctcgctcgttctcctcctcctccgtacccgtcctagtnagtttagcgctcaacagaacccaatcaccaccccggcgcccccgagagcagttgccttgccgtttgctgcggttccatatgggtgccccccgcgtcggcgtgagggctgcgcgcgctcgtgctgtttatcgggaggagatagatggggccccccttccgcagtagcgtcgtgatcaggggcactgtggtaggggtcctccttgnttggaatccccctgggcctgccgctggccccggggtttcccccccttcgggaccacttcccgtccatggaagccgaagcttccgttggttccggggggaaaaaaaattcccttttacaaaggggatgaaaacgattttggcccctattcagggaatattacgggaaaatataaaggggggtggattttttgggggccccaaaatggttcccctaaatttcttaagtttggga

SEQ ID NO: 52747 - DNA, 784 bp, Zea mays
  misc_feature: Ceres CLONE 1470292-F
aaagctggagctccccgcggtggcggccgctctagaactagtggatcccccgggctgcaggaattcgtctcacccctagaaaaaatcaccacatagaaataaaacactcccctcctgagtcctcacctcgtgctgccggcgccatttccacctcccagtgtcctttcgtccagtccccagccctgtagcccaaccgtggaggttctggaagggggtgtatcccttctagaaccttctccagatgcatagagccgcggctttccggcagtgccccactcggctgctggcgagcagcccttgtagcaccctcatctgggcccacccaattcttgtctccgccgctggcgccgtcgctaccagaaacaaggacgatgaccctcctggtcaggagcttcgggatgttggacaacttcacccgaccccccaagggaaagttcacccacctaacaggtgtaaatgcaaaccccattctggggaaggtttttgcgcttctcccaaaggcctaagagaaggagggggggccttctgaaaaagggattggggtttgtactgcgtcctatcaaacccccggggtccgtggttcaacactgtgctttccaagaaccctaccccacaacggggaatctaagggggttttcccatttccccttataaacagtcccggaaatgttaaaaattctctctttttaaaagtgttaacagggctagcttttcagtggggagaaaagggtttttttataaaaaaccccaaaaattttctttgggccacaagattttaaaatcg

SEQ ID NO: 52748 - DNA, 686 bp, Zea mays
  misc_feature: Ceres CLONE 1470293-F
  misc_feature: Encodes the peptide sequence at SEQ ID NO. 52749
aaagctggagctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcaaatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaagacgggcgcacgcttgccgactacaactccagaaggagagcaccctccacttggtggtgccccccaggggaggcatgcaaaatcttcgtggaaaaccctgaccgggaaaattttcccccttcgaggtgaaatcttccgacacg

SEQ ID NO: 52749 - protein, 169 aa, Zea mays
  misc_feature: Ceres CLONE 1470293-F
  misc_feature (6)..(74): Pfam Name: ubiquitin Pfam Description: Ubiquitin family
  misc_feature (82)..(143): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNSRRRAPSTWWCPPGEACKIFVENPDRENFPPSR

SEQ ID NO: 52750 - DNA, 676 bp, Zea mays
  misc_feature: Ceres CLONE 1470300-F
  misc_feature: Encodes the peptide sequence at SEQ ID NO. 52751
  misc_feature (672)..(672): n is a, c, t, g, unknown, or other
aaagctggagctccccgcggtggcggccgctctagaactagtggatcccccgggctgcaggaattcgtctcacccctagaaaaacacagagtgaggaggagtcgaggagcaggaggctagggtttaaggtgcacggcgatggcgacggcggcgaagaccctagcgcgggctggatcctccctcttcggccgcattctcgcgtccccttccataatccgccccgggctgcctctcgccgggctgcggccgcacttcccaccgacggcaccggcggggttggacgcttacgaggcggagaccgtcgccaggctgagctcgctccccggcgagatctccttcccctgcggcctcccctcgctccgcttcttcatcgacgacgttgaggatcctgttgctaatgaccctctccagttgcttccgaaaagaacttaccagcccagtaccatcaagcggaaaagaacccatggattccttacacgtaaatcgaccaagggtgggcgcaaggtgattgcccggagaatcgcaaaacgcaggcacagaatttcagtttagcaagatcccatagcatcactggatgttttctgtactacagattcgtatcgtgttctttgtgtgaacgacatatttttaagctcttttaaatttttgcataccaccctgctgaagcatgangctg

SEQ ID NO: 52751 - protein, 137 aa, Zea mays
  misc_feature: Ceres CLONE 1470300-F
  misc_feature (94)..(137): Pfam Name: Ribosomal_L34 Pfam Description: Ribosomal protein L34
MATAAKTLARAGSSLFGRILASPSIIRPGLPLAGLRPHFPPTAPAGLDAYEAETVARLSSLPGEISFPCGLPSLRFFIDDVEDPVANDPLQLLPKRTYQPSTIKRKRTHGFLTRKSTKGGRKVIARRIAKRRHRISV

SEQ ID NO: 52752 - DNA, 677 bp, Zea mays
  misc_feature: Ceres CLONE 1470315-F
  misc_feature: Encodes the peptide sequence at SEQ ID NO. 52753
  misc_feature (515)..(515): n is a, c, t, g, unknown, or other
  misc_feature (528)..(528): n is a, c, t, g, unknown, or other
  misc_feature (529)..(529): n is a, c, t, g, unknown, or other
aaagctggagctccccgcggtggcggccgctctagaactagtggatcccccgggctgcaggaattcgtctcacccctagaaaaattattatccacaacactcatcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagccctacacattgacaatctggtcaagtctctcaaattcgtcaccaacaaacgcgcttacggaccgtacggcagggacgagggcaccccgttccgtgtncaggtgatgaacnnacgccacgtcgcttgctttctttggcgctctggagattgcctggacgcgatcgggctctacgtgaaccccaactatactaaaacgatggatcggatcatctgcatgcatgcatatgcagtatgcatgctgcttggcctgctgtaacaa

SEQ ID NO: 52753 - protein, 174 aa, Zea mays
  misc_feature: Ceres CLONE 1470315-F
  misc_feature (15)..(150): Pfam Name: Jacalin Pfam Description: Jacalin-like lectin domain
  misc_feature (127)..(127): Xaa is any aa, unknown, or other
MGKPAKIGEWGGYAGDRRDLRATPDRLIEVKVTADNSSCIRSISFIYIGADGKPYEEGPWGFGHAGTEYKIDLCRFDESLTEISGTTGPALHIDNLVKSLKFVTNKRAYGPYGRDEGTPFRVQVMNXRHVACFLWRSGDCLDAIGLYVNPNYTKTMDRIICMHAYAVCMLLGLL

SEQ ID NO: 52754 - DNA, 675 bp, Zea mays
  misc_feature: Ceres CLONE 1470320-F
  misc_feature: Encodes the peptide sequence at SEQ ID NO. 52755
atagctggagctccccgcggtggcggccgctctagaactagtggatcccccgggctgcaggaattcgtctcacccctagaaaaaatccaccaccatcctctgccttgtcgatcatccatcgaccgcctcctgctcggcttcccaccccgcctgcctgcgttgcacaccagggaggagctcctccgaccgaccggccatgagctaccaggctcctcctccgggcacctcagcctacccgccgccgggcacggcctaccctccgccaggccagccgcaggcgtacccgccgccggcatacggcgcgccgccacccatggccgccggcgggtaccctcccccgccgcagcaggactctaagggcggcaacgacggcttcctgaaaggatgcttggccgctctctgctgctgctgcatgctcaacatgtgcttctgagttcgtcgtcaggggctcagggcacggggatggcgcgcctagagtccagaccgatctccatcatgcactcaggcgataaacaatgcatggagctgttctttttttttccttcctttctgaatcatgacgatgatacatctttgtttccgtttccatcctgtatatgctttcacgtgctatgcatggaaacttcactagctaccccagcagggattatgttctctggcccacaaaaataaaaa

SEQ ID NO: 52755 - protein, 78 aa, Zea mays
  misc_feature: Ceres CLONE 1470320-F
MSYQAPPPGTSAYPPPGTAYPPPGQPQAYPPPAYGAPPPMAAGGYPPPPQQDSKGGNDGFLKGCLAALCCCCMLNMCF

SEQ ID NO: 52756 - DNA, 657 bp, Zea mays
  misc_feature: Ceres CLONE 1470325-F
  misc_feature: Encodes the peptide sequence at SEQ ID NO. 52757
  misc_feature (490)..(490): n is a, c, t, g, unknown, or other
  misc_feature (626)..(626): n is a, c, t, g, unknown, or other
aaagctggagctccccgcggtggcggccgctctagaactagtggatcccccgggctgcaggaattcgtctcacccctagaaaaagctactggttgctagtgctaccaagaacaggaaggaaacaccgccgccgccgcgccttccattccagtactcgcggaggaaaggaacaccagccagcgccatggtcacgtcgacgaccgccgccgccgtgctgtccccgccgtccgtggccgggcttcgcctggcgccgtctccccgggcgcgcgtggcgttccgcgcggcgccggcgcggcggtccgtggcggcgcgcgcggagctgagcccgtcgctggtgatcagcctgagcacgggcgtgtcgctcttcctgggccgcttcgtcttcttcaacttccagcgggagaacgtggcgaagcaggtgcccgagcagaacggcaagacgcacttcgacgccggcgacgagcgcgccaagtagttctcgggcctgctncagtccaacgaccccgtgggcttcaacctcgtcgacgtcctcgcctggggctcgctacggcacatcgtcgcctactacatccttcgcacctccagcaacggatacgaccccaacttcttctgagcggcgggctgcnggcatgttcttgagcctgcctgtattctact

SEQ ID NO: 52757 - protein, 96 aa, Zea mays
  misc_feature: Ceres CLONE 1470325-F
  misc_feature (45)..(97): Pfam Name: PSI_PSAK Pfam Description: Photosystem I psaG / psaK
MVTSTTAAAVLSPPSVAGLRLAPSPRARVAFRAAPARRSVAARAELSPSLVISLSTGVSLFLGRFVFFNFQRENVAKQVPEQNGKTHFDAGDERAK

SEQ ID NO: 52758 - DNA, 756 bp, Zea mays
  misc_feature: Ceres CLONE 1470327-F
  misc_feature: Encodes the peptide sequence at SEQ ID NO. 52759
  misc_feature (341)..(341): n is a, c, t, g, unknown, or other
  misc_feature (756)..(756): n is a, c, t, g, unknown, or other
aagctggagctccccgcggtggcggccgctctagaactagtggatcccccgggctgcaggaattcgtctcacccctagaaaaaaaccaagaacaaaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggnggcccagcatcccatgttctgcttctggatccggatgcgggggaaatccccaactcctccctcctttcgtctcccaccggaatgtgagggcgacgatcagatggaagcccggcggggttctcctcgggtctgccaggccttcctccccccctcaagggaatgactttccctggcccctaaaaaattatcggaaccattttcccgagaagttttcagccaagagcctaggaaaacatggcccccctggaaaaaaggcccacgctaaggccggacggcctggtcaaaacaaactcggatggaccccgcaggcccctcctggggttacaccaatattccggcgccttttaaggaaggggaaaatatttaacgccggggtctcccctgggggggcgcccctttttatccggcgcttgtn

SEQ ID NO: 52759 - protein, 35 aa, Zea mays; identical to SEQ ID NO: 7877
  misc_feature: Ceres CLONE 1470327-F

SEQ ID NO: 52760 - DNA, 674 bp, Zea mays
  misc_feature: Ceres CLONE 1470331-F
  misc_feature: Encodes the peptide sequence at SEQ ID NO. 52761
aaagctggagctccccgcggtggcggccgctctagaactagtggatcccccgggctgcaggaattcgtctcacccctagaaaaaacttgctataaaaagaggtgtccatggtgctcaagctcagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtggtggtggttgaacaataataagcgaggccgagctggctgccatacataggtattgtgtggtgtgtgagagagagagagaaacagagttcttcagtttgctatctctctctctgcatgtttggcgtcagtctttgtgctcatgtacgtgtgtctacatgcatgttggttgatccgattgcgtctgctgtaacatatatt

SEQ ID NO: 52761 - protein, 76 aa, Zea mays; identical to SEQ ID NO: 42649
  misc_feature: Ceres CLONE 1470331-F
  misc_feature (1)..(76): Pfam Name: Metallothio_2 Pfam Description: Metallothionein

SEQ ID NO: 52762 - DNA, 764 bp, Zea mays
  misc_feature: Ceres CLONE 1470332-F
  misc_feature: Encodes the peptide sequence at SEQ ID NO. 52763
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (55)..(55): n is a, c, t, g, unknown, or other
gaaaaaaacaccacggannnnngattggtgtgcttcctcctctgcaaattttttntaaaaatggagctccccgcggtggcggccgctctagaatagtggatcccccgggctgcaggaattcgtctcacccctagaaaaacccctcgcgcaccgctcctgtccaccctgccaccgccgccgccgccccgccgcatcaactgtcaccgtcgctatgggccgtatcaaggtgcacgagctccgggggaagagcaagacggacctgcaggcgcagctcaaggagctgaagtctgagctctccctcctccgcgtagccaaggtcaccggcggcgcaccctgcaggctctccaagatcaaggtggtgcgcacctcgatcgcgcgcgtgctcacagtgatctcgcagaaacaaaaatcggcgttgcaggacgcgtactagaagaaaaacctgctccccctctacctccgccctaataagaaccgtgccatccctcgtacgtctgaccaaacaacaaccttcctctgaataccgagaggcgaaaagaaaacgtgaagaagtactctccccgtggaaggaaataggccttccctgggccctataggtcagaaacgtgtgattatgcttgtggcttgagccatttatcatacggccctggtggatttaaaattttctcgggctttgcgaagggcacaaattttgcttgtggaagatagcaaaaagggctgtgtccctctagggtgttctccgctagaaaaaatcggagtctaaa

SEQ ID NO: 52763 - protein, 73 aa, Zea mays
  misc_feature: Ceres CLONE 1470332-F
  misc_feature (6)..(64): Pfam Name: Ribosomal_L29 Pfam Description: Ribosomal L29 protein
MGRIKVHELRGKSKTDLQAQLKELKSELSLLRVAKVTGGAPCRLSKIKVVRTSIARVLTVISQKQKSALQDAY

SEQ ID NO: 52764 - DNA, 899 bp, Zea mays
  misc_feature: Ceres CLONE 1470336-F
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
acaaaaaaaataaaggaggggagaagtactctcacnncnnnnanntggagtttttcaaaactggagctccccgcggtggcggccgctctagaactagtggatcccccgggctgcaggaattcgtctcacccctagaaaaggcttttgcttgcttgcttcctcctctcccgtcgggaactcgggctcgtcagactgcgcccgggcgccgaatctccagacgggatcgcgccccccgtctgactcctccggtgccggagcccacggctaccgcccgcctctgcctccgatctataagaaacattgaacaaccgtactgaacataataagtaccggaaatctcctcggttgtcctcggttgttgcaataaatgggggtaactccattgccctctttggaggataaacggaccatattggtgtttcggaatgaacccccccaccccctgctatcttgggcaaggttgtgatcaatcctactggatccatggttgggccctttggcccctgctgcggacgcggttaccatctttggtgagctatatactgctgaggaatctggtggatcatacctggcgtttgcggcgctcctcccaaaaggaataggaattattccgcccctaagagatgccaaacaatttgatagctggcggagtaggaccttcctctaaccccccaggtgcttggaatttccttgagctctttgtgaacagtccagcattccaaagagggtgtttgtaaagccccttcctcccaaaaggggcgaattcgcccaagaatggggattgtcatctcacttgggatttggctcctatgagatatgtcttttctacgaccaagggggttaccgctatagaaatatagggcgtatgttctctttaataatggggagcatctctcggg

SEQ ID NO: 52765 - DNA, 672 bp, Zea mays
  misc_feature: Ceres CLONE 1470339-F
  misc_feature: Encodes the peptide sequence at SEQ ID NO. 52766
aaaactggagctccccgcggtggcggccgctctagaactagtggatcccccgggctgcaggaattcgtctcacccctagaaaaaattgggtccaacaccagccgccgccatgtcgaagcgaggcaggggaggttcggcggggaacaagttccgcatgtcgctgggtctgccagtggccgcgacggtgaactgcgcggacaacaccggcgccaagaacctctacatcatctccgtcaagggcatcaagggccgcctcaatcgcctcccgtccgcctgcgttggcgacatggtcatggccaccgtcaagaaggggaagcccgacctcaggaagaaggtgatgcccgccgtcatcgtccgccagcgcaagccgtggcgccgcaaggacggggtctacatgtacttcgaagataatgctggagtgattgtgaatcccaagggtgagatgaaaagttccgctatcactggacctatcggcaaggagtgtgctgatctttggcctaggattgctagcgcagcaaacgccattgtttgagagcttgttggaatatgttcagacttctatatgatcatcttattatcagttgctagactgcattggggcttatgtttgttcactcaattttgtagtaaacagaatttggtatacccaaggggatctatattacaatgtat

SEQ ID NO: 52766 - protein, 140 aa, Zea mays
  misc_feature: Ceres CLONE 1470339-F
  misc_feature (19)..(140): Pfam Name: Ribosomal_L14 Pfam Description: Ribosomal protein L14p/L23e
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKSSAITGPIGKECADLWPRIASAANAIV

SEQ ID NO: 52767 - DNA, 777 bp, Zea mays
  misc_feature: Ceres CLONE 1470343-F
  misc_feature: Translation starting site: 162
  misc_feature: Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
  misc_feature (206)..(206): n is a, c, t, g, unknown, or other
  misc_feature (420)..(420): n is a, c, t, g, unknown, or other
aaagctggagctccccgcggtggcggccgctctagaactagtgaatcccccgggctgcaggaattcgtctcacccctagagagatcctcttgttggaacaccacaggaactggggcatcaagtgactcttatccgccaagttgctgagaaagtgttcgccaatgtgggcaaagactatcgggtacaaagttggaacaatgattganatccccaggggagctctgggggctgatgagatagcggaacacgctcaattcttcttccttcgaaccaacgatcttgtttttatgcccttggggggggggtggggaacaagggggaaaatcgtaatccccgccgggcttgcccaggggcgggctttttttttggcccccccccaggggggccgcgcggcccggggttttgtgccaacttttactnaaaccaccccccccccccccaagaggggggcgaccccgcgctcgagggggggggggggggcattcaccaccatctgcaaggggcgcggctagtgggtccccgcgcggagacccgcggccccctaacatacccgatatctccccccccctttttctgccccggtcacttacctccccgtagtaccgccccttatgtctgttactgcgcaaccccccggacccgtgaaccccccgcaccccacccgccaagacacgttctgcgcgccccgtgcgccgcacatgttgggatgcgcccgcgcgccagcacgtattaaagcggccgatcaaatccggatgacctgccgcccgcccggctgtg

SEQ ID NO: 52768 - DNA, 691 bp, Zea mays
  misc_feature: Ceres CLONE 1470347-F
  misc_feature: Encodes the peptide sequence at SEQ ID NO. 52769
  misc_feature (409)..(409): n is a, c, t, g, unknown, or other
  misc_feature (424)..(424): n is a, c, t, g, unknown, or other
  misc_feature (482)..(482): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
aagctggagctccccgcggtggcggccgctctagaactagtggatcccccgggctgcaggaattcgtctcacccctagaaaaaaaattcgagccctgaaatcccaaaagcccaaaccaaatccaagcgcaagagggggcaaagccgcaaagggggaggcaccaggcaccggcagccattacttactggtcctcactcccacaccaaccaaccaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggngaggcccctgcccgngcgccgcccgctgccccttctgcgctgcgcaggacagtgcctgcagataggatgcacnagctggtgccaggtgtccttcagaggtcagcactgcaccacagtagaggacccatcacgcgtcggtcatggactaccaactccataaggactttattaaacggnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnn

SEQ ID NO: 52769 - protein, 37 aa, Zea mays
  misc_feature: Ceres CLONE 1470347-F
  misc_feature (3)..(3): Xaa is any aa, unknown, or other
MHXLVPGVLQRSALHHSRGPITRRSWTTNSIRTLLNG

SEQ ID NO: 52770 - DNA, 712 bp, Zea mays
  misc_feature: Ceres CLONE 1470359-F
  misc_feature: Encodes the peptide sequence at SEQ ID NO. 52771
  misc_feature (375)..(375): n is a, c, t, g, unknown, or other
  misc_feature (376)..(376): n is a, c, t, g, unknown, or other
  misc_feature (379)..(379): n is a, c, t, g, unknown, or other
aaagctggagctccccgcggtggcggccgctctagaactagtggatcccccgggctgcaggaattcgtctcacccctagaaaaaagaaaaaacaactgtcctggcctgtccacggtccacacacgccttccttatatcggcgctcacggttctataaaaaagacacagtacgagcagagcacggcggccgtgagctgagctgagggaaggacgacgtacggcacagatgctagcccggccgccggagctctccgtgatctgagccgccagcaacaacatgggtgccgcgctcttggcttcttggccatgggacaacctcggcttctacaagtacgtcctgtacgggccactagtgggcaaggtggtggtgtaacnnccntgggaggcggtaagcccctaccgctggatcctcctcctgatcttcctcttcggcctccgcgcgctcacctaccagctctggagctccttcagcaacatgctcttcgccacacgccggcgccgcgtcttccgcgacggcgtcgacttcgaccagatcgacaaggagtgggactgggacaacttcctgatcctggacgccctagatgacggcctgggaacagtgccgcgttccacgacgctgcgaggatcttcccggcctaggaaccagcccggggtattcaaccgtccccgctcggttggcccaagccggctgggcaaccgaagccccatctcc

SEQ ID NO: 52771 - protein, 79 aa, Zea mays
  misc_feature: Ceres CLONE 1470359-F
MLFATRRRRVFRDGVDFDQIDKEWDWDNFLILDALDDGLGTVPRSTTLRGSSRPRNQPGVFNRPRSVGPSRLGNRSPIS

SEQ ID NO: 52772 - DNA, 788 bp, Zea mays
  misc_feature: Ceres CLONE 1470361-F
  misc_feature: Translation starting site: 152
  misc_feature (332)..(332): n is a, c, t, g, unknown, or other
  misc_feature (413)..(413): n is a, c, t, g, unknown, or other
  misc_feature (418)..(418): n is a, c, t, g, unknown, or other
  misc_feature (419)..(419): n is a, c, t, g, unknown, or other
  misc_feature (423)..(423): n is a, c, t, g, unknown, or other
  misc_feature (426)..(426): n is a, c, t, g, unknown, or other
  misc_feature (427)..(427): n is a, c, t, g, unknown, or other
  misc_feature (433)..(433): n is a, c, t, g, unknown, or other
  misc_feature (435)..(435): n is a, c, t, g, unknown, or other
  misc_feature (443)..(443): n is a, c, t, g, unknown, or other
  misc_feature (461)..(461): n is a, c, t, g, unknown, or other
  misc_feature (467)..(467): n is a, c, t, g, unknown, or other
  misc_feature (490)..(490): n is a, c, t, g, unknown, or other
  misc_feature (491)..(491): n is a, c, t, g, unknown, or other
  misc_feature (663)..(663): n is a, c, t, g, unknown, or other
tccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcaatgccggcggccgcatccccatgccccgcaccccccagaacgttccccaaagccaatggaacggccctgacaccccccagaaatctggcccctatccccaaaccaacnccactccaacttaattttttaaatttccctggggggccaccgattttagaaatttttagaacatttttaatatgatgcctncccgnnctcnctnnaaatananatatttanaaaaaaaattactaaccnaaccgnccacccccacaacccaacccggnncgcgcgcctttcaactagatatacagtattaaaccctacgtacgcgccccccaattaccacctcgcgctggaagctaggcgtactcattacccatccgaccaccctactcaccaactcccctacctctaaccccgtggaaagaacacaatttatatccccgtcctaccccgncataaatatcgcgcgttccgtatgtcttcttttgtacccccccctccccatagtaaatacaaacatccgacacccctccaactccacgccgtgcagtatccgcttcaacgtggctaggttggtgg

SEQ ID NO: 52773 - DNA, 580 bp, Zea mays
  misc_feature: Ceres CLONE 1470365-F
aagctggagctccccgcggtggcggccgctctagaactagtggatcccccgggctgcaggaattcgtctcacccctagaaaattctcctcggaggaggcgatgcgatagcgccatctgtggcatgaacggcaaggagctggacagccacaacatcaccgtcaacgcagcccggtcccgcggcggccgtggaagccgcggcgatggataccgtgctgcccgtgaagggcggctcatacggatctggacaggcgccaatgttgtggggcacgatactgggtggctcagaaggttcgtggagcccccggtacctggtggatggtgaattacgaactgccaccgtggcggcccctaaggacccccccggaacttggagaactaacccttggcccaaaatggcaaccaccccggttgtaccgggtgttcccccttcccaaaggggttttcccgggcaagcacctcctcttttcccatcggccccttttttttaagaggccccccggtctttttttttcgccaacacccctcctgggggggactctcccccttttctccgaatccccccccccgaacgccgcccga

SEQ ID NO: 52774 - DNA, 636 bp, Zea mays
  misc_feature: Ceres CLONE 1470367-F
  misc_feature: Translation starting site: 211
ggagctccccgcggtggcggccgctctagaactagtggatcccccgggctgcaggaattcgtctcacccctagaaaaaagggctgcatatatcccgtgggctcattgcgtgttcgatcgatcggatccccactacgatctactagctagctaagctactcgactcaaccgaggaggaggagcgagctcaggccgtatacagactagccacatgtcggtgaccagccaagtgtctgggcctcccggctaccggcggtggtggatctattacatcgtctacgatactgatcaattgaagtaaagttctcaaccgacctgatcacctggtggtgctcatgttctcggcggactggaacgaaccctgcaaggcgattaataaaccgctcacggacatggccagggctacaaagatgcaggccggattctgcttagtgggacatcgacaagcttaaagatgctgcggtgcaacagttccaagtggaggcgctgccgacgttcgcgctgtactagaacggcatacacaaagggagggtcgttggcgccgatgtggacgacctcagagccgccctcgacagcaacatatgattccatctccgatcgatcgatccattcgtgctgcatgcatactatcgactaa

SEQ ID NO: 52775 - DNA, 679 bp, Zea mays
  misc_feature: Ceres CLONE 1470374-F
  misc_feature: Encodes the peptide sequence at SEQ ID NO. 52776
  misc_feature (655)..(655): n is a, c, t, g, unknown, or other
caaagctggagctccccgcggtggcggccgctctagaactagtggatcccccgggctgcaggaattcgtctcacccctagaaaaactagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaagggtcttcgcgaggctgccaaggccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactccgagggcaaggcaaggaaggttgtaggctgctcctgtgtcgttgtcaaggactacggtgaagaatctgagggccttaacatagtgcaggagtatgtcaagtcgcactagatgtaacacgtttcagtaatactctacatttggatctgggcttaatattatgcttgcgtcttgggcttgctnagagattaggacaatttactacaa

SEQ ID NO: 52776 - protein, 140 aa, Zea mays; identical to SEQ ID NO: 4593
  misc_feature: Ceres CLONE 1470374-F
  misc_feature (25)..(120): Pfam Name: Ribosomal_L7Ae Pfam Description: Ribosomal protein L7Ae/L30e/S12e/Gadd45 family

SEQ ID NO: 52777 - DNA, 743 bp, Zea mays
  misc_feature: Ceres CLONE 1470382-F
  misc_feature: Encodes the peptide sequence at SEQ ID NO. 52778
  misc_feature (395)..(395): n is a, c, t, g, unknown, or other
  misc_feature (743)..(743): n is a, c, t, g, unknown, or other
tctagaactagtggatcccccgggctgcaggaattcgtctcacccctagaaaaagctactgggttgctagtgctaccaggaacaggaaggaaacaccgtcgctgccgcaccttcgattccagtactcgcggaggaaaggaacaccagccagggccatggtcacgtcgacgaccgctcccgccgtgctgtcccctccgtccgtggccgggctacgcctggcgccgtctccccgggcgcgcgtggctttccgcgcggcgacggcgctgaggtccgtggcggcgctcgcgtgagctgagcccgtcgctggtgatcagcctggactggggcgtgtttttattcctggaccccttcgtcttcttcgagttccagcggggggaatgggtcccaccccacanccccaaacaaaaacgggcaggaacactcttttaacacccggcgcacaaggcgcgccctaggaagtattggggggcctggtttcagtttccacgccaaccgccgggggggtattaaacccttcgtccaacaatccctcccccttgggggtttcgcgtcgggacaaagtgggtcccccttgataaaattctatatattaccctcctacccacccgaaaaccggcccctaactttttttctgaagcgggcccggtttgcggggcctggcttttgtagaccatgcctggttattccaatcccgtgggggcgtgtgaaccgcttattgtccgtatggctcagcggatggcgtn

SEQ ID NO: 52778 - protein, 44 aa, Zea mays
  misc_feature: Ceres CLONE 1470382-F
MVTSTTAPAVLSPPSVAGLRLAPSPRARVAFRAATALRSVAALA

SEQ ID NO: 52779 - DNA, 691 bp, Zea mays
  misc_feature: Ceres CLONE 1470386-F
  misc_feature: Encodes the peptide sequence at SEQ ID NO. 52780
  misc_feature (420)..(420): n is a, c, t, g, unknown, or other
  misc_feature (434)..(434): n is a, c, t, g, unknown, or other
aaagctggagctccccgcggtggcggccgctctagaactagtggatcccccgggctgcaggaattcgtctcacccctagaaaaaaccagcctccaccccatcaaccctacctaggcgccgccgccgccgcaggcggcccccgcatcgtcggcaagatgcagatctttgtgaagactctgacggggaagaccatcactttggaggtggagtcctcggacaccatcgacaatgtgaaggccaagatccaggacaaggagggcatccccccggaccagcagcggctcatcttcgccggcaagcagctcgaggacggtcgcaccctcgccgactacaacatccagaaggagtccaccctccacctggtgctccgcctccgcggcggcgcctagaagcgtaagatgaagacgtacaccaagcctnagaagatcaagcancagcacaagaaggtgaagctctccgtgctgcagttctataaggtggacgacaccactagacaggtgacccggcctccgcaggagtgccccaactcaaagtggcggcgcgggcgtcttcttgggcaaccacttcgaccgccaatactgcggggaggtgcggcctacctttgtcttcaacaaaaagcgctatttgttggcccgatttggtttttcggcctaccctttggggatcccgtttgtgggtaccaaaactgttc

SEQ ID NO: 52780 - protein, 77 aa, Zea mays
  misc_feature: Ceres CLONE 1470386-F
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGA

SEQ ID NO: 52781 - DNA, 640 bp, Zea mays
  misc_feature: Ceres CLONE 1470390-F
  misc_feature: Encodes the peptide sequence at SEQ ID NO. 52782
ctggagctccccgcggtggcggccgctctagaactagtggatcccccgggctgcaggaattcgtctcacccctagaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgcccgcaacgctgccaaggacaaacaagaagacgcgcatcgtcccgcgccacgtgctgctggcgatccgcaacgacgaggagctcgggaagctgctgaccggcgtgaccatccgccccgggggggttgttggccaacatcaacccggttccggctggcccaaaaagacggcggaaaaaggcttccaggggcggggagcaggaaggccaagtcccccaagaaggccgccaagccccccagaaagggatagggtttgg

SEQ ID NO: 52782 - protein, 161 aa, Zea mays
  misc_feature: Ceres CLONE 1470390-F
  misc_feature (31)..(93): Pfam Name: Histone Pfam Description: Core histone H2A/H2B/H3/H4
MDATGTGAGGKAKKGAAGRKAGGPRKKSVTRSVKAGLQFPVGRIGRYLKKGRYAQRVGSGAPVYLAAVLEYLAAEVLELARNAAKDKQEDAHRPAPRAAGDPQRRGAREAADRRDHPPRGGCWPTSTRFRLAQKDGGKRLPGAGSRKAKSPKKAAKPPRKG

SEQ ID NO: 52783 - DNA, 657 bp, Zea mays
  misc_feature: Ceres CLONE 1470411-F
  misc_feature: Encodes the peptide sequence at SEQ ID NO. 52784
ctggagctccccgcggtggcggccgctctagaactagtggatcccccgggctgcaggaattcgtctcacccctagaaaaaaaccccggaacagagcgaggcgacgccgaggcacctcatctccggcgaagggaaatggcgaccgttccaggggatctgatctggcagattgtgaggaagaacaactccttcctggtgaagcagtttggcaacggcaatgccaaggtgcagttcaccaaggagcccaacaacctctacaatttacactcctacaagtactctggcttagcaaacaagaaaactgtaacgatccagccagctgctggaaaggactcggctgtggtcctctctactacccagacctagaagcagaacacacccgcgaagctcagcccacagtctgtgatgcgcaaggagttcccgcagatggccaaggctgtgaaaaaacaggttggccaacacctttttacagggcctgatctgacaaatccggcccttgggagggaaacctttggtacccccccccccatgtttccaattttggggaaaaaaaaaaaaaaaagggccccccccccaaccgggttttttttttgtggggccccacccccccccctttttttttttccccccgccccccccctgttttgtttttggtaaa

SEQ ID NO: 52784 - protein, 76 aa, Zea mays
  misc_feature: Ceres CLONE 1470411-F
  misc_feature (5)..(76): Pfam Name: Ribosomal_L28e Pfam Description: Ribosomal L28e protein family
MATVPGDLIWQIVRKNNSFLVKQFGNGNAKVQFTKEPNNLYNLHSYKYSGLANKKTVTIQPAAGKDSAVVLSTTQT

SEQ ID NO: 52785 - DNA, 752 bp, Zea mays
  misc_feature: Ceres CLONE 1470415-F
  misc_feature: Encodes the peptide sequence at SEQ ID NO. 52786
  misc_feature (318)..(318): n is a, c, t, g, unknown, or other
ggagctccccgcggtggcggccgctctagaactagtggatcccccgggctgcaggaattcgtctcacccctagaaaaaacgaccgcttggcgcttcatcactcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcacttccttcaacggaaagcggttcggcgcctagncccgcccaagcggttcggggccccaccacgccccatcaagggggggggcccaatttgccctttcccggtccgaatttccaagggaggaaggccccaacgggagcacaatccagttccctttacaccctttttttggggtctcttaaacccgggaaaacccgggcccaaaaaggggcaaagggggaaaaccccgccccccaaagggggaagggcccccccccccagggggggcccccctttacccccaaggggggcccccaaaaaaaccagggaaaccccggggggcccccccgaaatttgcgggtagaagaagagattccccccaagggttatcctattgggggttaaaaaaccctctctccccctggttggaagggttcccagaacggcccccccttaaataaaagaagagaggcgcctccctcccccccccc

SEQ ID NO: 52786 - protein, 152 aa, Zea mays
  misc_feature: Ceres CLONE 1470415-F
  misc_feature: SWISSPROT Homolog: EC 4.1.1.49 Phosphoenolpyruvate carboxykinase (ATP)
  misc_feature (51)..(51): Xaa is any aa, unknown, or other
MATPNGLARIETTGKKKQDNGVWYDDSSAPVRAQTIDELHFLQRKAVRRLXPPKRFGAPPRPIKGGGPICPFPVRISKGGRPQREHNPVPFTPFFWGLLNPGKPGPKKGQRGKTPPPKGGRAPPPRGGPPLPPRGAPKKTRETPGGPPEICG

SEQ ID NO: 52787 - DNA, 838 bp, Zea mays
  misc_feature: Ceres CLONE 1470419-F
  misc_feature (38)..(38): n is a, c, t, g, unknown, or other
  misc_feature (40)..(40): n is a, c, t, g, unknown, or other
  misc_feature (432)..(432): n is a, c, t, g, unknown, or other
tggcgccccccccccgcatacccccccccccccccccncncctcccccctcaaagctggactccccgcggtggcggccgctctagaactagtggatcccccgggctgcaggaattcgtctcacccctagaaaaaaaaccccctagagttgtaggagagagaatagactatattatggaagaggtaaagtatatatgcattcaggggggccaagtcaggttagatctatatctttaatgcctacaagacagtcatcttttgcgtggctttctaaagaatgatttcagaatcggattcaatagaaaatgagaaaataggcaaacaaaatagaagacacaaatgtatatggggatttcttttattcctaagttagattcctcacctaatccgatatacggacattcccttctatatggaactggattgggggggnaagcccgatgcagcactattcgtattaaattggggtaccccacactcttgccccccaatgggaatttggaatgtagatcgactcccaatgggggggtttttccccggacctcccccccctttcatctccggcgcgaaaagaagggggtaaaaaaaatggggcaaccccaaggcacaccccccatattttccaacaaaatcgcgttgggccactgccaaaaagcggcattgttttttggcgcagcacacggaacgccgagccgcttattttggggcaagccttttggggcgtttttttccaacaccccctcccttgtgttgctttttttgagccccctatcacaccggggtttgcgccccaaatagcatttctgacgccgcgtcttttgtgtccatttggtctccgt

SEQ ID NO: 52788 - DNA, 730 bp, Zea mays
  misc_feature: Ceres CLONE 1470425-F
  misc_feature: Encodes the peptide sequence at SEQ ID NO. 52789
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (379)..(379): n is a, c, t, g, unknown, or other
aagctggagctccccgcggtggcggccgctctagaactagtggatcccccgggctgcaggaattcgtctcacccctagaaaactcccgctcccctcatcgccttcgtggcctggcctgcccgtcgtgtgcgcctctgcgcctctccctccctccctccctcccccgatcgtaaccgccgcctccgatcgatcgccacgatgcggctcttctgacgaaccgccgggcgcgtcaccgtcaccgaccgagacccgcgcccctcgcctggactccatggccgcgtcctccccgatggtgctgtcgctgctcctcttggcgtcgctcaccgcgctgctggtcctcgcgccgcgcctgtccccggcggagtcgcggaaggnnnancagggtccggcggcccccggtgggggtggcttccaccagcaggaggaggccaaccacccccgcctgttcctccgcgcggctttgggattcgtcgggggcggggctgccccccccagggggggccttccgggttctgaaccaaatcccgagctcaccttcggccccttatttgggggcgctttttttcccggggaataagggcgcgggttgcggggttacttttcacgcccaaccgggccgggcgggcttgggccttggctggcccacccccccttctttcggggggccgctttctggggcgcgccaggggccccaattgggttttttcaccccctgtctcccttgtccccc

SEQ ID NO: 52789 - protein, 101 aa, Zea mays
  misc_feature: Ceres CLONE 1470425-F
  misc_feature (35)..(35): Xaa is any aa, unknown, or other
  misc_feature (36)..(36): Xaa is any aa, unknown, or other
MAASSPMVLSLLLLASLTALLVLAPRLSPAESRKXXQGPAAPGGGGFHQQEEANHPRLFLRAALGFVGGGAAPPRGGLPGSEPNPELTFGPLFGGAFFPGE

SEQ ID NO: 52790 - DNA, 499 bp, Zea mays
  misc_feature: Ceres CLONE 1470426-F
  misc_feature (194)..(194): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
aaactggagtccccgcggtggcggccgctctagaactagtggacccccgggctgcaggaattcgtctcacccctagaaaaaattattatccacaacactcatcgatctacacacatacatagtttcttctactacacgacgacaaacatggggaagcctgcgaagatcggagagtgggggtggatacgccgggncgaatcgtcggggatcctgaaggggcttactcccgggacccgggttgaatccaagggggaaagggtccccggggggggaaaaaaaaggggagggggggaaaccggggccccaaattcccccttttaaatttaaaaaattggggaaaacccccaaatggggggaaaaaaacccccttaaaaaaaaaaagaggggggggcccccccggggggggggtttttttttcccccccccttttttttttggttggggccccccccgnnnnnnncaaaccaaaaaaataaatttgtgttccccccgccggggt

SEQ ID NO: 52791 - DNA, 825 bp, Zea mays
  misc_feature: Ceres CLONE 1470429-F
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (266)..(266): n is a, c, t, g, unknown, or other
  misc_feature (273)..(273): n is a, c, t, g, unknown, or other
ggccgccgcccccccccattccccccccccccccnnnnnnnnccccccaaactggagctccccgcggtggcggccgctctagactagtggatcccccgggctgcaggaattcgtctcacccctagaaaaagaccagtgagctgcttgtccaagaatcgctcccactcccggctgtcgggagagcgcagcccagctagccgcctccgcttcttggaggtcgatggccgcgaaggggttgagggaggtggggaggaggagggcggcanaatgacntctgtacttctacggaagactgaacagtagtaattatcactcaagcatgtaaaacaagcaacggtagtaagttggaaaccaatcaaagatgcttatcgagtcgctcgttgctaccctgcccatcggataccagctgtatatagttttggtaccacacctgtttgcgccggttgggccctccacttgttataagggggcccccccccaccccctctcttaaaacgcaaaaatcgttccgcccccccatctgggatccctcaactttgcaaaaaagtaactcgtacataccccccgctatggccaatgttcagtttaaatcccccccccctttctagcgccttccttgtgtacggccggcctttcccaaccttcccggcgggccggggttttattgtcggggaacaacttggtcggcagtcccttaatataaccacctcttgttcctccctcttgtgcgcgccacccccgcgggccggcttattttttggtgaaggaccggcttctcccgccagatgcgctttttatctcccccatggtcgcggcgttcccacg

SEQ ID NO: 52792 - DNA, 674 bp, Zea mays
  misc_feature: Ceres CLONE 1470430-F
  misc_feature: Encodes the peptide sequence at SEQ ID NO. 52793
  misc_feature (379)..(379): n is a, c, t, g, unknown, or other
  misc_feature (674)..(674): n is a, c, t, g, unknown, or other
tcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagtgtaaccgcaccacaccctcgtacgtcgccttcaccgactccgagcgcctcatcggagatgcgggcaagaaacaggtcgccatgaacccccatcacaccgtctttggatgcccaccccncccattggcaggagggtttagggatccctctgtccaaaaggatattaagctggggccccttaagggtatttccttggccccggtgaagatcccaatgatagtttgttccaccacagggggggaggaaaaaacagttttgcatgcccaagaagatcccccccccttgggtttttcatccaaaatgcggtgacaattctctttgagcctcttcctttgggcctcactccaatccaaaaaagggcgttttgcccccgtgttcccttttcttttccttccacggaccttcagggggggn

SEQ ID NO: 52793 - protein, 138 aa, Zea mays
  misc_feature: Ceres CLONE 1470430-F
  misc_feature (76)..(76): Xaa is any aa, unknown, or other
MAGKGDGPAIGIDLGTTYSCVGVWQHDRVEIIANDQCNRTTPSYVAFTDSERLIGDAGKKQVAMNPHHTVFGCPPXPLAGGFRDPSVQKDIKLGPLKGISLAPVKIPMIVCSTTGGEEKTVLHAQEDPPPLGFSSKMR

SEQ ID NO: 52794 - DNA, 650 bp, Zea mays
  misc_feature: Ceres CLONE 1470433-F
  misc_feature: Encodes the peptide sequence at SEQ ID NO. 52795
aaagctggagctccccgcggtggcggccgctctagaactagtggatcccccgggctgcaggaattcgtctcacccctagaaaaaaaagcatggctgtggactagagtctgattaattatgatgtcctcctgcgtgtgcaccagtgctgcccagactttgtggagctcatggtgtctgcactgtacgtggatgatgagatggtctcattcatctgcaactctcttcctcgtctgaagaatttggagataccaagttgtgacatgtcttccgctgctattataaggttccttgattgcctagagcatctcgtgcacctggacatctcaggttacgagatatcagccatctcaagcccggttcttgacaaagcttcgcggctcatggtcttcctctggaactcgaaatttgagcttggccagttcatggactgctccaattgtggagagcacaacattaaccctcaagaaccctgcaagtgcatgatggagcacaaggtcatggactggctggctggaccttcataagctacctgaaccaaaggcgtctcttcttgtgtcttgttaaatcatgacgttttcctggctgtaaaattccaacctctgtcaaagttggtgtctgagctgtatgtacaaggaaatatgccacttcaa

SEQ ID NO: 52795 - protein, 118 aa, Zea mays
  misc_feature: Ceres CLONE 1470433-F
MVSALYVDDEMVSFICNSLPRLKNLEIPSCDMSSAAIIRFLDCLEHLVHLDISGYEISAISSPVLDKASRLMVFLWNSKFELGQFMDCSNCGEHNINPQEPCKCMMEHKVMDWLAGPS

SEQ ID NO: 52796 - DNA, 782 bp, Zea mays
  misc_feature: Ceres CLONE 1470434-R
  misc_feature (782)..(782): n is a, c, t, g, unknown, or other
cgtccaatactaagttccaaattcacacaagtccaaatacataagttcacaatttcacataagttcacatccatatttcacatttttagttcacaagttcaaacattagctccatcgctctcgatcaggacatcggattgttgttcgtagctccaccactagaattgagacatctgtccgcaaagtcagcgtgaggggcaggagtcacttgatgagagccagaatcaggatccatcaccgtcgccataagcgcccaagtttgctctgttcctgcacacgccgctggtgttcctttgaacgctcaataaacttagcagcaacatcatgaccttgataggatgccagcactgtcctaatgtcagaaggtctagccatggcaacatctgcaaattcacaaattcacataagtcgaaatacataagttcacaaattcacataagtggcgctggcgagccgatcgaggccggcggtgctggcgagccgatcgaggccgagcttgggcagcggacggcgagccgaggccgagctgggtggtggtggcgccgaggccgagctggggcagtggggcggtggtgagctgagcttgcgccgaggccgagctgagcggaggcgcggtctgctgggggtggtgcggcctgctggtggcgcggcctgctggtgtggcggcggcgacgccgagcttagcggagcctggggcggtggtgcggcggcggctagccggggcggtcagggcccagctggcgagcccgggcggcggcgatacccgcagatttccattttcn

SEQ ID NO: 52797 - DNA, 688 bp, Zea mays
  misc_feature: Ceres CLONE 1470435-F
  misc_feature: Encodes the peptide sequence at SEQ ID NO. 52798
  misc_feature (292)..(292): n is a, c, t, g, unknown, or other
  misc_feature (338)..(338): n is a, c, t, g, unknown, or other
  misc_feature (339)..(339): n is a, c, t, g, unknown, or other
aagctggagctccccgcggtggcggccgctctagaactagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaagtcgacancgtctcacgcgccggcgccaaccacaccccacacatggtcaccacnngcgccacggctttctggtgcgcgagacccagggtcgagaagacatcaacacctggcaccggcaattccacgagcgcagggaaaccttcctccgcagggttaattgagcccccccggggccggtatccaccccccttccgggtttgccggggggccttataattcccctgggttaaacgggttggccagggccctccgaattgggttttggaaaggggccccccctccctccccgggacaaataaacaaaaaaaccccggggccccgaaaaaaaacctccccccggttccttaaccccccccccaaaaaaaaaaaaaaaaaaaaagaacccctggggggccacatttccc

SEQ ID NO: 52798 - protein, 111 aa, Zea mays
  misc_feature: Ceres CLONE 1470435-F
  misc_feature (43)..(43): Xaa is any aa, unknown, or other
  misc_feature (59)..(59): Xaa is any aa, unknown, or other
MAYYQEVDYCSEEVRSVAPAGFGRHGGGVQQHVVKEKFEEVDXVSRAGANHTPHMVTTXATAFWCARPRVEKTSTPGTGNSTSAGKPSSAGLIEPPRGRYPPPFRVCRGAL

SEQ ID NO: 52799 - DNA, 724 bp, Zea mays
  misc_feature: Ceres CLONE 1470436-F
  misc_feature: Encodes the peptide sequence at SEQ ID NO. 52800
aaagctggagctccccgcggtggcggccgctctagaactagtggatcccccgggctgcaggaattcgtctcacccctagaaaaagcatcgttccctcctctgcacccccatcctcggacctcctcgtctgcagcagaccctcctctggtgcgcgtgcgccgccggcgagatgtcgaagaaaatcgtggtgaagctgcacctgcaggacaacaaggacaagcagaaggccatgaaggctgtctcggcgctcaccggcatcgacgagatatccgcggacatggcgtcccacaagatgacggtggtcggcatggtggaccccgtgagcgtggtgagcaagctgcgcaaggcgtcgtggtcggcgaccatcgagtcggtcggccccgccaaggagtcggagaagaaggacgggaaggccgccccccacccaaggcgctagggccaaaaaaaggaaggcgctagggggagaaaaggaaaccgggcagggggaaaaaaaagaagcgggcggccagaaggacaacccctccgggaaaaaaaaaaaaaaaaaaaaacacctcctcgtcgccgccccattccaaattatgggaaaaacctccgaagcccaaaaaaaaaagtctccaaccttaaaaagggtttccttccctttggggggggggcaaaaagcctacctaccttttttgtttttcaaagaccgagccgagggggaaaaaaaaaaagaaaccctctt

SEQ ID NO: 52800 - protein, 88 aa, Zea mays
  misc_feature: Ceres CLONE 1470436-F
MSKKIVVKLHLQDNKDKQKAMKAVSALTGIDEISADMASHKMTVVGMVDPVSVVSKLRKASWSATIESVGPAKESEKKDGKAAPHPRR

SEQ ID NO: 52801 - DNA, 699 bp, Zea mays
  misc_feature: Ceres CLONE 1470440-F
  misc_feature: Encodes the peptide sequence at SEQ ID NO. 52802
  misc_feature (331)..(331): n is a, c, t, g, unknown, or other
tcccccgggctgcaggaattcgtctcacccctagaaaaaaaaacccagctcaggcacaaccccaacgcaccgccgccgctcgcctggcctcacctctccggagaagagttataagacaggagaaccccgtccccggggagcaggcctcggcagcttccgtgaccaccgcccaatcttgccacagctgccctccctcctcccctctgggcgtggcctagttgtaggcatcacggctagcgatgcagcccctcggtgcggccccgcaactgctcatgtggagtccacgggcactatcacctccgctgtcgcgtccagggctagttctttacancaaccttcagggcgctgtccatcagccaggagaaaggccccccccaaccccatcttcctcgacggggggcggttggccgctgaaaccattcctggcctccccactttcttaccttttcctaaaaaattaagcccctttttgttaacccctcccgggaactccgaaccagtgcctcctcccgaagaagtaactggacccgaccttacccggcgggggaagaataaagattgacccctccagaagggtcccccgagcgcgctctttccaaattacccaggaggaaaccctcaaattattttcgtttttgggaaattccgtgaaaaaacaagtccccggattacattgttttcctgtcgcggcctcccaag

SEQ ID NO: 52802 - protein, 73 aa, Zea mays
  misc_feature: Ceres CLONE 1470440-F
  misc_feature (31)..(31): Xaa is any aa, unknown, or other
MQPLGAAPQLLMWSPRALSPPLSRPGLVLYXNLQGAVHQPGERPPPTPSSSTGGGWPLKPFLASPLSYLFLKN

SEQ ID NO: 52803 - DNA, 684 bp, Zea mays
  misc_feature: Ceres CLONE 1470444-F
  misc_feature: Encodes the peptide sequence at SEQ ID NO. 52804
agagctggagctccccgcggtggcggccgctctagaactagtggatcccccgggctgcaggaattcgtctcacccctagaaaaaaactagtctcacgtggtcatcactcaacgcgccgccgccgccgccaccgccagcaatggcgcgccgcctcttctgtgccacgagaacgctcctccttcctgccccagctcccgtgccggcgcccacctctgcgtcttctgcagcggccgcggaagcgtcggcctcgctcctgccactgctcccctgcaagcggagaaagaagctcctgaggaagctcaacagcccacgggtcgcgcctatcaagccggaggccgcgcgtcgcgttccggccctcgacgccgtgctcgaccgcgatacggccattcgcttcctccaccgggcgcgctcattctctgccaccctcccgtcaccgcaccggatcctccttgccgaggctggaaagctgtaccgcgagctcggcttccctcgcggccgcaaagtgtcgcgctccgctacgcgccacccgctgctgttccacctcccagtcgtggactccgttccgcacatcgcgctcacgccgttcatgtgctccctcctcgaggaagagcgccgcatccacgacgacctcctccctttcggggtgctcgcagtcaggaggctcttcatgctcacagcccacgg

SEQ ID NO: 52804 - protein, 32 aa, Zea mays
  misc_feature: Ceres CLONE 1470444-F
MCSLLEEERRIHDDLLPFGVLAVRRLFMLTAH
